United States Patent 11,098,302 (IDENTIFICATION OF POLYNUCLEOTIDES ASSOCIATED WITH A SAMPLE) - sequence listing, part 89

SEQ ID NO: 308506 - DNA, 674 bp, Homo sapiens
  misc_feature: GZ8MTXP02HBY3C.9.12.B01.1.454.CMB.2.raw
  modified_base (415)..(415): a, c, t, g, unknown or other
  misc_feature (415)..(415): n is a, c, g, or t
tcagtgatacgtctcacgaccggtgctcgatttagtagtgtagattccgcgggcgtagactttgtgtttctcgtagtctgctttgctcagcgtcagggtgctgctgaggctgtaggtgctgtccttgctgtcctgctctgtgacactctcctgggagttacccgattggagagggccaccatcaactgcaagtccagccagagtgtttatacggctccgacaacaagaactacttagcttggtatcagacaagaaaccaggacacgacctacctaaactgacctacaattaactgggacactcctacccggcaacgtcccggggtccctgaccgtattcaggtcggacgaggcgggtctacggggacagtactttcactctacaccatcacgcacgcctgaccgagctagaaagngtgtggtacttaggtttaacttacgttacgtacctaaacgtttacggttttccgtccggggtcgtttaccgggaaccgtaaacggggtaaccgtaaagggttacggaaaacgttaaccgaaaacgtacgttacgggtacggaccgttacggacccgtaccgtaacttaccggttacgttccgtttaccgtaaccgtttacccttccccggtacctaacgttacccgtaaggtaaaaccggtaccgtttaaaccgtaccg

SEQ ID NO: 308507 - DNA, 584 bp, Homo sapiens
  misc_feature: GZ8MTXP02FHI3W.9.12.B01.1.454.CMB.2.raw
  modified_base (188)..(188): a, c, t, g, unknown or other
  misc_feature (188)..(188): n is a, c, g, or t
  modified_base (253)..(253): a, c, t, g, unknown or other
  misc_feature (253)..(253): n is a, c, g, or t
  modified_base (264)..(264): a, c, t, g, unknown or other
  misc_feature (264)..(264): n is a, c, g, or t
  modified_base (419)..(419): a, c, t, g, unknown or other
  misc_feature (419)..(419): n is a, c, g, or t
  modified_base (483)..(483): a, c, t, g, unknown or other
  misc_feature (483)..(483): n is a, c, g, or t
  modified_base (525)..(525): a, c, t, g, unknown or other
  misc_feature (525)..(525): n is a, c, g, or t
  modified_base (528)..(528): a, c, t, g, unknown or other
  misc_feature (528)..(528): n is a, c, g, or t
tcagtgatacgtctcacgaccggtgctcgatttagtagtgtagattccgcggggagctctgggagaggagcccagcactgggattccgaggtgtttccattcagtgatctgcactgaacacagaggactcgccatggagtttgggctgagctgggttttccttgttgctatttaaaaggtgtccagtntgaggtgcagctggtggagtcgtgggggagcttggtccagccgtgggggtccctgaacctctccngtgcagcctcngatacaccgtcagtagtaactccatgaaccgtgggtcccgccaggcctccggaggggtaagggcgtgggagttgggtctcgtagtttattataggtcggtacggtaacacatacctacgcaagcctccgtagaacgggcatattcaaccagtccncccgaaggaactaccaaagttcccaaagggaaccacgtcctagtactcttacgaaatcaaaccncgacgagacgacggacgaagaccgagtctagtaatacttagnggngagagagtacgtgtacgtaacgtcgttacgtacgtacgtacggtacggacgaacgg

SEQ ID NO: 308508 - DNA, 566 bp, Homo sapiens
  misc_feature: GZ8MTXP02HHYFS.9.12.B01.1.454.CMB.2.raw
  modified_base (264)..(264): a, c, t, g, unknown or other
  misc_feature (264)..(264): n is a, c, g, or t
  modified_base (432)..(432): a, c, t, g, unknown or other
  misc_feature (432)..(432): n is a, c, g, or t
  modified_base (503)..(503): a, c, t, g, unknown or other
  misc_feature (503)..(503): n is a, c, g, or t
tcagtgatacgtctcacgaccggtgctcgatttagtagtgtagattccgcgggggctctgggagaggagcccagcactgggattccgaggtgtttccattcagtgatctgcactgaacacagaggactcgccatggagtttgggctgagctgggttttccttgttgctattttaaaaggtgtccagtgtgaggtgcagctggtggagtcgtgggggaggcttggtccagccgtgggggtccctgaaactctcctgtgcagcctntggatacaccgtcagtagtaactccatgaactgggtccgccagctccgaggggaagggctggagtgggtctcgagttattagtagcggtaggtaaccacgatactacgcacgactccggtagaaggcagattcaccactctccaaggacactaaattcccgaagaacncgtactgtactcgttacaaatgaacagcctagacgtagtacggagacgacggtctagttaatactttacgngtagacgagagtagtcgtacgttacgttgtttagactacgtcggtacgggaacgaacggtacg

SEQ ID NO: 308509 - DNA, 581 bp, Homo sapiens
  misc_feature: GZ8MTXP02G4KVP.9.12.B01.1.454.CMB.2.raw
  modified_base (467)..(467): a, c, t, g, unknown or other
  misc_feature (467)..(467): n is a, c, g, or t
  modified_base (478)..(478): a, c, t, g, unknown or other
  misc_feature (478)..(478): n is a, c, g, or t
  modified_base (511)..(511): a, c, t, g, unknown or other
  misc_feature (511)..(511): n is a, c, g, or t
  modified_base (551)..(551): a, c, t, g, unknown or other
  misc_feature (551)..(551): n is a, c, g, or t
tcagtgatacgtctcacgaccggtgctcgatttagtagtgtagattccgcggggagctctgggagaggagcccagcactgggattccgaggtgtttccattcagtgatctgcactgaacacagaggactcgccatggagtttgggctgagctgggttttccttgttgctattttaaaaggtgtccagtgtgaggtgcagctggtggagtcgtgggggaggcttggtccagccgtgggggtccctgaactctcctgtgcagcctctggatacaccgtcagtagtaacctccatgaacgtcggtccgccaggcctccggaggggaagggctgggaggtgggtctcgtagtttatttagaggtcggtaggtaacacatactacgcagccgtccgtaggaagggacagactcacctagtcctaccgaagacgaactaacttaccgaaggaaccacgtctagtactcttaanaaaatgaaacncgtaccgtagaacgagtacggaggtacacggtntagtaattatacgtgtcgagagagtatgtagtaaccgttntttaggatagtccggtaggggactaaaggg

SEQ ID NO: 308510 - DNA, 573 bp, Homo sapiens
  misc_feature: GZ8MTXP02JPGOL.9.12.B01.1.454.CMB.2.raw
  modified_base (210)..(210): a, c, t, g, unknown or other
  misc_feature (210)..(210): n is a, c, g, or t
  modified_base (282)..(282): a, c, t, g, unknown or other
  misc_feature (282)..(282): n is a, c, g, or t
  modified_base (287)..(287): a, c, t, g, unknown or other
  misc_feature (287)..(287): n is a, c, g, or t
  modified_base (296)..(296): a, c, t, g, unknown or other
  misc_feature (296)..(296): n is a, c, g, or t
  modified_base (314)..(314): a, c, t, g, unknown or other
  misc_feature (314)..(314): n is a, c, g, or t
  modified_base (442)..(442): a, c, t, g, unknown or other
  misc_feature (442)..(442): n is a, c, g, or t
  modified_base (502)..(502): a, c, t, g, unknown or other
  misc_feature (502)..(502): n is a, c, g, or t
tcagtgatacgtctcacgaccggtgctcgatttagtagtgtagattccgcgggcgtagactttgtgtttctcgtagtctgctttgctcagcgtcagggtgctgctgaggctgtaggtgctgtccttgctgtcctgctctgtgacactctcctgggattacccgattggagaggccaccatcaactgcaagtccagccagtagttgtttanacggctaccgaacaacaagaactacttagcttaggtatcagacaagaaaccaggtacagaccctactaaacngactnaattaacgnggcactccgtacccgganaacgtcccgggtacctagaccgtattccgaggtcgcgaggcgggtctacggggacagtcttaccactctcaccatcgagtccagtccctagaccaggctaaggagtagtggtagtcttagttattacngtactacgttagtttcgaggtcgtacgacgaaggacgagtagaactagaactagtaggtnacgtactaccaccttatccgttcttacctctaccgttaccctccgactcgttacagaacccgtatacaccg

SEQ ID NO: 308511 - DNA, 676 bp, Homo sapiens
  misc_feature: GZ8MTXP02IGMTA.9.12.B01.1.454.CMB.2.raw
  modified_base (363)..(363): a, c, t, g, unknown or other
  misc_feature (363)..(363): n is a, c, g, or t
tcagtgatacgtctcacgaccggtgctcgatttagtagtgtagattccgcggggagctctgggagaggagccccagcactgggattccgaggtgtttccattcagtgatctgcactgaacacagaggactcgccatggagtttgggctgagctgggtttccttgttgctattttaaaaggtgtccagtgtgaggtgcagctgggtggagtcgtgggggaggcttggtccagccgtgggggtccctgaactctcctgtgcagcctctggatacaccgtcagtagtaactccatgaactgggtccgccaggctccgagggaaggggctgggagtgggtctcgagttattatagcggtagtaacanatactacgacagcgtccgtagaaagggcagtattaccgaccattcacccgaagaacgaactaaacgttacccgaaagggaaacccacggtcctaggttactacctttacaaaattcggaaacacggtacccgtaggaacggtaggttaccggaaggaaccgtaccggggtacttaggttaaacttaagttttaaaccgtgggttacggtaccggaaggaacggtaacgttggttaggtaaaccggtttccgttttttaaggggaacctttaaagggttccgggttacgggggtaaaccccgtaaaaacggggg

SEQ ID NO: 308512 - DNA, 574 bp, Homo sapiens
  misc_feature: GZ8MTXP02IZRZ3.9.12.B01.1.454.CMB.2.raw
  modified_base (455)..(455): a, c, t, g, unknown or other
  misc_feature (455)..(455): n is a, c, g, or t
tcagtgatacgtctcacgaccggtgctcgatttagtagtgtagattccgcgggggctctgggagaggagcccagcactgggattccgaggtgtttccattcagtgatctgcactgaacacagaggactcgccatggagtttgggctgagctgggttttccttgttgctattttaaaaggtgtccagtgtgaggtgcagctggtggagtcgtgggggaggcttggtccagccgtgggggtccctgaaactctcctgtgcagcctctggatacaccgtcagtagtaactccatgaacgtcgggtcccgccaggcctccgaggggaacggggcgtggaggtgggtctcgtagtttatttagtagtcggtaggtaaccacatactacgcacgactccgtgaaggcagatcacatctccagagacatccaaggaccagctagatcttaagaaatcgaacngcctaggaagacgtcgaaggcaacggcttagtatatttaacgtggtagacgagagtagttaggttcgtaccgttgtttttagactttacgtcggtacggggaccgtaaaggggtaaccg

SEQ ID NO: 308513 - DNA, 694 bp, Homo sapiens
  misc_feature: GZ8MTXP02GWQ4C.9.12.B01.1.454.CMB.2.raw
  modified_base (249)..(249): a, c, t, g, unknown or other
  misc_feature (249)..(249): n is a, c, g, or t
  modified_base (505)..(505): a, c, t, g, unknown or other
  misc_feature (505)..(505): n is a, c, g, or t
tcagtgatacgtctcacgaccggtgctcgatttagtagtgtagattccgcggggattgtgaagtgagctacaacaggcaggcaggggcagcaagatggtgttgcagacccaggtcttcatttctctgttgctctggatctctggtgccgtacggggacatcgtgatgacccagtctcagacctcctggctgtgtctcgtgggcgaggacggccaccatacaactgacaagtccagcagtgttagtttanacggctaccgaacaacaaagtactattagcttaggactcaagacaacgaaaccgaggacacgtaccctaactaaactcgacttactaagttaacgcgggactacgtaccgtaccccccggactaaaccggtccccggggtaccctacgtaccgtattcgaggtcggacgacgggtccggggtacgtacggggacagttctttaccaccttacctacaacccgtataccgaaggaccacgacccgtgacgtacggtntaagggaagtagttcggggtacggttacttaaggttttactaacggttctaaccttaaacgtttcgggtttccggtcggggtaccggttaccggaccggtaaaacgggtaaccggtaaaggggtaaacgtaaaacgtaaccgtaaaacgacgttacggggttaacggccttacggacctaacggttacg

SEQ ID NO: 308514 - DNA, 671 bp, Homo sapiens
  misc_feature: GZ8MTXP02IGGYT.9.12.B01.1.454.CMB.2.raw
  modified_base (583)..(583): a, c, t, g, unknown or other
  misc_feature (583)..(583): n is a, c, g, or t
  modified_base (619)..(619): a, c, t, g, unknown or other
  misc_feature (619)..(619): n is a, c, g, or t
tcagtgatacgtctcacgaccggtgctcgatttagtagtgtagattccgcgggggctctgggagaggagcccagcactgggattccgaggtgtttccattcagtgatctgcactgaacacagaggactcgccatggagtttgggctgagctgggttttccttgttgctattttaaaaggtgtccagtgtgaggtgcagctggtggagtcgtgggggaggcttggtccagccgtgggggtcctgaactctctgtgcagcctcgtggactacaccgtcagtacgtaactccatagaacgtcgggtcccgccgacggcgtaccggaggggaacggggcgtgggagggtgggtctcgtagtttatttagtaggtcggtacggtaacactactactacgacacgacgtcggtaggaagggacagtacttacacctacttcccacgaagaacgtaactaaacttacccgaaacgaaccaacgtacttagtaacttacttaaacgaaaagtacggaaacacgtaccgttagggaaacggacggtaggaacggaaccgacgggtccttaagtaattacgtttaacgtgggnggacggtaaggagttagttcggttcgttaccggttntttttaggaatttacggtcggttacgggggaaacccgttaagggggtaaacg

SEQ ID NO: 308515 - DNA, 568 bp, Homo sapiens
  misc_feature: GZ8MTXP02GKARB.9.12.B01.1.454.CMB.2.raw
  modified_base (300)..(300): a, c, t, g, unknown or other
  misc_feature (300)..(300): n is a, c, g, or t
  modified_base (468)..(468): a, c, t, g, unknown or other
  misc_feature (468)..(468): n is a, c, g, or t
  modified_base (486)..(486): a, c, t, g, unknown or other
  misc_feature (486)..(486): n is a, c, g, or t
  modified_base (535)..(535): a, c, t, g, unknown or other
  misc_feature (535)..(535): n is a, c, g, or t
tcagtgatacgtctcacgaccggtgctcgatttagtagtgtagattccgcggggagctctgggagaggagcccagcactgggattccgaggtgtttccattcagtgatctgcactgaacacagaggactcgccatggagtttgggctgagctgggttttcctgttgctatttaaaggtgtccagtgtgaggtgcagctggtggagtcgtgggggaggcttggtccaggccgtggggggtccctgaactctcctgtgcagcctctggatacaccgtcagtagtaactcatgaactggtccnccaggctccgaggggagggctggagtggggtctcgtagttatttataggtcggtaggtaaacacgtatactacggacacgccgtccgtaggaacgggcagtattaccacaatcctaccaagagaacaacgttacccaaggaaccacgtctgtactctacaaatgaacngcctagagagtcgagacncggactggtaatattcgtggactcggaatacggattgtacgtaacgttntttagattacgtcggaggggtacccaaaagggg

SEQ ID NO: 308516 - DNA, 658 bp, Homo sapiens
  misc_feature: GZ8MTXP02GWVOD.9.12.B01.1.454.CMB.2.raw
  modified_base (250)..(250): a, c, t, g, unknown or other
  misc_feature (250)..(250): n is a, c, g, or t
tcagtgatacgtctcacgaccggtgctcgatttagtagtgtagattccgcggggattgtgaagtgagctacaacaggcaggcaggggcagcaagatggtgttgcagacccaggtcttcatttctctgttgctctggatctctggtgcctacggggacatcgtgatgacccagtctccagactccctggctgtgtctcgtgggcgagacgggccaccatcaactgacaacgtccagccagtagttgtttanacggctacgaacaacaagtactacttagcttggatcagcaacgaaacaggacacgaccctacctaaaactgacctactaacttaacgtgggacctaacgtccgtaccccccggtacaaacggttcccccgggggtccctacggaacccgtatttcgacggttcgggccgaacgggtccggggtacgtaggggaactacggttactttaccacttcctaccaacctatccgaacgccaacgcccgtagaccgaggggtaccttaggaaagtcgttaggtacggtacttaaggtttacttacgtacggtactaaacgtttggtttccggtcgggttcgttacggaccgaaagggtaccgtaagggtacgaacttaacgaacgtaacgtggtacgactcgaccaccgttag

SEQ ID NO: 308517 - DNA, 570 bp, Homo sapiens
  misc_feature: GZ8MTXP02H2W2Z.9.12.B01.1.454.CMB.2.raw
  modified_base (303)..(303): a, c, t, g, unknown or other
  misc_feature (303)..(303): n is a, c, g, or t
  modified_base (305)..(305): a, c, t, g, unknown or other
  misc_feature (305)..(305): n is a, c, g, or t
  modified_base (346)..(346): a, c, t, g, unknown or other
  misc_feature (346)..(346): n is a, c, g, or t
  modified_base (421)..(421): a, c, t, g, unknown or other
  misc_feature (421)..(421): n is a, c, g, or t
  modified_base (424)..(424): a, c, t, g, unknown or other
  misc_feature (424)..(424): n is a, c, g, or t
  modified_base (450)..(450): a, c, t, g, unknown or other
  misc_feature (450)..(450): n is a, c, g, or t
tcagtgatacgtctcacgaccggtgctcgatttagtagtgtagattccgcgggggctctgggagaggagcccagcactgggattccgaggtgtttccattcagtgatctgcactgaacacagaggactcgccatggagtttgggctgagctgggttttccttgttgctattttaaaaggtgtccagtgtgaggtgcagcgtgggtggagtcgtggggggaggcgttggtccaggccgtggggggtccctgaaactctcctgtgcagcctctggatacaccgcagtagtactcatgactggccncnggctcgagggagggctggagtggtctctagttattagtagnggtgaaccatatacacgcagactccggtagaaggcagtatcacatccacaagacgaacaattcccgaaagaaccncgntagtactcttaaacaaatcggaaacngacctggagacgtcgaagaccaggcttagattactacgtgtacggactaaggaagtcgtagtttcggtaacttcgttttaagaaacttcggtacggtacggggaacctaaagggggtaac

SEQ ID NO: 308518 - DNA, 721 bp, Homo sapiens
  misc_feature: GZ8MTXP02HZDX7.9.12.B01.1.454.CMB.2.raw
tcagtgatacgtctcacgaccggtgctcgatttagtagtgtagattccgcggggattgtgaagtgagctacaacaggcaggcaggggcagcaagatggtgttgcagacccaggtcttcatttctctgttgctctggatctctggtgcctacggggacatcgtgatgacccagtctccagacctccctggctgtgtctcgtgggcgagacggaccaccatcaactgacaagtccagccagagttgtttacacggctaccgacaacaagaactactagcttggtatcagcaacgaaaccgaggaacacgacctacctaaaactgactacgtaacttaacgtcgggactactccgtaaccccccgggactaaaccggttccccggggtacccccttaggaacccgtacgtttcgaacggttcgggaccgtacggggccgggggttcgtaggggtaacctagtacttttaccaacccttcctaccgaccctaaacgttccgaacgcccgaacgtccgtacggaccgtacggcctaaggtaaagtaggttcggtacggtacgttaaggttttacttacgtacgttaaccgtaacgtttacgggtttttccgtcggggtccggtttaccgggaaaccgtaaacggggtaaccgtaaaaggggtacgtaaaacgttaaccgaaaaacggttaccggtaggtacggtacgtccgtaccgtaccgtaacg

SEQ ID NO: 308519 - DNA, 543 bp, Homo sapiens
  misc_feature: GZ8MTXP02FHKQ6.9.12.B01.1.454.CMB.2.raw
  modified_base (349)..(349): a, c, t, g, unknown or other
  misc_feature (349)..(349): n is a, c, g, or t
tcagtgatacgtctcacgaccggtgctcgatttagtagtgtagattccgcggggattgtgaagtgagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgtttatacggctccgacaacaagaactactagcttggtatcagcagaaaccaggacagcctcctaaactgctcattaactggcatctacccccggcaactccggggtcccngaccgattcagtggcagcgggtctgggacagatttcactctcaccatcagcagcctgcaggctgaagatgtggctagtttattactgtacaactagttttccgtcggggtcgttcggtaccgaaacggggacccgtaaagggtacggaaaactacgaaaacgaacgttacggtacggctacggaccacctaacg

SEQ ID NO: 308520 - DNA, 637 bp, Homo sapiens
  misc_feature: GZ8MTXP02JJFQG.9.12.B01.1.454.CMB.2.raw
tcagtgatacgtctcacgaccggtgctcgatttagtagtgtagattccgcggggattgtgaagtgagctacaacaggcaggcaggggcagcaagatggtgttgcagacccaggtcttcatttctctgttgctctggatctctggtgcctacggggacatcgtgatgacccagtctccagacctccctggctgtgtctcgtgggcgaggacgggccaccatacaactcgacaagtccagccagtagttagttttacacggctaccgaacaacaagactactagctagtatcagcaacgaaacaggacacgaccctactaaacgtcgacctactaagtttaaacgcgggactaacgtacccgtacccccggactaaccggtcccggggtaccctacggtacccgtattccgggagtacggcgtacggtcgggtacggtagggacttagtattacccacttcaccaaccatccgaagctcgccgcgacgacggagtagtaagtagtggtaggtacgttagttaacgtttactacgtacgtaacgttacgtttcgttcggtacggtacggtacggaacggaaccggtaaggtaacgtaacgtaacgaaacgtaacgtacgtacgacgtacgtacacgtacg

SEQ ID NO: 308521 - DNA, 633 bp, Homo sapiens
  misc_feature: GZ8MTXP02GTUE6.9.12.B01.1.454.CMB.2.raw
  modified_base (572)..(572): a, c, t, g, unknown or other
  misc_feature (572)..(572): n is a, c, g, or t
  modified_base (579)..(579): a, c, t, g, unknown or other
  misc_feature (579)..(579): n is a, c, g, or t
  modified_base (604)..(604): a, c, t, g, unknown or other
  misc_feature (604)..(604): n is a, c, g, or t
tcagtgatacgtctcacgaccggtgctcgatttagtagtgtagattccgcggggagctctgggagaggagcccagcactgggattccgaggtgtttccattcagtgatctgcactgaacacagaggactcgccatggagtttgggctgagctgggttttccttgttgctattttaaaaggtgtccagtgtgaggtgcagctggtggagtcgtgggggaggcgttggtccagccgtgggggtccctgaactctcctgtgcagcctctggatacaccgtcagtagtactccatagaactggtccgccacggctaccgagggaaggggcgtggaggtgggtctacgtagtttaatttagtagtcggtacggtaacacgtaatactacgcaacgtaccgtaccggtaggaaacgggcgaagtaacttaccgaaccctagttcctacccgaaagaacgaaaccctaaagttaccgaagggaaacccacggtcctagtaacttacttaacaaaacttaggaaacaggtacccttaggaacgacggtaccggaggaaccacgggtatagtatattacgngtacganaggagtatgggttactaacggtttntttaggactacgtacggacgggtacaagg

SEQ ID NO: 308522 - DNA, 684 bp, Homo sapiens
  misc_feature: GZ8MTXP02JFG23.9.12.B01.1.454.CMB.2.raw
  modified_base (306)..(306): a, c, t, g, unknown or other
  misc_feature (306)..(306): n is a, c, g, or t
  modified_base (479)..(479): a, c, t, g, unknown or other
  misc_feature (479)..(479): n is a, c, g, or t
tcagtgatacgtctcacgaccggtgctcgatttagtagtgtagattccgcggggagctctgggagaggagcccagcactgggattccgaggtgtttccattcagtgatctgcactgaacacagaggactcgccatggagtttgggctgagctgggttttccttgttgctatttaaaaggtgtccagtgtgaggtgcagctggtggagtctggtgggaggcgttggtccaggccgtggggggtccctagaactctcctgtgcagcctctggatacaccgtcagtagtaactccatgaactgggtccncgagctcgaggggagggctggagtgggtctcgtagtttatttagtaggtcggtaggtaaacacaatactaacgacacgacgtccgtagaacggcagtattccaccattccacccgaaagagtaactaaacttccgaagggaaaccacggtcgttacttaactaccctttaaanaaagtacgaaactcgggtacctaagggaacggtaacgggtaccggaaacgggtaccgtaccgggtactttaacgttaaactttaacgtttacggaggggtacggaacggtaagtaacgtacgggtttacgggttaaccggtttaacctttacgggttttaaacggaacgtttacgggttacccgggggtaacgggggaaacccgg

SEQ ID NO: 308523 - DNA, 700 bp, Homo sapiens
  misc_feature: GZ8MTXP02GC97G.9.12.B01.1.454.CMB.2.raw
tcagtgatacgtctcacgaccggtgctcgatttagtagtgtagattccgcgggggctctgggagaggagcccagcactgggattccgaggtgtttccattcagtgatctgcactgaacacagaggactcgccatggagtttgggctgagctgggttttccttgttgctattttaaaaggtgtccagtgtgaggtgcagctggtggagtcgtgggggaggcttggtccagccgtcggggggtccctgaaactctcctgtgcagcctcgtggatacaccgtcagtagtaactcatgaacgtgggtccgcaggcctccgagggaggggcgtagggaggtgggtctcgtaggtttattagtaggtcggtaggtaaccactatactacgcagactccgtagaaggcagtacttcacctatcctacccagtaacaactaagttacccaaggaaccaacgtcttagtaactcttaaacaaagttacgaaacgagtacctaggacggaacggttccggaaacgggtaaccgtaacggggtaccttagggttaaaactttaacgtttaaaccgttggttacggaaccggttaaaggaaacgttacgggttagtttaacgggtttaacccggttaacgttttttagggaaacgttttacggtacccggggtttacgggggtaaacccgtaaaacgggggtttaaaacccg

SEQ ID NO: 308524 - DNA, 614 bp, Homo sapiens
  misc_feature: GZ8MTXP02IST5I.9.12.B01.1.454.CMB.2.raw
  modified_base (250)..(250): a, c, t, g, unknown or other
  misc_feature (250)..(250): n is a, c, g, or t
  modified_base (264)..(264): a, c, t, g, unknown or other
  misc_feature (264)..(264): n is a, c, g, or t
  modified_base (394)..(394): a, c, t, g, unknown or other
  misc_feature (394)..(394): n is a, c, g, or t
  modified_base (431)..(431): a, c, t, g, unknown or other
  misc_feature (431)..(431): n is a, c, g, or t
  modified_base (446)..(446): a, c, t, g, unknown or other
  misc_feature (446)..(446): n is a, c, g, or t
  modified_base (473)..(473): a, c, t, g, unknown or other
  misc_feature (473)..(473): n is a, c, g, or t
tcagtgatacgtctcacgaccggtgctcgatttagtagtgtagattccgcggggattgtgaagtgagctacaacaggcaggcaggggcagcaagatggtgttgcagacccaggtcttcatttctctgttgctctggatctctggtgcctacggggacatcgtgatgacccagtctccagacctccctggctgtgtctcgtgggcaggacgggccaccatcaactgacaagtccagccagtagttgtttanaccggctaccgaanaacaaagactacttagcttggtatcagcaagaaaccaggacacgccctactaaaactcgactactaattaacgtgggacctacgtaccgtacccccggactaaccgtccccggggtccctagaacccgtnttcgaggtcggcgaggccggggtgtaggggactagtnttccactctacaccntccagcagcctgcgtaggctagaacgngtggtacggcttaagtttatacgtagtactaaacgttgtttccggtcggggtcgttacgggaccggtaaacggaacggtaacgggtaaacgtaaactaaccgaaaacgtacggtgtacggggtacctacggacctaactcg

SEQ ID NO: 308525 - DNA, 641 bp, Homo sapiens
  misc_feature: GZ8MTXP02IXIDR.9.12.B01.1.454.CMB.2.raw
  modified_base (407)..(407): a, c, t, g, unknown or other
  misc_feature (407)..(407): n is a, c, g, or t
tcagtgatacgtctcacgaccggtgctcgatttagtagtgtagattccgcgggcgtagactttgtgtttctcgtagtctgctttgctcagcgtcagggtgctgctgaggctgtaggtgctgtccttgctgtcctgctctgtgacactctcctgggagttacccgattggagagggccaccatcaactgcaagtccagccagagtgttttatacggctaccgacaaacaagaactacttagcttggtatcagcaagaaaccaggacagccctacctaaactgctacaattaacgtgggacatccgtaccccggcaacgtcccggggtccctgaccgattcagtgcaggcgggtctaggggacagtatttcactctacaccatcagccagcctgcagctagaagagtgngtactagtttatacgtgtacaaacgttcgtttcggtcggggtacgttcgggacctaacggggaaccgtaaagggtacggaaacgttaaccgaaaacgtaaccgttgggtacggtacccgttaggacccgaacctaaacgttccttaacggtttcctttacccggtaactttcccccggtaaccccgtacctaacgttaccgtaacgttaaacggaacccgttaatttaacccgg

SEQ ID NO: 308526 - DNA, 608 bp, Homo sapiens
  misc_feature: GZ8MTXP02IS75B.9.12.B01.1.454.CMB.2.raw
  modified_base (244)..(244): a, c, t, g, unknown or other
  misc_feature (244)..(244): n is a, c, g, or t
  modified_base (326)..(326): a, c, t, g, unknown or other
  misc_feature (326)..(326): n is a, c, g, or t
  modified_base (448)..(448): a, c, t, g, unknown or other
  misc_feature (448)..(448): n is a, c, g, or t
  modified_base (496)..(496): a, c, t, g, unknown or other
  misc_feature (496)..(496): n is a, c, g, or t
tcagtgatacgtctcacgaccggtgctcgatttagtagtgtagattcggcggggggggtctcaggaggcagcgctctcaggacgtcaccaccatggcctgggctctgctcctcctcaccctcctcactcagggcacagggtcctgggcccagtctgccctgactcagcctccctccgcgtccgggtctccgtggacagtcggtcaccatctcctgcactggaaccagcagtgactagttgggtntctttaataacttatcgtctccgtaggtaaccaacacgccaacccgaggaccaaaacgtcccccaaaatccaatgtatttanggaagtacaaagtaacgccggaccctcggttcggggtccctgtactcgtcttctccgtcgcctaccgtaagtctacggacaccgaccgtccctcccgagtacccgtctcgtcgggcctccgnggctcggacgagtgacggtctagtatttagtactagcagtctactatntcgacacggacaaccactaagtgtaccgtacggaaggtaccggacctacggtccaccgtacgttacggccacgaacccgtacgacccaaccctcgtacgtacacctttcccg

SEQ ID NO: 308527 - DNA, 566 bp, Homo sapiens
  misc_feature: GZ8MTXP02JM385.9.12.B01.1.454.CMB.2.raw
  modified_base (307)..(307): a, c, t, g, unknown or other
  misc_feature (307)..(307): n is a, c, g, or t
  modified_base (444)..(444): a, c, t, g, unknown or other
  misc_feature (444)..(444): n is a, c, g, or t
tcagtgatacgtctcacgaccggtgctcgatttagtagtgtagattccgcgggggctctgggagaggagcccagcactgggattccgaggtgtttccattcagtgatctgcactgaacacagaggactcgccatggagtttgggctgagctgggttttccttgttgctattttaaaaggtgtccagtgtgaggtgcagctggtggagtcgtgggggaggcttggtccaggccgtggggggtccctaggaaactctcctgtgcagcctctggatacaccgtcagtagtaactccatgaactgggtccnccaggctaccgaggggacgggctggagtggtctgagttattataggcggtagtaaccatatactacgcacgactccgtagaagggcagtatcaccatctccagacgacaattccaaggacacgactgtaactcttanaaatagaaacacgaccgtagaagtacgtaccgaggaccgacggtctagtataattacgtagtgacggtagaagtactggtctacgtcgtttagacttagtcgtacggggacctaagggaacc

SEQ ID NO: 308528 - DNA, 677 bp, Homo sapiens
  misc_feature: GZ8MTXP02GKHV6.9.12.B01.1.454.CMB.2.raw
  modified_base (248)..(248): a, c, t, g, unknown or other
  misc_feature (248)..(248): n is a, c, g, or t
  modified_base (444)..(444): a, c, t, g, unknown or other
  misc_feature (444)..(444): n is a, c, g, or t
  modified_base (531)..(531): a, c, t, g, unknown or other
  misc_feature (531)..(531): n is a, c, g, or t
tcagtgatacgtctcacgaccggtgctcgatttagtagtgtagattccgcggggattgtgaagtgagctacaacaggcaggcaggggcagcaagatggtgttgcagacccaggtcttcatttctctgttgctctggatctctggtgcctacggggacatcgtgatgacccagtctccagacctccctggctgtgtctctgggcgagacgggccaccatcaactgacaagtccagccagtagtgtttanacggctaccgacaacaagaactactagcttggtatcagcaagaaaccaggacagccctactaaatgctacattaactgggacactccgtaacccccggacaacggtcccggggtaccctagacccgtattccgagtggccgacgggtccgggtcgtaggggaacctaagtcttttacccacttctaccgaacctanaccacggtacacgaccctgggaccaacgggttccaggtaaaggagttgggtcggtaaccgttaaaggtttttactaacccggtttanaccgtttaaaacgttacgggttttttcccggaaccgggggttccgttttaaaccggggccgtaaaaacgggggaccgtaaaaggggtttacgaaaacgttaacccgaaaaggtactaagggtacgtcgtacgaccaccggtttacg

SEQ ID NO: 308529 - DNA, 604 bp, Homo sapiens
  misc_feature: GZ8MTXP02FKH8P.9.12.B01.1.454.CMB.2.raw
tcagtgatacgtctcacgaccggtgctcgatttagtagtgtagattccgcggggattgtgaagtgagctacaacaggcaggcaggggcagcaagatggtgttgcagacccaggtcttcatttctctgttgctctggatctctggtgccgtacggggacatcgtgatgacccagtctccagacctccctggctgtgtctcgtgggcgagacgggcccaccatcaaactgacaagtccagccagtagttgtttataccggctaccgaacaacaaagaactactagcttggtatcagacaagaaaccgaggacacgcctacctaaactgactacaattaacgtggactacgtacgtaccccccggactaacgtcccggggtccctagacccgtattcgaggtcgcgaggcgggtcgtagggactagtactttacactactcaaccagcaacgcagccctgaccgaggctagaagtatggtgtacttagtttactacgtgtaacgtaacgttgtttaccggcgggtcgttaccggaacggaaacggaccggtaaaggtaacgaaacgtaacgaaaaccgtagtacggtaggctacggaacacttaacg

SEQ ID NO: 308530 - DNA, 575 bp, Homo sapiens
  misc_feature: GZ8MTXP02G4GES.9.12.B01.1.454.CMB.2.raw
  modified_base (213)..(213): a, c, t, g, unknown or other
  misc_feature (213)..(213): n is a, c, g, or t
  modified_base (412)..(412): a, c, t, g, unknown or other
  misc_feature (412)..(412): n is a, c, g, or t
  modified_base (573)..(573): a, c, t, g, unknown or other
  misc_feature (573)..(573): n is a, c, g, or t
tcagtgatacgtctcacgaccggtgctcgatttagtagtgtagattccgcgggcgtagactttgtgtttctcgtagtctgctttgctcagcgtcagggtgctgctgaggctgtaggtgctgtccttgctgtcctgctctgtgacactctcctgggagttacccgattggagagggccaccatcaactgcaagtccagccagtagttgttttanacggctccgaacaaacaagaactacttagcttggtatcagcaagaaaccaggaccagccctacctaaactgctacaattaacgtgggcatcctacccggacaacgtcccggggtccctgaccgattcaggtggcaggcgggtctagggacagtactttcactctacaccatcagcagcctgaccgaggctaggaaagtntggtgtctaagttttactacgtgtactaaacgttgtttccgcggggtccgttacggaccgaacgggacgaaaggtaaggaaactaacgaaacgaacgtagtggctacgacacctatctcttactacacttccctcccgtaccattacacgtaagacttacncg

SEQ ID NO: 308531 - DNA, 560 bp, Homo sapiens
  misc_feature: GZ8MTXP02H0BBQ.9.12.B01.1.454.CMB.2.raw
  modified_base (304)..(304): a, c, t, g, unknown or other
  misc_feature (304)..(304): n is a, c, g, or t
  modified_base (408)..(408): a, c, t, g, unknown or other
  misc_feature (408)..(408): n is a, c, g, or t
  modified_base (422)..(422): a, c, t, g, unknown or other
  misc_feature (422)..(422): n is a, c, g, or t
  modified_base (445)..(445): a, c, t, g, unknown or other
  misc_feature (445)..(445): n is a, c, g, or t
tcagtgatacgtctcacgaccggtgctcgatttagtagtgtagattccgcgggggctctgggagaggagcccagcactgggattccgaggtgtttccattcagtgatctgcactgaacacagaggactcgccatggagtttgggctgagctgggttttccttgttgctattttaaaaggtgtccagtgtgaggtgcagcgtggtggagtcgtgggggaggtcttggtccagccgtggggggtccctgaaactctcctgtgcagcctctggatacaccgtcagtagtaactccatgactggtccncaggctcgagggagggctggagtgggtctcgtagtttattagtaggcggtagtaaccacatactacgctagactccgtaggaaggcagattacacatcacaganacaatccaggaacncgactgtatctacaaatcgaacngcctaggagagtcgaaggaccgaaggtctaggtaattaacgttacgtaggtcgacggtagacgtagtagttcgtacgttcgttttagattacgtcggtacggacgaagggtaacg

SEQ ID NO: 308532 - DNA, 701 bp, Homo sapiens
  misc_feature: GZ8MTXP02H41NB.9.12.B01.1.454.CMB.2.raw
  modified_base (225)..(225): a, c, t, g, unknown or other
  misc_feature (225)..(225): n is a, c, g, or t
tcagtgatacgtctcacgaccggtgctcgatttagtagtgtagattcggcggggggggtctcaggaggcagcgctctcgggacgtctccaccatggcctgggctctgctattcctcaccctcctcactcagggcacagggtcctggacccagtctgccctgactcaacctgcctccgtgtctgggtctcctggacagtcgatcaccatctcctgcactggaaccngcagtgactattggtaattaacatgtcctctaggtaaccaacaactaccccggacaaacgcccccaaactcttgtctttaatgtatgtactagttactccggccctcgtaggtagtttctagtagtcgtctttcctcgtcgcccctaccaagttccgacggccacccgaccggtcccttcccgtcgtaccctactccgtcgtcgggtccctaccgacggcgtaggagggaccgagggtcttggttaactttacttcgtcggtacaaccgtattaaaaccgaaaaaggtacgttaacccgtccccgtttggttccgggtttacggggtttacgggggaccgggggtaaacgtacggggtaccgtacccggtaccgtaaacggtccggaaccgtacccggtaaagggtcccctaccgggcccccgttcggaccttcccgtccgtaacccgttccccgccctaccgtcaaacggtcccg

SEQ ID NO: 308533 - DNA, 798 bp, Homo sapiens
  misc_feature: GZ8MTXP02HCS3Y.9.12.B01.1.454.CMB.2.raw
tcagtgatacgtctcacgaccggtgctcgatttagtagtgtagattccgcgggggctctgggagaggagcccagcactgggattccgaggtgtttccattcagtgatctgcactgaacacagaggactcgccatggagtttgggctgagctgggttttccttgttgctattttaaaggtgtccagtgtgagtgcagctggtggagtcgtgggggaggcttggtccaggccgtggggggtcctgaactctcctgtgcagcctctggactacaccgtcagtacgtaactccatgaacgtggtccgcaggctcgaggggaaggcgtggagtggtctcgtagttattagtagcggtaggtaaccagtataacgtacgacagaccgtccggtagaagggtcaaggtacttaccaccgtaactccctaccgaaaggtaacgtaacctaaactttcccggaaagggtaaacctaacccgtcgtttaagggtaaactttacccgtttaaaacaaaacgttaccggaaaaaacccgtcggtacccccttaagggggaaaacgttaaccgggtaccgggaaaaccggggttaaccgaaaccccggggggtttccttaaggggttttaaaactttaaacccgggttttttaaacccgggtacggggtttaccggaaacggggttaaaagggttaaacccggttaaggttttaccgggtttaacgggttaacccgtttttaacgtttaggttaaaccggtttacgggttacccggggttaacgggggaaaaccgttaaaacggggtaccg

SEQ ID NO: 308534 - DNA, 610 bp, Homo sapiens
  misc_feature: GZ8MTXP02IVB1J.9.12.B01.1.454.CMB.2.raw
  modified_base (290)..(290): a, c, t, g, unknown or other
  misc_feature (290)..(290): n is a, c, g, or t
  modified_base (525)..(525): a, c, t, g, unknown or other
  misc_feature (525)..(525): n is a, c, g, or t
tcagtgatacgtctcacgaccggtgctcgatttagtagtgtagattccgcgggggctctgggagaggagcccagcactgggattccgaggtgtttccattcagtgatctgcactgaacacagaggactcgccatggagtttgggctgagctgggttttccttgttgctattttaaaaggtgtccagtgtggaggtgcagctggtggagtcgtgggggaggcttggtccagccgtgggggtccctgaaactctctgtgcagcctctggataccaccgtcagtacgtaaccnccatagaacgtcgggtcccgccgacggccgtaccgaggggaacggggcgtgggaggtgggtctctagtttattagtagtcggtagtaaccacatactacgacacgactccggtagaagggcagtactacacatcctacagaacactaaattacccgaaagaaccacgtctacgtacttacttaacgaaaattagaactacgaccgttagacggtacgacggaagacgaacgggtnttagtaactaagtactggtagacgagacgtagtcgtagttacgtgttttagacttacgtcggacggggaaccgtaaaggggtacc

SEQ ID NO: 308535 - DNA, 637 bp, Homo sapiens
  misc_feature: GZ8MTXP02H3PB2.9.12.B01.1.454.CMB.2.raw
  modified_base (438)..(438): a, c, t, g, unknown or other
  misc_feature (438)..(438): n is a, c, g, or t
  modified_base (481)..(481): a, c, t, g, unknown or other
  misc_feature (481)..(481): n is a, c, g, or t
tcagtgatacgtctcacgaccggtgctcgatttagtagtgtagattccgcggggattgtgaagtgagctacaacaggcaggcagggggcagcaagatggtgttgcagaccccaggtcttcatttctctgttgctctggatctctggtgccgtacggggacatcgtgatgacccagtctccagacctccctggctgtgtctcgtgggcgagacgggccaccatacaactgacaacgtccagccagtagttagtttagaccggctaccgaacaaacaaagtaactacttagtacttaggtatcagacaaacgaaaccgaggacacgacctaacctaaaactcgactactaattacgcgggactacgttccgtaacccccggactaaccggtcccggggtaccctacgaccgtacttcgagggtcgcgagtccgggtacgngggactagtacttcactcacaccatcgagcgacgtcgcgacgnggactagagtagtggagtacttagttattacgacgttaccaagtttacgtttccggtacggtccggttaccggaccggtaaacggggtaaacctaacggggtagtaaaacgtaacgtaaaaccgtagtacgtcggacggtaccgacaacccgttcg

SEQ ID NO: 308536 - DNA, 702 bp, Homo sapiens
  misc_feature: GZ8MTXP02JOCDI.9.12.B01.1.454.CMB.2.raw
  modified_base (250)..(250): a, c, t, g, unknown or other
  misc_feature (250)..(250): n is a, c, g, or t
  modified_base (262)..(262): a, c, t, g, unknown or other
  misc_feature (262)..(262): n is a, c, g, or t
  modified_base (342)..(342): a, c, t, g, unknown or other
  misc_feature (342)..(342): n is a, c, g, or t
tcagtgatacgtctcacgaccggtgctcgatttagtagtgtagattccgcggggattgtgaagtgagctacaacaggcaggcaggggcagcaagatggtgttgcagacccaggtcttcatttctctgttgctctggatctctggtgccgtacggggacatcgtgatgacccagtctccagactccctggctgtgtctcgtgggcgagacgggccaccatcaactgacaagtccagccagtagttgtttanacggctaccganaacaagtaactacttagcttaggtatcaagacaagaaaccgaggacacgtcctacctaaactcgctactaagtttaacgngggacacgtccgtaacccccggctaaaccggtcccggggtacctacggacccgtattccgaggtcggacgtagggccggggttcgaggggaacctagttactttacccgactccttaccgaaccctatacccgaacgccaacggtcccgtaggaccgacggtacgtagggtaacggtacgttcggggttacgttacgtttaaagtttaccgtttacgttacgttaaccgttaaacgttttcggtttacccggtccggggttaccggttaccgggaaaccggtaaaccgggtaacgtaagggtaaacgtaaacgtaaaccgaaaacggtacgtacggtacggtaccgtacgacctactacg

SEQ ID NO: 308537 - DNA, 623 bp, Homo sapiens
  misc_feature: GZ8MTXP02IR1QO.9.12.B01.1.454.CMB.2.raw
  modified_base (247)..(247): a, c, t, g, unknown or other
  misc_feature (247)..(247): n is a, c, g, or t
  modified_base (329)..(329): a, c, t, g, unknown or other
  misc_feature (329)..(329): n is a, c, g, or t
tcagtgatacgtctcacgaccggtgctcgatttagtagtgtagattccgcggggattgtgaagtgagctacaacaggcaggcaggggcagcaagatggtgttgcagaccccaggtcttcatttctctgttgctctggatctctggtgcctacggggacatcgtgatgacccagtctccagactccctggctgtgtctctgggcgagagggccaccatcaactgacaagtccagccagagttgtttanacggctccgaacaacaagaactacttagcttggtatcagcaagaaaccaggacacgccctactaaactgactacattaacgnggcactccgtacccccgctaaccgtcccggggtaccctagacccgtatttcgagtcgggacgtaggccgggggtactggggaacctagttactttccacctcctaccaacctatccgaagcccaacggtccctggacccgagggtaccgtaggaaacgtgtgggtacggtaccttaaggtttttactacgtagtacctaaacgtttggtttccgtcggggtcgttacggacggtaaacggacgtaaggtaacgaactaagaaaaccgtacgtaggtcggactacgccaactacg

SEQ ID NO: 308538 - DNA, 682 bp, Homo sapiens
  misc_feature: GZ8MTXP02F3CU2.9.12.B01.1.454.CMB.2.raw
  modified_base (512)..(512): a, c, t, g, unknown or other
  misc_feature (512)..(512): n is a, c, g, or t
tcagtgatacgtctcacgaccggtgctcgatttagtagtgtagattccgcggggagctctgggagaggagcccagcactgggattccgaggtgtttccattcagtgatctgcactgaacacagaggactcgccatggagttgggctgagctgggttttcctgttgctatttaaaaggtgtccagtgtgaggtgcagcgtggtggagtcgtgggggaggcgttggtccgaggccggtggggggtccctagaaacctctcctgtgcagcctctggatacaccgtcagtacgtaactccatcgaactggtcccgccgacggctccgaaggggaggggtcgtgggaggtgggtctcgtagtttattagtaggtcggtacggtaacacataacgtacgccacgtaccgtaccggtaggaaacggggcaagtactccacctactccctaccgaaagtaagaaacccttaacgttacccgaagggaaacctaccgtcttaacgttattacccgtttaanaaaacttcgaaactacggaccgttaaggaagtaacggggtaccgaaggggtaacccacggggtacctaggttaacttaaaacgttcggttagcgggtaagagtaacgtagtacggttgttaaacgttcttttaggaacttaggtcggtaacgggggacctaaaacggggg

SEQ ID NO: 308539 - DNA, 691 bp, Homo sapiens
  misc_feature: GZ8MTXP02HFKWN.9.12.B01.1.454.CMB.2.raw
  modified_base (288)..(288): a, c, t, g, unknown or other
  misc_feature (288)..(288): n is a, c, g, or t
tcagtgatacgtctcacgaccggtgctcgatttagtagtgtagattccgcggggattgtgaagtgagctacaacaggcaggcaggggcagcaagatggtgttgcagacccaggtcttcatttctctgttgctctggatctctggtgccgtacggggacatcgtgatgacccagtctccagactccctggctgtgtctcgtgggcgagagggccaccgatcaactgacaagtccagccagagttgttttacacggctaccgaacaacaaagaactacttagcttggtancgagacaacgaaaccgagacacgtaccctactaaactcgtactactaagttacgtggacctacgtaccgaacccccggacgtaccggttcccggggtacctacgtaccgtagttcgacgggtcgacggacgggtccgggtacgtacgggacgtacgttacttacctacctacctaccacctacgtacgacgacgtaccgtaccgtacgacgacggtaaaaaacgtcgtaaagtagttacgggtacgttacgttaagtttacgttacgttacgttacgttaacgtttacggtttcggttaccgggttaccggttaccgggtaaccggtaaacgggaacggtaacggtaacggtaaacgtaacgtaaacgtaacgtacggtacggtacgtacgaccgtacgtacg

SEQ ID NO: 308540 - DNA, 586 bp, Homo sapiens
  misc_feature: GZ8MTXP02JS03C.9.12.B01.1.454.CMB.2.raw
  modified_base (210)..(210): a, c, t, g, unknown or other
  misc_feature (210)..(210): n is a, c, g, or t
tcagtgatacgtctcacgaccggtgctcgatttagtagtgtagattccgcgggcgtagactttgtgtttctcgtagtctgctttgctcagcgtcagggtgctgctgaggctgtaggtgctgtccttgctgtcctgctctgtgacactctcctgggagttacccgattggagagggccaccatcaactgcaagtccagccagagtgtttanacggctccgacaacaagaactacttagcttggtatcagacagaaaccaggacagcctacctaaactgctacaattaactgggacatcctacccggcaacgtcccggggtcctgaccgtattcagtggctaggcgggtctcgggacagtatttcactcctacacctatcaagcacgcctagcacggtctagaagagtggtcggtacttaacggtttattaccttgtacctaacgttaggtttccgtacggggtcgttcggaccgaaacggggaaccgtaaaggtaggtaaactacgtaaacgacgtagtgactacgacacgtactcgtcgtactactactaccttccgactactacgtacgtaacgtacgtctaccg

SEQ ID NO: 308541 - DNA, 550 bp, Homo sapiens
  misc_feature: GZ8MTXP02IZRWZ.9.12.B01.1.454.CMB.2.raw
  modified_base (323)..(323): a, c, t, g, unknown or other
  misc_feature (323)..(323): n is a, c, g, or t
tcagtgatacgtctcacgaccggtgctcgatttagtagtgtagattccgcggggattgtgaagtgagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagttgttttatacggctccgacaacaaagaactacttagcttggtatcagcagaaaccaggacagcctcctaaactgactcattaacngggcatcctacccccggcaacgtcccggggtccctgacccgattcagtggcagcgggtctggggacagatttcactctcacccatcagcagcctgtaggctagaagtatcggtgggactagtttacttactgttacaacttagtttcgtcgggtcgttcggaccgaacgggtaaccgaagggtacgaaaactcgaaaacgtaacgtgtacgactagacacgacttcg

SEQ ID NO: 308542 - DNA, 711 bp, Homo sapiens
  misc_feature: GZ8MTXP02GG8KE.9.12.B01.1.454.CMB.2.raw
  modified_base (630)..(630): a, c, t, g, unknown or other
  misc_feature (630)..(630): n is a, c, g, or t
tcagtgatacgtctcacgaccggtgctcgatttagtagtgtagattccgcggggagctctgggagaggagcccagcactgggattccgaggtgtttccattcagtgatctgcactgaacacagaggactcgccatggagtttgggctgagcttgggttttccttgttgtctaattttaaaaggtgtccagtgtgaggtgcagctggtggagtcgtgggggagtcgttggtccaggtccggtcgggggtccctagaacctctcctgtgcacgcctcgtggactaccgaccgtacagtaacgtaacctccaagtcgtaacgtcgggtcccgaccgaggccgtaccggaaggggaacggggtcgtagggtaggtgggtacctacgttaagtttaagtttagtaggtacggtacggtaaaccactacgtaacctacgaccgaacgtaccgtccggtaaggaacgggtactaagtacttaccgaccctagttcccaccgaagacgaaactaacgttacccgaaaggaaccacgtcctagttacttaccttaacgaaactacgaaactcgtaccggagaacgtacggacgacgggaacctcggtatgtaacttaacgttcgtaggcggaacggaancggttaaacttggttaacgttaaccgtttcgttttaaggacgtttaacgggtcgggaaccggggttaaccggaaaacgggg

SEQ ID NO: 308543 - DNA, 618 bp, Homo sapiens
  misc_feature: GZ8MTXP02FQ8ZD.9.12.B01.1.454.CMB.2.raw
  modified_base (374)..(374): a, c, t, g, unknown or other
  misc_feature (374)..(374): n is a, c, g, or t
  modified_base (384)..(384): a, c, t, g, unknown or other
  misc_feature (384)..(384): n is a, c, g, or t
  modified_base (447)..(447): a, c, t, g, unknown or other
  misc_feature (447)..(447): n is a, c, g, or t
  modified_base (537)..(537): a, c, t, g, unknown or other
  misc_feature (537)..(537): n is a, c, g, or t
tcagtgatacgtctcacgaccggtgctcgatttagtagtgtagattccgcgggggcagctctgggagaggagcccagcactgggattccgaggtgtttccattcagtgatctgcactgaacacagaggactcgccatggagtttgggctgagctgggtttccttgttgctatttaaaaggtgtccagtgtgaggtgcagctggtggagtcgtgggggaggcttggtccaggccgtggggggtccctgaaactctcctgtgcagcctctggatacaccgtcagtagtaactccatgaacgtcgggtccgccgaggcctccgaggggaaggggcgtgggagtggggtctcgtagttatttagtagcggtagtacanatactacgcngactcggtagaggcagtactcaaccagtcctaccaagacgaactaaattcccgaaggaaaccncgacttagtattacctacaaaagtcgaaacgtacgtccctaggaggacgtacgggaacggacacgggtcttaggtaattactttaacggnggtacggacgtaggtacgtagttacggtaacggttacgtttacgtttacggtaacgttacggtacgggtacgggggtaacg

SEQ ID NO: 308544 - DNA, 846 bp, Homo sapiens
  misc_feature: GZ8MTXP02F3QB2.9.12.B01.1.454.CMB.2.raw
  modified_base (245)..(245): a, c, t, g, unknown or other
  misc_feature (245)..(245): n is a, c, g, or t
tcagtgatacgtctcacgaccggtgctcgatttagtagtgtagattccgcggggattgtgaagtgagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccacatcaactgacaagtccagccagagttgtttanacggctccgacaacaagaactacttagcttggtatcagcaagaaaccaggacagccctactaaaactgactacgtaatttaaacgtgggacctaacgtacccgtaacccccccgggacctaaaccggttcccccgggggttaccccctaggaacccccggttatttacccggaaagggttcggggaccgtacgggggtcccgggggttactacggggggtaaaccctaaagggttacctttttacccgaaacccgtttacccgttaacccaaaccccgtaacttacccgtaaaacgggtcccaaacggttccccccgttagggaacccggtaaacggggtacccgtttaaacgggaaaaggttaaccggtttggggttaacggggttaaccctttaaaggggttttttaacctttaaaccgtttacgggttaaaccctaaaaccggttttacggttttttcccgggtaccgggggttaccggttttaccgggaacccggtaaaacgggggtacccgtaaaaggggtttaacggaaaacgttaaccgaaaaacggttaaaccgttgggtaacgggtaccttacggaaccctaccgtttaacg

SEQ ID NO: 308545 - DNA, 560 bp, Homo sapiens
  misc_feature: GZ8MTXP02I8XUN.9.12.B01.1.454.CMB.2.raw
  modified_base (259)..(259): a, c, t, g, unknown or other
  misc_feature (259)..(259): n is a, c, g, or t
  modified_base (272)..(272): a, c, t, g, unknown or other
  misc_feature (272)..(272): n is a, c, g, or t
  modified_base (282)..(282): a, c, t, g, unknown or other
  misc_feature (282)..(282): n is a, c, g, or t
  modified_base (298)..(298): a, c, t, g, unknown or other
  misc_feature (298)..(298): n is a, c, g, or t
  modified_base (323)..(323): a, c, t, g, unknown or other
  misc_feature (323)..(323): n is a, c, g, or t
  modified_base (329)..(329): a, c, t, g, unknown or other
  misc_feature (329)..(329): n is a, c, g, or t
  modified_base (331)..(331): a, c, t, g, unknown or other
  misc_feature (331)..(331): n is a, c, g, or t
  modified_base (445)..(445): a, c, t, g, unknown or other
  misc_feature (445)..(445): n is a, c, g, or t
tcagtgatacgtctcacgaccggtgctcgatttagtagtgtagattccgcgggggctctgggagaggagcccagcactgggattccgaggtgtttccattcagtgatctgcactgaacacagaggactcgccatggagtttgggctgagcgtggtttcgtgtagctatttaaagtgtcagtgtgaggtgcagctggtggagtcgtgggggaggcttggtccagccgtggggggtccctgaaactctcctgtgcagcctntggatacaccgtnagtagttacnccatagaacgtggccncaggctccgaggggagggctagggngtggtntntagttatagtagacggtagtaccactatacgacgcacgctcgaggaggactatactacactatccacagtaacactactacgaacgacacgtactatactactaactaaataanaacacgacgagaagacgacgacggacgacgacgtagtatagttacgtagtagacgagagtacgtagttagtacgttcgttagtacgtacgtacggtacggtacggaacggtaacg

SEQ ID NO: 308546 - DNA, 661 bp, Homo sapiens
  misc_feature: GZ8MTXP02I72MU.9.12.B01.1.454.CMB.2.raw
tcagtgatacgtctcacgaccggtgctcgatttagtagtgtagattccgcgggggctctgggagaggagcccagcactgggattccgaggtgtttccattcagtgatctgcactgaacacagaggactcgccatggagtttgggctgagctgggttttccttgttgctattttaaaaggtgtccagtgtgaggtgcagctggtggagtcgtgggggaggcttggtccagccgtggggggtccctgaaactctcctgtgcagcctctggactacaccgtcagtacgtactccatagaacgtcgggtaccgccgaggcctaccggaggggaacggggcgtgggaggttcgggtctcgtagtttatttagtacggtcggtacggtaaccactatacgtacgcacgactccggtagaacggggcagtacttacaccatcctacagtacgaactaacttcccgaaaggtaccacggtaccttagtaacttacctttaaacaaaacgttacgaaaccgtacgaccccgttaggaacgtacggtacggaaccgggtacacccggggtattaggtaattacttacggtaggtaggacggaaagtagtacgttcggttagttaacgttcgttagtaatcggtacggtacggggaccgtaaagggtaaccg

SEQ ID NO: 308547 - DNA, 686 bp, Homo sapiens
  misc_feature: GZ8MTXP02H23W0.9.12.B01.1.454.CMB.2.raw
tcagtgatacgtctcacgaccggtgctcgatttagtagtgtagattccgcgggggctctgggagaggagcccagcactgggattccgaggtgtttccattcagtgatctgcactgaacacagaggactcgccatggagtttgggctgagctgggttttccttgttgctattttaaaaggtgtccagtgtgaggtgcagcgtggtggagtcgtgggggaggcttggtccagccgtggggggtccctgaactctcctgtgcagcctctggatacaccgtcagtagtaactccatgaactggtccgccagctcgaggggaagggctggagtgggtctactagttatttagtaggcggtagtaaccacatacctacgcacgacctccggtagaacgggcagtacttacacctataccctaccgaagtaccgaacgtaacttacccgaaacgggtaaccacgtacgttagttaacttacttaaacgtaaaacgtacgtaaaaccgtacggtacccttagggaacgtaacggtaccgggaagggaacccgtacggggttaccttaagggtaatttaaacgtttaccggtagtagggaccgtaaggtaacggtacgtttaggtacgtttaacggttctttttaacggaagtttacgtccggggtacggggtaaccgttaaaacggggtaaccg

SEQ ID NO: 308548 - DNA, 719 bp, Homo sapiens
  misc_feature: GZ8MTXP02HIC2W.9.12.B01.1.454.CMB.2.raw
  modified_base (638)..(638): a, c, t, g, unknown or other
  misc_feature (638)..(638): n is a, c, g, or t
  modified_base (653)..(653): a, c, t, g, unknown or other
  misc_feature (653)..(653): n is a, c, g, or t
tcagtgatacgtctcacgaccggtgctcgatttagtagtgtagattccgcgggggctctgggagaggagcccagcactgggattccgaggtgtttccattcagtgatctgcactgaacacagaggactcgccatggagtttgggctgagctgggttttccttgttgctattttaaaaggtgtccagtgtgaggtgcagcgtgggtggaggtcgtggggggaggtcgttgggtccgaggtccgtcggggggtcccctagaaacctctccctgtgcagcctcgtggactacaccgtcagtacgtaactccatacgaacgtcggtcccgccgacggccgtaccggaggggaaggggcgtaggggtaggtcggtcgttacgtaagtttacgtttaagtaggtcggtaggtaaacctactaacgtaacctacgcaacgtacccgtccggtaaggaacgggacagtacttaccgaacctagtccctaccgaagaacgaactaaacttacccgaaaggaaacccacggtaccttaagtaaccttactttaaacgaaaagttaccggaaaccgtacgtcccgtaagggaagtaccggtacggaaacgggtaccaacgggttccttaaaggtacttaacgtttacgnggtacgacgtaaagnggtattcgggttactaccgttgtttaggaaacttcgtcgggtaacggggacctaaaagggtaaccg

SEQ ID NO: 308549 - DNA, 727 bp, Homo sapiens
  misc_feature: GZ8MTXP02G2COV.9.12.B01.1.454.CMB.2.raw
  modified_base (296)..(296): a, c, t, g, unknown or other
  misc_feature (296)..(296): n is a, c, g, or t
  modified_base (314)..(314): a, c, t, g, unknown or other
  misc_feature (314)..(314): n is a, c, g, or t
  modified_base (357)..(357): a, c, t, g, unknown or other
  misc_feature (357)..(357): n is a, c, g, or t
tcagtgatacgtctcacgaccggtgctcgatttagtagtgtagattccgcggggattgtgaagtgagctacaacaggcaggcaggggcagcaagatggtgttgcagacccaggtcttcatttctctgttgctctggatctcgtggtgccgtacggggacatcgtgatcgacccagtctccagacctccctggctgtgtctcgtgggacgaggacggccacatcaactgacacgtccagccagtgttagtttacgccggctaccgaaacaacaaacgaactacttagcttaggtacncgagacaaacgaaaccgnggaaccacgtaccctaactaaacgtcgactactaacttacggnggacctaacgtcccgtaacccccgacgtaaacccgggtccccgggtaccctaggtaacccgttacttcggagggttcggaccgacggggtccggggtacgtacggggactaacgttaccttccaaccctccacctaacccagtccaacggtccaaccgtccgtcggacgtacggataaggtaaagtcgggttggtacggtaactttaaggttacttaccgtacggttaacctaacggttttcggttccggtaccgggggtaccgttaccgggaaacccggaaacgggtaaccgggtaaaggtaaccgtaaaacgaaacccgtaaaagttcggtaacgggtccgtaaccgtaccggaaccttaacggttcg

SEQ ID NO: 308550 - DNA, 806 bp, Homo sapiens
  misc_feature: GZ8MTXP02H18EZ.9.12.B01.1.454.CMB.2.raw
  modified_base (248)..(248): a, c, t, g, unknown or other
  misc_feature (248)..(248): n is a, c, g, or t
  modified_base (259)..(259): a, c, t, g, unknown or other
  misc_feature (259)..(259): n is a, c, g, or t
tcagtgatacgtctcacgaccggtgctcgatttagtagtgtagattccgcggggattgtgaagtgagctacaacaggcaggcaggggcagcaagatggtgttgcagacccaggtcttcatttctctgttgctctggatctctggtgcctacggggacatcgtgatgacccagtctccagacctccctggctgtgtctcgtgggcgagacgggccaccatcaactgacaagtccagccagagtgtttanacggctccganaacaagaactactagcttggtatacagacaagaaaaccgaggaccaacgtccctacctaaaactcgtactactaaacgtttaaacgtggggacctaagttcccgtaccccccgggactaaaaccggttcccccgggggtacccccttacggaacccggtaactttccgaagggttacggggccgacggggttacccgggggtccgtttagggggaaccctaaaggtttaacctttccctaaaccttcccttacccaacccctaaacttcccgaacggacccaacggttccccgtacggaccggaacgggttaccgtaagggtaaacgtacgggttacgggttacggttaccgtttaaaggtttttaacgtttaacgtttacgttaaccgttaacggttttaccgggtttttcccggggttacccgggggtttacccgggttaccggggtaacccggtaaaacggggtaaaccggtaaaacggggtaaacggtaaaactaaccggaaaacggtacggtaggtaccggtacgtaccgacctaaccgtac

SEQ ID NO: 308551 - DNA, 662 bp, Homo sapiens
  misc_feature: GZ8MTXP02I4JLU.9.12.B01.1.454.CMB.2.raw
  modified_base (610)..(610): a, c, t, g, unknown or other
  misc_feature (610)..(610): n is a, c, g, or t
tcagtgatacgtctcacgaccggtgctcgatttagtagtgtagattccgcggggagctctgggagaggagcccagcactgggattccgaggtgtttccattcagtgatctgcactgaacacagaggactcgccatggagtttgggctgagcgttgggttttccttgttgtcttaattttaaaaggtgtccagtgtgaggtgcagcgtggtggagtcggtgggggagtcgttggtccgaggccgtgggggtccctagaacctctcctgtcgcacgcctcgtggactaccaccgtacaagtacgtaactccatacggaacgtcggtcccgccgaggccgtaccggaaggggaacgggcgtaggggacggttacgggtctacgttaagtttagtttagtaggtacggttacgtaacgactaatacctacgacgtaacgccgttaccggtagggaaacggacagtacttaccaactacgtcctacgaacgaagtaaccctaaagttacccaaggaaacctcgtacgtattacttacgttaaacaattacgaaacacgctaggaacgtgaccggaagaccgcggtattaggactttagtacgtagtgaacgtaanagtagtgttacgtaacgtatttagtacgtaggtcggaacggggtacaaaggg

SEQ ID NO: 308552 - DNA, 690 bp, Homo sapiens
  misc_feature: GZ8MTXP02F07DM.9.12.B01.1.454.CMB.2.raw
  modified_base (213)..(213): a, c, t, g, unknown or other
  misc_feature (213)..(213): n is a, c, g, or t
  modified_base (225)..(225): a, c, t, g, unknown or other
  misc_feature (225)..(225): n is a, c, g, or t
  modified_base (278)..(278): a, c, t, g, unknown or other
  misc_feature (278)..(278): n is a, c, g, or t
  modified_base (314)..(314): a, c, t, g, unknown or other
  misc_feature (314)..(314): n is a, c, g, or t
  modified_base (321)..(321): a, c, t, g, unknown or other
  misc_feature (321)..(321): n is a, c, g, or t
  modified_base (410)..(410): a, c, t, g, unknown or other
  misc_feature (410)..(410): n is a, c, g, or t
tcagtgatacgtctcacgaccggtgctcgatttagtagtgtagattcggcggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggaccagtcggtcacatctccngcactggaaccngcagtgaactagtttgggtgtcttaataactattgtctccgtggtaaccaacngcaccaggacaaacgtccccaaatcatgtatttagngacggtnaataagccggacctgtcggggtccctagactcgtcgtttctccgtcggctcgaagttctagggacacgccggcctccgtcgtaccgttntacgtcgggcctacgacggctgacgtagtgacgggttctaggtaactttaacgttaccgtaggtaccgtacgtacccgttacgtaaactttacgtacggggaaccgttaaccgggacccaaacccggttaaactaacggtttaccgtttacgggttacccggggtaaaggttcccggggaaaccgttaccggggtacctacccggttccgtaaccggtccgaaccggaacccgaaccggaaccccgtaaccctacgttaccggtacctacgtttcccccg

SEQ ID NO: 308553 - DNA, 662 bp, Homo sapiens
  misc_feature: GZ8MTXP02HLGQU.9.12.B01.1.454.CMB.2.raw
  modified_base (266)..(266): a, c, t, g, unknown or other
  misc_feature (266)..(266): n is a, c, g, or t
  modified_base (273)..(273): a, c, t, g, unknown or other
  misc_feature (273)..(273): n is a, c, g, or t
  modified_base (289)..(289): a, c, t, g, unknown or other
  misc_feature (289)..(289): n is a, c, g, or t
  modified_base (305)..(305): a, c, t, g, unknown or other
  misc_feature (305)..(305): n is a, c, g, or t
  modified_base (324)..(324): a, c, t, g, unknown or other
  misc_feature (324)..(324): n is a, c, g, or t
  modified_base (376)..(376): a, c, t, g, unknown or other
  misc_feature (376)..(376): n is a, c, g, or t
  modified_base (396)..(396): a, c, t, g, unknown or other
  misc_feature (396)..(396): n is a, c, g, or t
  modified_base (409)..(409): a, c, t, g, unknown or other
  misc_feature (409)..(409): n is a, c, g, or t
tcagtgatacgtctcacgaccggtgctcgatttagtagtgtagattccgcggggagctctgggagaggagcccagcactgggattccgaggtgtttccattcagtgatctgcactgaacacagaggactcgccatggagtttgggctgagctgggttttccttgttgcttaattttaaaaggtgtccagtgtgaggtgcagctggtggagtcgtgggggagtcgttggtccagccgtgggggtcctgaactctctgtgcagcctcnggatacnccgtacagtagtaacnccatgaacgtggtccnccaggcctcgagggagggntcggagtgggtctcgtagttattagtggtcgtacggtaacacatactacganacgcgtcgtagaacgggtanagtactcgacctntacaccgaagactaactaaaccttcgaaacggaacctaccgtactagttaactttacctaaactaaagttaacggtaaacctacgaccccgttaggtaaacgacggtaaccggaaggaacccgtaaccggttgttaaagtaacctttaagttaccgtagggttacgacggttaaacgggacgttacgtttacggtacgttaaccgtttacgtttaagacgtttaacggtccggaaccggggtaacgaaacggg

SEQ ID NO: 308554 - DNA, 547 bp, Homo sapiens
  misc_feature: GZ8MTXP02GPJ0Q.9.12.B01.1.454.CMB.2.raw
  modified_base (305)..(305): a, c, t, g, unknown or other
  misc_feature (305)..(305): n is a, c, g, or t
  modified_base (348)..(348): a, c, t, g, unknown or other
  misc_feature (348)..(348): n is a, c, g, or t
  modified_base (419)..(419): a, c, t, g, unknown or other
  misc_feature (419)..(419): n is a, c, g, or t
  modified_base (442)..(442): a, c, t, g, unknown or other
  misc_feature (442)..(442): n is a, c, g, or t
  modified_base (468)..(468): a, c, t, g, unknown or other
  misc_feature (468)..(468): n is a, c, g, or t
tcagtgatacgtctcacgaccggtgctcgatttagtagtgtagattccgcgggggctctgggagaggagcccagcactgggattccgaggtgtttccattcagtgatctgcactaaacacagaggactcgccatggagtttgggctgagctgggttttccttgttgctatttaaaaggtgtccagtgtgaggtgcagctggtggagtcgtgggggaggcttggtccaggccgtggggggtccctgaaactctcctgtgcagcctctggactacaccgtcagtagtaactccatgaactgggtccncaggctccgagggaaggctggagtgggtctcgtagttatttanagcggtaggtaacacatactacgcagactcgtggaaggcagatcgacatccacagagacaatccaagtacncgctgtatcttacaaatcgaaangccagaagagaccgaggactacggtntagtatattcgtagtcgagagagtagtcgtacgtacgttattaagaacgttacgtcggtacgggacgtaacggtactag

SEQ ID NO: 308555 - DNA, 671 bp, Homo sapiens
  misc_feature: GZ8MTXP02HTN3W.9.12.B01.1.454.CMB.2.raw
  modified_base (294)..(294): a, c, t, g, unknown or other
  misc_feature (294)..(294): n is a, c, g, or t
tcagtgatacgtctcacgaccggtgctcgatttagtagtgtagattccgcggggtgggagaggagcccagcactgggattccgaggtgtttccattcagtgatctgcactgaacacagaggactcgccatggagtttgggctgagcttgggttttccttgttgcttaattttaaaaggtgtccagtgtgaggtgcagctggtggagtcgtgggggaggcgttggtccaggccgtcggggggtccctagaaacctctcctgtgcagcctctggactacaccgtcacgtagtaacnccatagaacgtcggtccgcgacggcctaccggaggggaagggcgtgggaggtggtcgtacgtagtttatttagtaggtcggtaggtaaacactaacgtacctaccgcaacgtacgtaccgtagacggggacagtacttaccaaccactcctaccaagacgaaactaactaccgaaggtaaacccgacgtacttagtaactacgtttacaaaagtacgtaaaccaggtacccgtaggaaggacgggtacggaacggtaaccgaacggtctacgttaagttattaacgtgtcgaggtaggagtagtaggtcgttaacgttcttttagaagtttaacggtcggtacgggggtaacccgtaaagggaccgttaaagtccgg

SEQ ID NO: 308556 - DNA, 700 bp, Homo sapiens
  misc_feature: GZ8MTXP02FIC75.9.12.B01.1.454.CMB.2.raw
  modified_base (475)..(475): a, c, t, g, unknown or other
  misc_feature (475)..(475): n is a, c, g, or t
  modified_base (515)..(515): a, c, t, g, unknown or other
  misc_feature (515)..(515): n is a, c, g, or t
tcagtgatacgtctcacgaccggtgctcgatttagtagtgtagattccgcggggattgtgaagtgagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatacaactgacaagtccagccagtagttgtttagacggtctaccggaacaacgaagtaactacgttagccttaggtactcgaagacgtaacgaaaccgaggaccagtccctactaactgacctactaagttaaccgtcggactaaccttccgtacccccccggactaaaccggtcccggggtaccccctaggaccccgtaatttcgacggtcggacgaggtccggtacgacgggactagttacttcacctctacaaccctntaccagacgtagcccgtgaccgagggtacagggaaacgtnttacggggtacggtacccttaaggtttttactaaccggttacggtacctaaaacccggttttcggtttttacccgcgggggttacccgtttacggacccggtaaaacgggaacccgtaagggttaaaccgaaagttaaccgaaacgtaacggttacgtcggtaccgtacggaccctaaccgttcc

SEQ ID NO: 308557 - DNA, 640 bp, Homo sapiens
  misc_feature: GZ8MTXP02IZ1MH.9.12.B01.1.454.CMB.2.raw
  modified_base (261)..(261): a, c, t, g, unknown or other
  misc_feature (261)..(261): n is a, c, g, or t
  modified_base (279)..(279): a, c, t, g, unknown or other
  misc_feature (279)..(279): n is a, c, g, or t
  modified_base (574)..(574): a, c, t, g, unknown or other
  misc_feature (574)..(574): n is a, c, g, or t
tcagtgatacgtctcacgaccggtgctcgatttagtagtgtagattccgcgggggctctgggagaggagcccagcactgggattccgaggtgtttccattcagtgatctgcactgaacacagaggactcgccatggagtttgggctgagctgggttttccttgttgctattttaaaaggtgtccagtgtgaggtgcagctggtggagtcgtgggggaggcttggtccaggccgtggggggtccctgaaactctcctgtgcngcctctggatacaccgtnagtagtaactccatgaactggtcccgcaggctaccgaggggaagggcgtggaggtgggtctcgtagtttatttagtagtcggtagtaacccacgtatacgtacgcacgaccgtccgtagggaaacgggtcagtacttacaccgtataccctacccgaagaacgaaccgtaacttacccgaaacggaacccacgtaccgtttacgtaacttacgtttaaaccaaaattacgggaaaacctacggaccctagggaacgaggttacggaaggacgacgggtctagtattacttaacgnggtgacggagagtactggtagttacgtgttttagagttacgtcggtacggggacctaaggggtaac

SEQ ID NO: 308558 - DNA, 761 bp, Homo sapiens
  misc_feature: GZ8MTXP02G140I.9.12.B01.1.454.CMB.2.raw
tcagtgatacgtctcacgaccggtgctcgatttagtagtgtagattccgcggggattgtgaagtgagctacaacaggcaggcaggggcagcaagatggtgttgcagacccaggtcttcatttctctgttgctctggatctctggtgccgtacggggacatcgtgatcgaccagtctccagacctccctggctgtgtctcgtgggcgaggacgggccaccatacaactgacaacgtccagcctagttagtttttacgcgctaccgaacaacaaagtaactactacgtcgttaggtactacgaacgacgaacgaaaaccgaggtaaccacgtacccttaacctaaacgtcgtcctactaattaacggtcggactacgtaccgtacccggacgtaaccggttcccgggtacccacgaccgtagttacgacggtcggacggtacgggccgggttcggtagggaactaggttaactttccaccttaccactaaccctaagtaccgacgaccgtacgccccgtagaccggtaacggtcgtaaggtaacgtagttaggggtacgttaaccgtttaaggtttttacttaccggttaaggttaaccttaacggttttacgggtttccggtaccgggggttacccgttaacggggaaccgggtaaaacgggggaaacccgttaaaagggggtaaccgttaaaaccgaaccggtaaaacggttaacgttcggggtaccgttacggaccctacctaaccgttacgtttacccg

SEQ ID NO: 308559 - DNA, 664 bp, Homo sapiens
  misc_feature: GZ8MTXP02IK95P.9.12.B01.1.454.CMB.2.raw
  modified_base (247)..(247): a, c, t, g, unknown or other
  misc_feature (247)..(247): n is a, c, g, or t
tcagtgatacgtctcacgaccggtgctcgatttagtagtgtagattccgcggggattgtgaagtgagctacaacaggcaggcaggggcagcaagatggtgttgcagacccaggtcttcatttctctgttgctctggatctctggtgcctacggggacatcgtgatgacccagtctccagactccctggctgtgtctcgtgggcgagagggcccaccatcaactgcaagtccagccagagttgtttanacggctccgaacaacaagaactactagcttaggatcagcaagaaaccaggacacgaccctactaaaactcgacttactaattaaacgtgggacctatccgtaccccccgggactaacgtcccggggtaccctaggacccgtatttccgagtcggaccgtacggccggggttctaggggacctaggttacttcccgaactctacaaccctataccgagccaagccctagcctacggggcttaaggaaagacgtttgggtaacgtaccggtttaaattttacgttacgtacggttaacctaaacggtttgtttttcccgggacgggttccggtttaccgggaccgtaaaacggggaccgtaaagggttacggaaaattaacccgaaaagttaccgtaggtcggacgtctacgaaccttg

SEQ ID NO: 308560 - DNA, 743 bp, Homo sapiens
  misc_feature: GZ8MTXP02JRAVZ.9.12.B01.1.454.CMB.2.raw
  modified_base (594)..(594): a, c, t, g, unknown or other
  misc_feature (594)..(594): n is a, c, g, or t
tcagtgatacgtctcacgaccggtgctcgatttagtagtgtagattccgcggggagctctgggagaggagcccagcactgggattccgaggtgtttccattcagtgatctgcactgaacacagaggactcgccatggagtttgggctgagcttgggttttccttgttgcttaattttaaaaggtgtccagtgtgaggtgcagctggtggtaggtcgtgggggaggtcgttggtccgagccggtgggggtccctagaaacctctctgtgcagcctctggactaccaccgtcaagtacgtaacctccagtacggaacgtcgggtcccgccgacggtccgtcccggaaggggaaggggtcgtaggggaggttcggggttactacgtaagttttagtttaaggtaggtacgggttaacggtaaacgaacctaacgttaaccgtaacgaccgaacgtccgtaccgggttaaaggaaacggggtacacgtaacttaccacccgattcccaaccgaaagtaacgaacctaacgttaacccgaagggtaaccctaggtaccttacgttaaacttacgttaaaccaaaagttcccggaaaacncggttaaccgtaggaaacgtagggttacgaaggccgtaaacgggttttaaacgttagttaacgtcggtaggtcggaaacggtacgtagtacgttggtacggttaacgttgtttacgacgttacgggtccgggtaacggggaacctaagg

SEQ ID NO: 308561 - DNA, 687 bp, Homo sapiens
  misc_feature: GZ8MTXP02JTFRU.9.12.B01.1.454.CMB.2.raw
tcagtgatacgtctcacgaccggtgctcgatttagtagtgtagattccgcggggattgtgaagtgagctacaacaggcaggcaggggcagcaagatggtgttgcagacccaggtcttcatttctctgttgctctggatctctggtgcctacggggacatcgtgatgacccagtctccagacctccctggctgtgtctcgtgggcgaggacgggccaccatcaactgacaagtccagccagtagttgtttagacggctaccgaacaaacaagtaactacttagcttaggtatcagacaagaaaccgaggacacgtccctacctaaactgactactaattaacgcggactacgtccgtaccccccggactaacgtccccggggtaccctggacccgtattccgacggtcggacgacgggtccgggtcgtacgggactacgttactttccacctcctacaaccgtatccgaacgcgacgtcctgaccgtaggtactaggtaaagtgttagggtacgttaccgttaaggttttaacttacgttacgttaaccgttaacgtttacggttttccggtaccgggggttccgttaccggggaccggtaaaacggggaaccgtaaacggggtaacggtaaaacttaaccggaaaacggttacgtacgggtacggtacgtaccggacctaacgttcg

SEQ ID NO: 308562 - DNA, 581 bp, Homo sapiens
  misc_feature: GZ8MTXP02JMEWM.9.12.B01.1.454.CMB.2.raw
  modified_base (305)..(305): a, c, t, g, unknown or other
  misc_feature (305)..(305): n is a, c, g, or t
  modified_base (459)..(459): a, c, t, g, unknown or other
  misc_feature (459)..(459): n is a, c, g, or t
  modified_base (544)..(544): a, c, t, g, unknown or other
  misc_feature (544)..(544): n is a, c, g, or t
tcagtgatacgtctcacgaccggtgctcgatttagtagtgtagattccgcgggggctctgggagaggagcccagcactgggattccgaggtgtttccattcagtgatctgcactgaacacagaggactcgccatggagtttgggctgagctgggttttccttgttgctattttaaaaggtgtccagtgtgaggtgcagctggtggaggtcgtgggggaggcttggtccaggccgtggggggtccctgaaactctcctgtgcagcctctggatacaccgtcagtagtaactccatgaactggtccnccaggctccgaggggaagggcgtggagtgggtctcgagtttatttagtagtcggtaggtaaccacatactacgcacgactccggtagaagggcagattcacatccacagacgacaattccgaagaaccacgctgtactcttaacaaatagaacncgcctaggaacgaggtacgaagggaccacggtcttagtataagttacctggtacgacggagaagtgttacggtgtaaccggtttntttaggacttcggtacggacggggaaccgtaaggtac

SEQ ID NO: 308563 - DNA, 734 bp, Homo sapiens
  misc_feature: GZ8MTXP02HGJGI.9.12.B01.1.454.CMB.2.raw
  modified_base (503)..(503): a, c, t, g, unknown or other
  misc_feature (503)..(503): n is a, c, g, or t
tcagtgatacgtctcacgaccggtgctcgatttagtagtgtagattccgcggggattgtgaagtgagctacaacaggcaggcaggggcagcaagatggtgttgcagacccaggtcttcatttctctgttgctctggatctctggtgccgtacggggacatcgtgatcgacccagtctcagactccctggctgtgtctcgtgggcgaggacggccaccatacgaactgacaacgtccagccagtagttgtttacgaccggctaccgaacaacaaagtaacttcttagcttaggtatcgagacaaagaaaccgaggaaccacgacccttaacctaaacgtcgacctactaaattaacggtcggacctacttaccggaaccccccggtacaacccgggttccccgggtaccctagtacccgtagtttccgagtccggccgtacggggtcggttaccgtaggggaacctacggttactttaccgaccgttaccgtaccaaacccgtnttacccgaaggtccccttaacggtccccgtagtaccggaacggttaaacccggtaggtaaacggtcgttagggtacgttaacgtttaagtttaccgttaacgtcgttaaaccttacggtttccgggtttaccgggtaccgggttaccggttaacggaaaccggtaaaacgggtaaccgtaacggtaaacgtaaacgtaaacgaacgtagtcgacgtaccaccgactactcg

SEQ ID NO: 308564 - DNA, 635 bp, Homo sapiens
  misc_feature: GZ8MTXP02HQOQS.9.12.B01.1.454.CMB.2.raw
  modified_base (242)..(242): a, c, t, g, unknown or other
  misc_feature (242)..(242): n is a, c, g, or t
  modified_base (252)..(252): a, c, t, g, unknown or other
  misc_feature (252)..(252): n is a, c, g, or t
  modified_base (277)..(277): a, c, t, g, unknown or other
  misc_feature (277)..(277): n is a, c, g, or t
  modified_base (364)..(364): a, c, t, g, unknown or other
  misc_feature (364)..(364): n is a, c, g, or t
  modified_base (374)..(374): a, c, t, g, unknown or other
  misc_feature (374)..(374): n is a, c, g, or t
tcagtgatacgtctcacgaccggtgctcgatttagtagtgtagattccgcgggggctctgggagaggagcccagcactgggattccgaggtgtttccattcagtgatctgcactgaacacagaggactcgccatggagtttgggctgagctggttttcctgttgctatttaaaggtgtcagtgtgagtgcagctggtgagtcgtggggagcttggtccagccgtgggggtcctgaactctcngtgcagcctntggataccaccgtcagtagtaaccnccatgaacgtcggcccgccgaaggctccggaggggaacgggtcgtagggagtcgggtctgtagtttacttagtgcggtagtaaccanactactacgnacgactccggtagaacgggctaagcttcactacgtctaacgagtacaactaactacccgaaggaacacgtccgtatacttactaccgttaaaaactagaacgtacgtacgtaggaacgacggtaccgaaacggaccgtacggtattaagttaacttaacgttacggtggtacggacgaggtaacgttacgttcgttaacgtttacgttaacgttttagaacgttacggtaccggggtaacggtaaccggtaaaaggtaacg

SEQ ID NO: 308565 - DNA, 621 bp, Homo sapiens
  misc_feature: GZ8MTXP02HRSGE.9.12.B01.1.454.CMB.2.raw
  modified_base (441)..(441): a, c, t, g, unknown or other
  misc_feature (441)..(441): n is a, c, g, or t
  modified_base (563)..(563): a, c, t, g, unknown or other
  misc_feature (563)..(563): n is a, c, g, or t
tcagtgatacgtctcacgaccggtgctcgatttagtagtgtagattccgcgggggctctgggagaggagcccagcactgggattccgaggtgtttccattcagtgatctgcactgaacacagaggactcgccatggagtttgggctgagctgggttttccttgttgctattttaaaaggtgtccagtgtgaggtgcagctggtggagtcgtgggggaggcttggtccagccgtggggggtccctggaaactctcctgtcgcacgtcctctggactacgaccgtcagtacggtaacctccatgtaaaccgtcggggtaccgaccgacggccgtccggaggggaacggggcgtggaggttcgggtctacgtagtttatttacgtaggtcggtacggtaaccgacatactacgcacgactcggtaggaacggcagtataccacnctcacctaggaacgactaaagttcccgaaaggacctacggaccttgttactacgttaacaaattacgaaactacgcctaagacggtaacgtcggagacgtacgacttcgtaatcgttacgtnggacgagtacgatgtacgtacgtgtttagacttacggtacgtcggggactagggtaac

SEQ ID NO: 308566 - DNA, 650 bp, Homo sapiens
  misc_feature: GZ8MTXP02JTLUD.9.12.B01.1.454.CMB.2.raw
  modified_base (278)..(278): a, c, t, g, unknown or other
  misc_feature (278)..(278): n is a, c, g, or t
tcagtgatacgtctcacgaccggtgctcgatttagtagtgtagattccgcgggggctctgggagaggagcccagcactgggattccgaggtgtttccattcagtgatctgcactgaacacagaggactcgccatggagtttgggctgagctgggttttccttgttgctattttaaaggtgtccagtgtgaggtgcagctggtggagtcgtgggggaggcgttggtccagccgtgggggtccctgaactctcctgtgcagcctcgtggactacaccgtnagtagtaactccatgaacgtgggtccgccgaggcctccggaggggaacggggcgtgggagttgggtctactagtttacgtttagtaggtacggtaggtaaacccactaagtacgtacgacagacctccggtagaacgggtcaagtacttaccaacctactacctcccaaggtacaacctaattacccgaacggaaccacgtcttacggttactaccttaaagaaattacggaacacggtcctagggaagtcgaacgggaacggacgtaacgggtctaggttaataaccgtttacgtagtaccggcgtagggataccgtggttagtacggttctttggaaattccgtaggtcggggaacctaagggtaacccg

SEQ ID NO: 308567 - DNA, 747 bp, Homo sapiens
  misc_feature: GZ8MTXP02F73BW.9.12.B01.1.454.CMB.2.raw
tcagtgatacgtctcacgaccggtgctcgatttagtagtgtagattccgcggggtgggagaggagcccagcactgggattccgaggtgtttccattcagtgatctgcactgaacacagaggactcgccatggagtttgggctgagctgggttttccttgttgctattttaaaaggtgtccagtgtgaggtgcagctggtggagtcgtgggggagtcgttggtccaggccgtggggggtccctagaaactctcctgtgcagcctcgtggactacaccgtcaagtacgtaaacctccagtacgaaccgtcgggtcccgaccgacggtcctacccggagggggaacggggcgtaggggtaggtcggggttccttacgtaacgtttatttaaggtacggtacgggttacggtaaaccacgtaacctaaccgtaccgtcgaacgtaccgtaccggtagggacggggtcaaggtacttccgaacctatccgtacccaagtaacgaaccctaaagttaccgaaacggtaacccgtaaacgtccgttaaggttaacctttccgttaaaacaaaacgtacggtaaacccgacggtacccgtaggtaaggaacgttacccgggaaacggtacgaacggtcgtaaggttaattaagtttcgtgacggtacggaggacgttagtcggttacgttacgttgttttacgaacgtttgaccggggttacgggaaccgttaacgggaaccgttaggtacccgg

SEQ ID NO: 308568 - DNA, 773 bp, Homo sapiens
  misc_feature: GZ8MTXP02F9PVE.9.12.B01.1.454.CMB.2.raw
tcagtgatacgtctcacgaccggtgctcgatttagtagtgtagattccgcgggggctctgggagaggagcccagcactgggattccgaggtgtttccattcagtgatctgcactgaacacagaggactcgccatggagtttgggctgagtcgttgggttttccttgttgtcttaattttaaaaggtgtccagtgtgaggtgcagcgtggtggaggtcggtgggggtaggtcgtttcgggtcccgacggtcccgggttcggggggttacccctacggtaaaccttccgtcccgtgtgccacgtcctcgtaggtactaccgaccgtacaagtaacgtaacctacctaagtacgaaccggtccgggtcccgaccgacggccgtaccggaacggggaaggggtcgtgggtaggtcggtcgtacgttaagtttaagtttaagtaggtacgggttaacgtaaacccgtaacctaacgtaacgtaaccgacgaacggtaaccgtccggtagggaaacgggctaacgtacttaccaacctacttaccgtaccgaaagtaacgaaactaacgtaaccgaaacggtaacccaacggtaccttagttaaccttacgttaaaacgaaacgtacgaaaccacgtaccgtaagggaacggtacggtacggaacgaccgtaacggtacttaaggttaacttacgttaacgtggtagaccggaaagtacgtagtacggttacgttacgttgtttagacgtttacggcggttacggaccgtaaggtaacg

SEQ ID NO: 308569 - DNA, 751 bp, Homo sapiens
  misc_feature: GZ8MTXP02J2GE0.9.12.B01.1.454.CMB.2.raw
  modified_base (273)..(273): a, c, t, g, unknown or other
  misc_feature (273)..(273): n is a, c, g, or t
tcagtgatacgtctcacgaccggtgctcgatttagtagtgtagattccgcgggggctctgggagaggagcccagcactgggattccgaggtgtttccattcagtgatctgcactgaacacagaggactcgccatggagtttgggctgagcttgggtttttccttgttgcttaattttaaaaggtgtccagtgtgaggtgcagcgtggtggaggtcggtgggggaggtcgttggtccagcgaggtcgggggtccctagaacctctcctgtgcancctcgtggactacaccgtcagtacgtactacatacgaacgtcggtccgcgacggcgtcggaggggacggcgtagggacggtgggttctacgtaagtttagttaacgtacggtacggttacgtaaaccacgtaacgtaccgtaacgaccgtaacggtacccgtaccgggtaacgggaaacgggtacgaacgttaccgtttaaccaacccgtaactttacccgaaaccgtaacggaaaacgtaaacccgtaaaccgtttaccccggaaacggtaaacccgtacgttaccgttaacgttaccttaaccttaaacgaaacgttaacgaaccgtaaacgggtccgtaaggaacgtacggtaacggaacggaccgtaacggtactaggttaacttacggtacgtggaaacggaactaaggtacgtacggttacgtacgttaaccgtttagacggttacgtacgggacggaacgtacgggtaacg

SEQ ID NO: 308570 - DNA, 728 bp, Homo sapiens
  misc_feature: GZ8MTXP02I97GU.9.12.B01.1.454.CMB.2.raw
  modified_base (198)..(198): a, c, t, g, unknown or other
  misc_feature (198)..(198): n is a, c, g, or t
tcagtgatacgtctcacgaccggtgctcgatttagtagtgtagattccgcggggagctctgggagaggagcccagcactgggattccgaggtgtttccattcagtgatctgcactgaacacagaggactcgccatggagtttgggctgagcttgggttttccttgttgctaattttaaaaggtgtccagtgtgaggtncagctggtggagtcgtgggggaggtcgttggtccagccgtgggggtccctagaaactctcctgtgcagcctcgtggactacaccgtacagtagtaacctcagtgaacgtcggtcccgcaggcctaccggaaggggaaggggctagggaggttcgggtcttacgtaagtttaagtttagtacggtcggttaacggtaaacctactaagttaacctacgacctaacggtaccgttaccggtaggaaacggggtaccaaggtaactttaccaacccgtattacccgtacccgaagaaacgtaacctaaacgttcccgaaacggaaacctaccggtatacgttaacttaccttaaacgaaaacgttcgaaaacgaccgtaccttaagggaaccgttaggtaacgggaaccgggttaacgaaccgggttattaacggttaactttaacgttacgtggtaacgacggtaaacgtacgtacgtgtttacgtaacgtttagttacgaccttcggtcggtaaccgggaacgtaaacggg

SEQ ID NO: 308571 - DNA, 699 bp, Homo sapiens
  misc_feature: GZ8MTXP02FJNVW.9.12.B01.1.454.CMB.2.raw
  modified_base (225)..(225): a, c, t, g, unknown or other
  misc_feature (225)..(225): n is a, c, g, or t
  modified_base (240)..(240): a, c, t, g, unknown or other
  misc_feature (240)..(240): n is a, c, g, or t
  modified_base (373)..(373): a, c, t, g, unknown or other
  misc_feature (373)..(373): n is a, c, g, or t
  modified_base (675)..(675): a, c, t, g, unknown or other
  misc_feature (675)..(675): n is a, c, g, or t
tcagtgatacgtctcacgaccggtgctcgatttagtagtgtagattcggcggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcggtcaccatctcctgcactggaaccngcagtgacattggtntcttaataactatgtctcctggtaccaacagccacccgaggacaaacgtccccaaaatcaatgtaatttagtaggaggtacaaaagtaacggccggtcccctcggtcggggtccctagacgttcgtcctttcnccgtcggtacctaccaaagtttcgacggaccaaccgtaccgggtccctcccgtacgtacccgttcgtccggttacggggtcctcccggaaggtccgtaggaaccgtagttcggaaggtccttaggttaactttaacgtttaccgtcggactacgtaccctataatacgtcgaccgacggacccaacctaaactaaggtcgttaccggtacggtaaaacgggtcgggaaacccgtacggtacccgtaacccggttacgtacgggtaccgaaccgaacccgtaaacggaccccctaaaaccccncgttacgtacctaccgtttccccg

SEQ ID NO: 308572 - DNA, 720 bp, Homo sapiens
  misc_feature: GZ8MTXP02JU431.9.12.B01.1.454.CMB.2.raw
  modified_base (317)..(317): a, c, t, g, unknown or other
  misc_feature (317)..(317): n is a, c, g, or t
tcagtgatacgtctcacgaccggtgctcgatttagtagtgtagattccgcgggggctctgggagaggagcccagcactgggattccgaggtgtttccattcagtgatctgcactgaacacagaggactcgccatggagtttgggctgagcttgggttttccttgttgctaattttaaaaggtgtccagtgtgaggtgcagctggtggagtcgtgggggaggcgttggtccgaggccggtcggggggtccctaggaaacctctccgtgtgcacgtcctcgtggataccaccgtcagtatactcatagactcgggtccncgagctccggaggggaagggcgtgggaggtggtctacgtagtttatttagtaggcggtacgtaaccactatactacgcacgacgtccggtaggaacggggcaagtacttaccaaccgtactacctaccgaagaacgaactaaacgttcccgaaaggaccacgtcttacgttacttacctttaaacaaaacgttacgaaacgtacggtacccgttagggaaacggacggttacccgggaaagggacccgtaacggggtccttaaggttaactttaaacggtttaccgtaggttacggaccgggtaaagtacggggttaattacggggtttacgttaaccgtttgttttacggaaagtttacggttccgggttaacggggggaaccctaaaacgggggtaaaccg

SEQ ID NO: 308573 - DNA, 729 bp, Homo sapiens
  misc_feature: GZ8MTXP02H2DKN.9.12.B01.1.454.CMB.2.raw
  modified_base (255)..(255): a, c, t, g, unknown or other
  misc_feature (255)..(255): n is a, c, g, or t
  modified_base (285)..(285): a, c, t, g, unknown or other
  misc_feature (285)..(285): n is a, c, g, or t
  modified_base (433)..(433): a, c, t, g, unknown or other
  misc_feature (433)..(433): n is a, c, g, or t
tcagtgatacgtctcacgaccggtgctcgatttagtagtgtagattccgcggggattgtgaagtgagctacaacaggcaggcaggggcagcaagatggtgttgcagacccaggtcttcatttctctgttgctctggatctctggtgccgtacggggacatcgtgatgacccagtcctccagacctcccgtggctgtgtctcgtgggcgagacgggccacatacaactgacaacgtccagccagtagttgttttanacggctaccgacaaacaagaactacttagntttagatcgagtacaagaaacctaggaaccacgtacctacctaaaactcgtactactagttaaacgtcggtacactaccgacccccgactaaccggtcccggggtcctaggacccgtaattccgaggtacgacgtcggtagggttcgnggggaaacctagtaactttccactaccttacaaaccttacacgacgaccaacgcccgttagaccgtacgggttacgtaaacggtaggtacgttagggtacgttaccgtttaaacgtttacgtttaaccgtacggtttaacccgttacggtttacggttttccggttacccggggtacggtttaacccgggaaaacccgggtaaaacggggtaaccggtaaaacgggtaacggttaaaaccgaaccgttaaaacggtacgttacgggtccggacctacccggtaccgttaacgtacg

SEQ ID NO: 308574 - DNA, 589 bp, Homo sapiens
  misc_feature: GZ8MTXP02H92Z0.9.12.B01.1.454.CMB.2.raw
  modified_base (421)..(421): a, c, t, g, unknown or other
  misc_feature (421)..(421): n is a, c, g, or t
tcagtgatacgtctcacgaccggtgctcgatttagtagtgtagattccgcgggggctctgggagaggagcccagcactgggattccgaggtgtttccattcagtgatctgcactgaacacagaggactcgccatggagtttgggctgagctgggttttctgttgctattttaaaggtgtccagtgtgagtgcagctggtggagtcgtgggggaggcttggtccagccgtgggggtccctgaactctcctgtgcagcctcgtggactacaccgcagtacgtaactccatgacgtggtccgcacgactccgagggaggggctggaggtggtctctagttatagtagcggtaggaaccacatactacgctagactcgagaacggcagtatcgactactcaccagacgacaatcgaagaacacgntagtactactacaattacgaacacgactaggacgtagtacggaaggaccgacggtactagttaaactacttaacgtcgttcggacgtaaggagtacgtgtttacggtaccgttaagtttttagaacgtttacggtcgggtaccggggtacgtaaaacgggggtaaacc

SEQ ID NO: 308575 - DNA, 556 bp, Homo sapiens
  misc_feature: GZ8MTXP02FPY2S.9.12.B01.1.454.CMB.2.raw
  modified_base (277)..(277): a, c, t, g, unknown or other
  misc_feature (277)..(277): n is a, c, g, or t
  modified_base (353)..(353): a, c, t, g, unknown or other
  misc_feature (353)..(353): n is a, c, g, or t
  modified_base (366)..(366): a, c, t, g, unknown or other
  misc_feature (366)..(366): n is a, c, g, or t
  modified_base (398)..(398): a, c, t, g, unknown or other
  misc_feature (398)..(398): n is a, c, g, or t
  modified_base (455)..(455): a, c, t, g, unknown or other
  misc_feature (455)..(455): n is a, c, g, or t
  modified_base (482)..(482): a, c, t, g, unknown or other
  misc_feature (482)..(482): n is a, c, g, or t
  modified_base (496)..(496): a, c, t, g, unknown or other
  misc_feature (496)..(496): n is a, c, g, or t
tcagtgatacgtctcacgaccggtgctcgatttagtagtgtagattccgcggggggctctggggagaggagcccagcactgggattccgaggtgtttccattcagtgatctgcactgaacacagaggactcgccatggagtttgggctgagctgggtttccttgttgctattttaaaaaggtgtccagtgtgaggtgcagctggtgagtctgggggaggcttggtccagcctggggggtccctgaaactctcctgtgcagcctctggatacaccgtnagtgtaactccatgaactgggtccgccaggctccgaggggaaggggtctgggagtggggtctcagtttaatttaangcggtggtaaccncatactacgcagactcccgtgaaagggctagnttcaccatccaccgagagacaattcccaaggaactacgctgaactcttacaaagtanaacagctagagacgtacgaggacacgntagtatacttacgngacgacgagagtagtcgtagtacgtgtttagatacgcggtacggggaaccgaagggtaac

SEQ ID NO: 308576 - DNA, 671 bp, Homo sapiens
  misc_feature: GZ8MTXP02F3JFV.9.12.B01.1.454.CMB.2.raw
  modified_base (559)..(559): a, c, t, g, unknown or other
  misc_feature (559)..(559): n is a, c, g, or t
  modified_base (577)..(577): a, c, t, g, unknown or other
  misc_feature (577)..(577): n is a, c, g, or t
tcagtgatacgtctcacgaccggtgctcgatttagtagtgtagattccgcgggggctctgggagaggagcccagcactgggattccgaggtgtttccattcagtgatctgcactgaacacagaggactcgccatggagtttgggctgagcttgggttttccttgttgcttaattttaaaaggtgtccagtgtgaggtgcagctggtggagtcgtgggggaggtcgttggtccagccgtgggggtccctgaaactctcctgtgcacgcctcgtaggactaccaccgtcgagtacgtaacctccatcgaacgtcggtccgccgacggcgtaccggaggggagggcgtggaggtggtctcgtagtttattagtagtcggtagtaaccacactactacgacacgactccggtagaacggacacgtacttaccaacctataccctaccgaagaacgtaaactaaaccttaccgaaacggaacctacccggtattacgtaaacttccttaaacaaaagtcgaaaaccgcgtaccgtagggaaacgcggtacgaacgacgacggtnttagtaaattgtttacgnggtacgaacggaagtacgttacgttacgttacgtttactttaacggttttaagacgttacggttaccgggaaccggggaacgtaaaacggtacg

SEQ ID NO: 308577 - DNA, 639 bp, Homo sapiens
  misc_feature: GZ8MTXP02H2P2Y.9.12.B01.1.454.CMB.2.raw
  modified_base (297)..(297): a, c, t, g, unknown or other
  misc_feature (297)..(297): n is a, c, g, or t
  modified_base (338)..(338): a, c, t, g, unknown or other
  misc_feature (338)..(338): n is a, c, g, or t
tcagtgatacgtctcacgaccggtgctcgatttagtagtgtagattccgcggggagctctgggagaggagcccagcactgggattccgaggtgtttccattcagtgatctgcactgaacacagaggactcgccatggagtttgggctgagcgtggtttcgtgtagctatttaaaagtgtcagtgtgaggtgcagctggtggagtcgtgggggagcttggtccagccgtggggggtccctggaaactctccgtgtcgcagctctggatcacgtcagtagtaactcatgaactggtccncaggctccgaggaggctaggagtgggtctacaggtatttanaggtcgtacggtaacacaataccgtaagccaggaccttccggtaggaaaggggccaagtaagttctaacccaaattcacccgaaagggaacaacgtaaacgtaccgtaacgaacgaacgtacgtacgtacgttacttaacgtaaataacgtaaactaacgtacgtacgtagtacgtacggtaacggaacgacggtacgtacgtaacgttacttacgttacgtacgtacgtacggtacgtacgtagttacgttaacgttacgtttacgttacgttacgtacggttacgggtaacggtaacgg

SEQ ID NO: 308578 - DNA, 777 bp, Homo sapiens
  misc_feature: GZ8MTXP02FIAJ5.9.12.B01.1.454.CMB.2.raw
  modified_base (181)..(181): a, c, t, g, unknown or other
  misc_feature (181)..(181): n is a, c, g, or t
  modified_base (318)..(318): a, c, t, g, unknown or other
  misc_feature (318)..(318): n is a, c, g, or t
tcagtgatacgtctcacgaccggtgctcgatttagtagtgtagattccgcgggggcagctctgggagaggagcccagcactgggattccgaggtgtttccattcagtgatctgcactgaacacagaggactcgccatggagtttgggctgagctgggttttctgttgctatttaaaaggtntccagtgtgaggtgcagctggtggagtcgtgggggaggcgttaggtccaggccgtggggggtccctaggaaactctcctagtgcagtcctcgtaggactaccaccgtcaaggtacgtaacctcatgaactgggtccncgagctcgagggagggctggaggtggtctcgtagttatttagtagtccgggtaggtaacactacgtaacgtacgcgtacgaccgtaccgggtaggaaacggggtacaacgggttaacttacccgaaccctaacgtttccctacccggaaagaaccggtaacctaaaaccggttcccggaaaacgggtaaaacccctccggggacttaacgggtttaaaccttaacccttaaacgtaaaagttacccgaaacgtttaaaccggcccgttaaaggaaacgggtttaccgggaacggttaaacgggggacccgtaacgggggttaccttaaaagggtttaatttaaacccgtttcgggttagacgggggtaccgtaaagggggtaataaccgtttgggaaaccggtttccctaacgtttttaggggaacctttaggtaccgggggttacggggaaaacccgg

SEQ ID NO: 308579 - DNA, 761 bp, Homo sapiens
  misc_feature: GZ8MTXP02FJ7W7.9.12.B01.1.454.CMB.2.raw
tcagtgatacgtctcacgaccggtgctcgatttagtagtgtagattccgcggggtgggagaggagcccagcactgggattccgaggtgtttccattcagtgatctgcactgaacacagaggactcgccatggagtttgggctgagctgggttttccttgttgctaattttaaaaggtgtccagtgtgaggtgcagctgggtggagtcgtgggggaggcttggtccagccggtggggggtccctgaaactctcctgtgcagcctcgtggactacaccgtcagtacgtaactccatagaacgtcgggtcccgaccgaggccgtaccggagggggacggggcgtggggaggtgggtctcgtagtttattagtggtaccggtagtaaaccataactacgtaccgactagaccgtaccggttaggacgggcacgtacttcccacctacttccacccgaaagacgtaaccctaaaacgtttcccaaaaggggtaaacccacggtacccttagggttaaacttaccccgtttaaaaacgaaaacgtaaccggtaaacccgtacggtacccggttaggaaacgggtacgggtaaccggaaccgggtaaaccgtaaccggtagtttaacgttaacgtttacgttcggtaagggtacggacggtaagtaacggttgttacggttaccgtttaacggtttgttttaacggaacgttaccggggttacggggtaacccggggtaacgtaaaaggggtaaccctacgggtaccg

SEQ ID NO: 308580 - DNA, 786 bp, Homo sapiens
  misc_feature: GZ8MTXP02FVE0S.9.12.B01.1.454.CMB.2.raw
  modified_base (312)..(312): a, c, t, g, unknown or other
  misc_feature (312)..(312): n is a, c, g, or t
  modified_base (337)..(337): a, c, t, g, unknown or other
  misc_feature (337)..(337): n is a, c, g, or t
  modified_base (422)..(422): a, c, t, g, unknown or other
  misc_feature (422)..(422): n is a, c, g, or t
tcagtgatacgtctcacgaccggtgctcgatttagtagtgtagattccgcggggggctctgggagaggagcccagcactgggattccgaggtgtttccattcagtgatctgcactgaacacagaggactcgccatggagtttgggctgagctgggttttccttgttgctatttaaaaggtgtccagtgtgaggtgcagctggtggagtcgtgggggaggcttggtccagccgtgggggggtccctggaaactctcctagtgcagtcctcgtggatacaccgtcagtagtaactccaatgaaacgtgggtccnccgaaggcgtaccgaggggagggcngggtaggtggggtctcaggttttactttagaggtccggtaggtaaaccctacgtaactaacgtacgacgaaggtaccgttccggnggaaagggggtaccaaggtactttaccaccctaattacccttacccgaaagtacgaaaccttaaattacccgaaaggaacccaaacggtcccgttaagttaaactcctttaaaccgggaaattaacggaaacgagccccttaagggaacgaccgtttacggaacgggtaaccaaccgggggtaccttaagggtactttaacggtttaaaacccgtttcgggtacgggtacggtaaacgggggaaactaacgggtttaacgggttaaggtttaaaaccccggggtttcgtttttaaacggtaaaacgttcggttacccggttttacggggggggaaaaccctaaccgggggggtttaaaaacccg

SEQ ID NO: 308581 - DNA, 741 bp, Homo sapiens
  misc_feature: GZ8MTXP02JY47I.9.12.B01.1.454.CMB.2.raw
  modified_base (222)..(222): a, c, t, g, unknown or other
  misc_feature (222)..(222): n is a, c, g, or t
  modified_base (237)..(237): a, c, t, g, unknown or other
  misc_feature (237)..(237): n is a, c, g, or t
  modified_base (250)..(250): a, c, t, g, unknown or other
  misc_feature (250)..(250): n is a, c, g, or t
tcagtgatacgtctcacgaccggtgctcgatttagtagtgtagattcggcgggggggtctcaggaggcagcgctctcaggacgtcaccaccatggcctgggctctgctcctcctcaccctcctcactcaggcacagggtcctgggcccagtctgccctgactcacgcctccctcgcgtcccggtctcctggacagtcgtcaccatctcctgcactggaaccngcagtgactattggntacttataacttntacgtctccgtaggtaacccaacgacgaccaacccgaggtacctaaaacggttcccccaaaacttccaagttgtaacttttagtacggtaaggtacaaaacgttaaggccccggtaccccttcgggttcgggggttcccctggtaacgttccggtccttttcgtccccggttcggaccttaccgaaacggtttccgacggggacccaaccggtcccgggtcccccttacccgtacgtaacccggttcccgttacgtcggggcccttacccgaaaggttcccgttaggaaccgagttagggacggtaccgttaggtaactttacgttacgtaggctacgccttagactaggtcgacaaccggcccaaacccgtagtaacgtcgtacgttaccgggaggtaaccggaccgtaaccggtccaaccgttcgtacggtacgaccggaaccccgaacggtaccccaaaacccggtctacggtacccactttccccgg

SEQ ID NO: 308582 - DNA, 669 bp, Homo sapiens
  misc_feature: GZ8MTXP02FGYVA.9.12.B01.1.454.CMB.2.raw
  modified_base (492)..(492): a, c, t, g, unknown or other
  misc_feature (492)..(492): n is a, c, g, or t
tcagtgatacgtctcacgaccggtgctcgatttagtagtgtagattccgcgggggcagctctgggagaggagcccagcactgggattccgaggtgtttccattcagtgatctgcactgaacacagaggactcgccatggagtttgggctgagcttgggttttccttgttgctaattttaaaaggtgtccagtgtgaggtgcagctggtggagtcggtgggggagtcgttgggtccagtccggtgggggtccctagaactcctctgtgcagcctgtgactacacgtcaagtacgtaactcaatgaacgtgggtcccacgacgcctacggaggggtacgggcgtgggtagtcggggtctacgttagttaagtttagtagccgggtagtaaacacgtaatacgtaccgcgacgaccgtacgtaggaacgggctaaggtacttaccgacgttaataccctaaccgaggtacaaacttaccacgaaaggtaaacccnctacgttagtacttaactaacgtaagacgaactcgcgtaggtaacgtaacggtcgaacggaccgtacgtacgttaagttaacttacttaggtcgtaggaacgtaaggtaacgtgttacgttaacggttaccgtttacgtttaacggtacgtttacggaccgggttacggggtaaaac

SEQ ID NO: 308583 - DNA, 677 bp, Homo sapiens
  misc_feature: GZ8MTXP02JZXO7.9.12.B01.1.454.CMB.2.raw
  modified_base (309)..(309): a, c, t, g, unknown or other
  misc_feature (309)..(309): n is a, c, g, or t
  modified_base (449)..(449): a, c, t, g, unknown or other
  misc_feature (449)..(449): n is a, c, g, or t
tcagtgatacgtctcacgaccggtgctcgatttagtagtgtagattccgcgggggctctgggagaggagcccagcactgggattccgaggtgtttccattcagtgatctgcactgaacacagaggactcgccatggagtttgggctgagctgggttttccttgtgcttattttaaaaggtgtccagtgtgaggtgcagtctggtggagtcgtgggggaggcttggtccagccgtggggggtccctagaaacctctccgtgtgcacgcctcgtggataccacgtcagtagtactcatgaactcgggtccncgaggcgtaccgaggggaacggggctagggaggtcggggtactctaggtttaatttaacgtagtccgggttagaacccctactataactaaccggctacgtacgtcccggtaggaaacggggcctaggattccaaaccgntaccctacaagacgaacacttaccgacgggaaacacgggtactgtaactcttaaccaaagttacgaaccagtacccgtagaaggtacgtcggaaacggaacgttccggaccttaggtaacttattaaacggtgtagtacccgtaaagaaaggttgtaaccgttagtaacccgggttttctttaacggaacgtttacgtaccggtacgggtaacccggtaaggtaaccc

SEQ ID NO: 308584 - DNA, 388 bp, Homo sapiens
  misc_feature: GZ8MTXP01EYSSL.39.12.B01.1.454.CMB.2.raw
  modified_base (246)..(246): a, c, t, g, unknown or other
  misc_feature (246)..(246): n is a, c, g, or t
  modified_base (386)..(388): a, c, t, g, unknown or other
  misc_feature (386)..(388): n is a, c, g, or t
tcagtcgcactagtcacgaccggtgctcgatttagtagtgtagatttgggtgggaggcatcatccctcgctttgctacaccaacctacgcacagaaattccaaggcagagtcacgatttccgctgacgaatccacgaacacggcctatctagaactgagcagccttaagtctgaggacacggccatttatactgtgcaagagatcaccctctcacgtggggccaagggaccagggtcaccgtttcncagcctccaccaagggcccatcggtcttccccctggcaccctcctccaagagcacctctgggggcacagcggccctgggctgcctgggtcaaggactacttccactagtcgcgactgagcgggctggcaaggcgcatagnnn

SEQ ID NO: 308585 - DNA, 385 bp, Homo sapiens
  misc_feature: GZ8MTXP01ES69R.39.12.B01.1.454.CMB.2.raw
  modified_base (279)..(279): a, c, t, g, unknown or other
  misc_feature (279)..(279): n is a, c, g, or t
  modified_base (380)..(385): a, c, t, g, unknown or other
  misc_feature (380)..(385): n is a, c, g, or t
tcagtcgcactagtcacgaccggtgctcgatttagtagtgtagatttgggtgggaggcatcatccctcgctttgctacaccaacctacgcacagaaattccaaggcagagtcacgatttccgctgacgaatccacgaacacggcctatctagaactgagcagccttaagtctgaggacacggccatttattactgtgcaagagatcaccctctcacgtggggccaagggaccagggtcaccgtctcctcagcctccaccaaggcccatcggtctccccnggcaccctcctccaagagcacctctggggcacagcggccctgggctgcctggtcaaggctactccactagtgcgactgagcgggctggcaaggcgcatagnnnnnn

SEQ ID NO: 308586 - DNA, 394 bp, Homo sapiens
  misc_feature: GZ8MTXP01AYY27.39.12.B01.1.454.CMB.2.raw
  modified_base (387)..(394): a, c, t, g, unknown or other
  misc_feature (387)..(394): n is a, c, g, or t
tcagtcgcactagtcacgaccggtgctcgatttagtagtgtagatttgggtgggaggcatcatccctcgctttgctacaccaacctacgcacagaaattccaaggcagagtcacgatttccgctgacgaatccacgaacacggcctatctagaactgagcagccttaagtctgaggacacggccatttatactgtgcaagagatcaccctctcacgtggggccaagggaccagggtcaccgtctcctcagcctccaccaagggcccatcggtctccccctggcaccctcctccaagacgcacctcgtgggggcacagcggccctgggctgcctggtcaaggactacttccactacgtgcgactgagcgggctggcaaggcgcatagnnnnnnnn

SEQ ID NO: 308587 - DNA, 667 bp, Homo sapiens
  misc_feature: GZ8MTXP01ACLYD.39.12.B01.1.454.CMB.2.raw
  modified_base (214)..(214): a, c, t, g, unknown or other
  misc_feature (214)..(214): n is a, c, g, or t
tcagtcgcactagtcacgaccggtgctcgatttagtagtgtagattcgcgcggacccaaaaaccacacccctccttgggagaatcccctagatcacagctcctcaccatggactggacctggagcatcctttttcttggtggcagcaacaacaggtgcccactcccaggttcagctggtacagtctggagctgagatgacgagccgtgggcctnagtgaaggtctcctgcaaggtcttctgttacacctttaccaactatggtatcgtaggttgggtgacgacgacggcccccgtagggacgaagggtcttaggaggtggagtggggatggatcgagcgtacttacaagttggtacaacaacgtaaactacgtacgactaacaacggaaccctccgaaaggggacaaggacgtaccaacagtcgaaccaacacgaaccaacactaccgacgacgaccgaaccggacctaacagtacggaaccgtaggaacggtacgaccggtaggacgtacgtacgtacggaaccgaccggaccggttacgtagttacttacgtggtcggaacgaaggttaaggtaggttacgggttaaaatttcgtttacgttcgttacggttaacccttgttaacggtactacgggttccgggtaaccgttaacgggttaacccg

SEQ ID NO: 308588 - DNA, 397 bp, Homo sapiens
  misc_feature: GZ8MTXP01DIW4N.39.12.B01.1.454.CMB.2.raw
  modified_base (212)..(212): a, c, t, g, unknown or other
  misc_feature (212)..(212): n is a, c, g, or t
  modified_base (383)..(383): a, c, t, g, unknown or other
  misc_feature (383)..(383): n is a, c, g, or t
  modified_base (389)..(397): a, c, t, g, unknown or other
  misc_feature (389)..(397): n is a, c, g, or t
tcagtcgcactagtcacgaccggtgctcgatttagtagtgtagatttgggtgggaggcatcatccctcgctttgctacaccaacctacgcacagaaattccaaggcagagtcacgatttccgctgacgaatccacgaacacggcctatctagaactgagcagccttaagtctgaggacacggccattttatactgtgcaagagatcaccctntcacgtgggccaagggccagggtcaccgtctcctcagcctccaccaagggcccatcggtcttccccctggccaccctcctccaagacgccacctcgtgggggcacagccggccctgggctgcctggtcaggctacttcactcgtgcgactgagcgggctgggcaaagggcncatagnnnnnnnnn

SEQ ID NO: 308589 - DNA, 448 bp, Homo sapiens
  misc_feature: GZ8MTXP01EP0IK.39.12.B01.1.454.CMB.2.raw
  modified_base (294)..(294): a, c, t, g, unknown or other
  misc_feature (294)..(294): n is a, c, g, or t
  modified_base (431)..(431): a, c, t, g, unknown or other
  misc_feature (431)..(431): n is a, c, g, or t
  modified_base (438)..(448): a, c, t, g, unknown or other
  misc_feature (438)..(448): n is a, c, g, or t
tcagtcgcactagtcacgaccggtgctcgatttagtagtgtagatttgggtgggaggcatcatccctcgctttgctacaccaacctacgcacagaaattccaaggcagagtcacgatttccgctgacgaatccacgaacacggcctatctagaactgagcagccttaagtctgaggacacggcctattttatactgtgcaagagatccaccctctcgacggtcggggaccaaggggaccagggtccaccgtctcctcacgccctccaccgaaggcccatccggtccttcccccnggccacccctcctaccaagcgccacccgtcgtcgggggccacgcgccggcccgtgggcctcggcccgtggtaccgaaggtaccttaccttccaacgttacgtggacgacgtggacggccgggctgggacgaagggcncagtagnnnnnnnnnnn

SEQ ID NO: 308590 - DNA, 376 bp, Homo sapiens
  misc_feature: GZ8MTXP01D5BVX.39.12.B01.1.454.CMB.2.raw
  modified_base (276)..(276): a, c, t, g, unknown or other
  misc_feature (276)..(276): n is a, c, g, or t
  modified_base (289)..(289): a, c, t, g, unknown or other
  misc_feature (289)..(289): n is a, c, g, or t
  modified_base (370)..(376): a, c, t, g, unknown or other
  misc_feature (370)..(376): n is a, c, g, or t
tcagtcgcactagtcacgaccggtgctcgatttagtagtgtagatttgggtgggaggcatcatccctcgctttgctacaccaacctacgcacagaaattccaaggcagagtcacgatttccgctgacgaatccacgaacacggcctatctagaactgagcagccttaagtctgaggacacggccattttatactgtgcaagagatcaccctctcacgtgggccaagggaccagggtcacgtctcctcagcctccacaaggcccatcggtctccccngcaccctctcagncacctctggggcacagcgccctggctgcctggtcaaggctactcactacgtgcgactgagcgggctggcaaggcgcatagnnnnnnn

SEQ ID NO: 308591 - DNA, 487 bp, Homo sapiens
  misc_feature: GZ8MTXP01EVOBO.39.12.B01.1.454.CMB.2.raw
  modified_base (202)..(202): a, c, t, g, unknown or other
  misc_feature (202)..(202): n is a, c, g, or t
  modified_base (207)..(207): a, c, t, g, unknown or other
  misc_feature (207)..(207): n is a, c, g, or t
  modified_base (216)..(216): a, c, t, g, unknown or other
  misc_feature (216)..(216): n is a, c, g, or t
  modified_base (301)..(301): a, c, t, g, unknown or other
  misc_feature (301)..(301): n is a, c, g, or t
  modified_base (463)..(463): a, c, t, g, unknown or other
  misc_feature (463)..(463): n is a, c, g, or t
  modified_base (467)..(487): a, c, t, g, unknown or other
  misc_feature (467)..(487): n is a, c, g, or t
tcagtcgcactagtcacgaccggtgctcgatttagtagtgtagatttgggtgggaggcatcatccctcgctttgctacaccaacctacgcacagaaattccaaggcagagtcacgatttccgctgacgatccacgaacacggcctatctagaactgagcagccttaagtctgaggacacggcctatttattactgtgcaagngtacnctacccctntccgacggtggggccaaggggaccagggtccaccgtctcctcacgcctaccaccgaacgggcccagtccggtccccttcccccgnggccctacccctcctccaagacgcctaccgtcggtcgggggccacgacggcccggccctggggtcctcggcccgtttcgggtaccgaaacggtacctaccgttcccacgttacggtcgacgtacgtcgggacggtcggggccgtgggaccgagggccgacgntagnnnnnnnnnnnnnnnnnnnnn

SEQ ID NO: 308592 - DNA, 381 bp, Homo sapiens
  misc_feature: GZ8MTXP02HG8WI.39.12.B01.1.454.CMB.2.raw
  modified_base (245)..(245): a, c, t, g, unknown or other
  misc_feature (245)..(245): n is a, c, g, or t
  modified_base (378)..(381): a, c, t, g, unknown or other
  misc_feature (378)..(381): n is a, c, g, or t
tcagtcgcactagtcacgaccggtgctcgatttagtagtgtagatttgggtgggaggcatcatccctcgctttgctacaccaacctacgcacagaaattccaaggcagagtcacgatttccgctgacgaatccacgaacacggcctatctagaactgagcagccttaagtctgaggacacggccatttattactgtgcaagagatcaccctctcacgtggggccaagggccagggtcaccgttcncagcctcacaggcccatcggtctcccctggcaccctcctccaagagcacctctggggcacagcggccctgggctgcctggtcaaggactacttccactagtcgcgactgagcgggctgggcaaggcgcatagnnnn

SEQ ID NO: 308593 - DNA, 391 bp, Homo sapiens
  misc_feature: GZ8MTXP02IY1UL.39.12.B01.1.454.CMB.2.raw
  modified_base (385)..(391): a, c, t, g, unknown or other
  misc_feature (385)..(391): n is a, c, g, or t
tcagtcgcactagtcacgaccggtgctcgatttagtagtgtagatttgggtgggaggcatcatccctcgctttgctacaccaacctacgcacagaaattccaaggcagagtcacgatttccgctgacgaatccacgaacacggcctatctagaactgagcagccttaagtctgaggacacggccatttattactgtgcaagagatcaccctctcacgtggggccaagggaccagggtcaccgtctcctcagcctccaccaagggcccatcggtcttcccctggcaccctcctccaagagcaccctctggggcacagcggccctgggctgcctggtcaggactactccactagtgcgactgagcgggctgggcaagggcgcatagnnnnnnn

SEQ ID NO: 308594 - DNA, 386 bp, Homo sapiens
  misc_feature: GZ8MTXP02G28GU.39.12.B01.1.454.CMB.2.raw
  modified_base (382)..(386): a, c, t, g, unknown or other
  misc_feature (382)..(386): n is a, c, g, or t
tcagtcgcactagtcacgaccggtgctcgatttagtagtgtagatttgggtgggaggcatcatccctcgctttgctacaccaacctacgcacagaaattccaaggcagagtcacgatttccgctgacgaatccacgaacacggcctatctagaactgagcagccttaagtctgaggacacggccatttatactgtgcaagagatcaccctctcacgtggggccaagggaccagggtcaccgtctcctcagcctcaccaaggcccatcggtcttcccctggcaccctcctccaagacgcacctctggggcacagcggccctgggctgcctggtcaaggactacttccactagtgcgactgagcggctgggcaaggcgcatagnnnnn

SEQ ID NO: 308595 - DNA, 391 bp, Homo sapiens
  misc_feature: GZ8MTXP02JUYR6.39.12.B01.1.454.CMB.2.raw
  modified_base (387)..(391): a, c, t, g, unknown or other
  misc_feature (387)..(391): n is a, c, g, or t
tcagtcgcactagtcacgaccggtgctcgatttagtagtgtagatttgggtgggaggcatcatccctcgctttgctacaccaacctacgcacagaaattccaaggcagagtcacgatttccgctgacgaatccacgaacacggcctatctagaactgagcagccttaagtctgaggacacggccatttattactgtgcaagagatcaccctctcacgtggggccaagggaccagggtcaccgtctcctcagcctccaccaaggcccatcggtctccccctggcaccctcctccaagacgcacctcgtggggcacgagcggccctgggctgcctggtcaaggactactccactacgtgcgactgagcgggctgggcaaggcgcatagnnnnn

SEQ ID NO: 308596 - DNA, 383 bp, Homo sapiens
  misc_feature: GZ8MTXP02IFX6B.39.12.B01.1.454.CMB.2.raw
  modified_base (212)..(212): a, c, t, g, unknown or other
  misc_feature (212)..(212): n is a, c, g, or t
  modified_base (247)..(247): a, c, t, g, unknown or other
  misc_feature (247)..(247): n is a, c, g, or t
  modified_base (376)..(376): a, c, t, g, unknown or other
  misc_feature (376)..(376): n is a, c, g, or t
  modified_base (382)..(383): a, c, t, g, unknown or other
  misc_feature (382)..(383): n is a, c, g, or t
tcagtcgcactagtcacgaccggtgctcgatttagtagtgtagatttgggtgggaggcatcatccctcgctttgctacaccaacctacgcacagaaattccaaggcagagtcacgatttccgctgacgaatccacgaacacggcctatctagaactgagcagccttaagtctgaggacacggccattttatactgtgcaagagatcaccctntcacgtggggccaagggaccagggtcaccgtttcncagcctcaccaggcccatcggtctcccctggcaccctcctccaagagcacctctggggcacagcggccctgggctgcctggtcaaggactacttccactagtcgcgactgagcgggctgggcaagggcncatagnn

SEQ ID NO: 308597 - DNA, 390 bp, Homo sapiens
  misc_feature: GZ8MTXP02I8BJ4.39.12.B01.1.454.CMB.2.raw
  modified_base (385)..(390): a, c, t, g, unknown or other
  misc_feature (385)..(390): n is a, c, g, or t
tcagtcgcactagtcacgaccggtgctcgatttagtagtgtagatttgggtgggaggcatcatccctcgctttgctacaccaacctacgcacagaaattccaaggcagagtcacgatttccgctgacgaatccacgaacacggcctatctagaactgagcagccttaagtctgaggacacggccatttattactgtgcaagagatcaccctctcacgtggggccaagggaccagggtcaccgtctcctcagcctccaccaaggcccatcggtctcccctggccaccctcctccagacgcacctcgtggggcacagcggccctgggctgcctggtcaaggactactccactagtgcgactgagcgggctgggcaagggcgcatagnnnnnn

SEQ ID NO: 308598 - DNA, 395 bp, Homo sapiens
  misc_feature: GZ8MTXP02H7ZS3.39.12.B01.1.454.CMB.2.raw
  modified_base (361)..(361): a, c, t, g, unknown or other
  misc_feature (361)..(361): n is a, c, g, or t
  modified_base (391)..(395): a, c, t, g, unknown or other
  misc_feature (391)..(395): n is a, c, g, or t
tcagtcgcactagtcacgaccggtgctcgatttagtagtgtagatttgggtgggaggcatcatccctcgctttgctacaccaacctacgcacagaaattccaaggcagagtcacgatttccgctgacgaatccacgaacacggcctatctagaactgagcagccttaagtctgaggacacggccatttattactgtgcaagagatcaccctctcacgtggggccaagggaccagggtcaccgtctcctcagcctccaccaaggcccatcggtctccccctggccaccctcctccaagacgcaccctcgtcggggcacgagccggccctgggcctgcctggtcaaggactacttccactagngcgactgagcgggctggcaaggcgcatagnnnnn

SEQ ID NO: 308599 - DNA, 393 bp, Homo sapiens
  misc_feature: GZ8MTXP02HMDFX.39.12.B01.1.454.CMB.2.raw
  modified_base (195)..(195): a, c, t, g, unknown or other
  misc_feature (195)..(195): n is a, c, g, or t
  modified_base (213)..(213): a, c, t, g, unknown or other
  misc_feature (213)..(213): n is a, c, g, or t
  modified_base (379)..(379): a, c, t, g, unknown or other
  misc_feature (379)..(379): n is a, c, g, or t
  modified_base (385)..(393): a, c, t, g, unknown or other
  misc_feature (385)..(393): n is a, c, g, or t
tcagtcgcactagtcacgaccggtgctcgatttagtagtgtagatttgggtgggaggcatcatccctcgctttgctacaccaacctacgcacagaaattccaaggcagagtcacgatttccgctgacgaatccacgaacacggcctatctagaactgagcagccttaagtctgaggacacggccattttattacngtgcaagagatcaccctntcacgtgggccaagggccagggtcaccgtctcctcagccctccaccaagggcccatcggtctccccctggccaccctcctccaagacgcacctctggggcacagccggcctgggctgcctggtcaaggctacttccatacgtgcgactgagcgggctggcaaggcncatagnnnnnnnnn

SEQ ID NO: 308600 - DNA, 398 bp, Homo sapiens
  misc_feature: GZ8MTXP02IKS3B.39.12.B01.1.454.CMB.2.raw
  modified_base (213)..(213): a, c, t, g, unknown or other
  misc_feature (213)..(213): n is a, c, g, or t
  modified_base (392)..(398): a, c, t, g, unknown or other
  misc_feature (392)..(398): n is a, c, g, or t
tcagtcgcactagtcacgaccggtgctcgatttagtagtgtagatttgggtgggaggcatcatccctcgctttgctacaccaacctacgcacagaaattccaaggcagagtcacgatttccgctgacgaatccacgaacacggcctatctagaactgagcagccttaagtctgaggacacggccattttattactgtgcaagagatcaccctntcacgtggggccaagggaccagggtcaccgtctcctcagcctcaccaagggcccatcggtcttccccctggccaccctcctccaagacgcacctctgggggcacagcggccctgggctgccctggtcaaggactacttccactacgtgcgactgagccgggctgggcaaggcgcatagnnnnnnn

SEQ ID NO: 308601 - DNA, 403 bp, Homo sapiens
  misc_feature: GZ8MTXP02G1J6M.39.12.B01.1.454.CMB.2.raw
  modified_base (212)..(212): a, c, t, g, unknown or other
  misc_feature (212)..(212): n is a, c, g, or t
  modified_base (299)..(299): a, c, t, g, unknown or other
  misc_feature (299)..(299): n is a, c, g, or t
  modified_base (396)..(403): a, c, t, g, unknown or other
  misc_feature (396)..(403): n is a, c, g, or t
tcagtcgcactagtcacgaccggtgctcgatttagtagtgtagatttgggtgggaggcatcatccctcgctttgctacaccaacctacgcacagaaattccaaggcagagtcacgatttccgctgacgaatccacgaacacggcctatctagaactgagcagccttaagtctgaggacacggccatttattactgtgcaagagatcaccctntcacgtgggccaagggccagggtcaccgtctcctcagcctccaccaaggcccatccgtcttcccctggccacccctcctccaagacnccacctcgtcggggcacgacggccggccctgggctgcctggtacaaggactactccactgtgcgacgtgaggcggggctcgggcaaggcgacatagnnnnnnnn

SEQ ID NO: 308602 - DNA, 671 bp, Homo sapiens
  misc_feature: GZ8MTXP02J0K91.39.12.B01.1.454.CMB.2.raw
  modified_base (216)..(216): a, c, t, g, unknown or other
  misc_feature (216)..(216): n is a, c, g, or t
tcagtcgcactagtcacgaccggtgctcgatttagtagtgtagattcggcgggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctnagtgaaggtctcctgcaaggcttctggttacacctttaccaactatggtatcagttgggtgcgacaggcccctggacaagggcttgagtggatgggatggatcagtcgcttacaatggtacaacgaccaaatgtgcccaacagaaccctcgagggcagcgtacaccatacgaccaacacgaccacactacccacgacgccacggacctacgagtacggaacctaggaggacgccgtaggagactcgtacggacgtaaccgaccgggtaccggttacggtaactttacggttcggtacggaccggacgggtaacgggtacggtaaacggggggtaaaatttaacgggttttacgtaaaccggttccgggttaacccccgttcggttttaccggtaaccggttacccgggtaccgggggtacccccggtaaacgggggtaaccccgtttacccgggg

SEQ ID NO: 308603 - DNA, 689 bp, Homo sapiens
  misc_feature: GZ8MTXP02JQ4UF.39.12.B01.1.454.CMB.2.raw
  modified_base (281)..(281): a, c, t, g, unknown or other
  misc_feature (281)..(281): n is a, c, g, or t
  modified_base (547)..(547): a, c, t, g, unknown or other
  misc_feature (547)..(547): n is a, c, g, or t
tcagtcgcactagtcacgaccggtgctcgatttagtagtgtagatttcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtggggcctcgagtgaaggtcctctggcaaggtcttctgttactacctttacaacttatggtatcgtagttggtncgacaggccctggacaaggcttgagtggagtggatggatcgagcgtacttacgaaagtcggtacacgaaacaaatactagaccccaacgacggaaacctcgaacgggcaagcgtaccactagaccaacgacaacgtacacaacgtacccgagacgacaccggtaccctaaagacgtacgggaacctggggaacgtagcccgtaaggacgtacgttacacgggaaaccgaccgacgggttacccgtaggtttacttaacggttcggngaaacggtaacggaaacggttacggggtaaacggggtaaaatttcgggttttaccggtaaaccgttttccggggtaaccctttaaggttacgttaccggttaacgggccgggttacccggaaacgggttaacccgttccggg

SEQ ID NO: 308604 - DNA, 539 bp, Homo sapiens
  misc_feature: GZ8MTXP01BVW7R.39.59.F04.1.454.CMB.2.raw
tcagtcgcactagtcacgaccggtgctcgatttagtacacacacttagggattgggaggcttggtacggcctggggggtccctgagactctcctgtgcagcctctggactaatctttagtaaatacgccatgatctgggtccgccaggctccagggaaggggctggagtgggtctcagccatttccggcaatggtggtggcacacactacgcagactccgtgaagggccggttcaccgtctccagagacaattccaggaacactctctatctggaaatgaatagcctgagagccgacgacacggccatatattattgtgacgaaacgaccccaacggtgaccacattggagcttttgacttcgtggggccaagggaacaacggtcaccgtctcttcagcctcaccagggcccatcggtcttcccctggccgccctgctccagacgcacctccggagagcacagccggccctgggctcgcctggtcaagggcctacttccacttagtcgcgacttgagcgggctgggcagggcgcaagtg

SEQ ID NO: 308605 - DNA, 554 bp, Homo sapiens
  misc_feature: GZ8MTXP01AJKGZ.39.59.F04.1.454.CMB.2.raw
tcagtcgcactagtcacgaccggtgctcgatttagtacacacacttagggattgggaggcttggtacggcctggggggtccctgagactctcctgtgcagcctctggactaatctttagtaaatacgccatgatctgggtccgccaggctccagggaaggggctggagtgggtctcagccatttccggcaatggtggtggcacacactacgcagactccgtgaagggccggttcaccgtctccagagacaattccaggaacactctctatctggaaatgaatagcctgagagccgacgacacggccatatattatgtgacgaaagccccaaggtgaccacattggagtctttttcgactttcgtgggggcccaaaggggaacaacgggtcaacccgtctcttcagcctccaccagggcccatcggtcttcccctgccgcctgcctccgagacgcacctccgggagacgcaccacgccggccctggggcctgcctggtcaagggaactacgttccacttagtgcgacttgacgcgggctgggcaggcgtcaagtg

SEQ ID NO: 308606 - DNA, 631 bp, Homo sapiens
  misc_feature: GZ8MTXP01D5E2F.39.59.F04.1.454.CMB.2.raw
tcagtcgcactagtcacgaccggtgctcgatttagtacacacacttagggattgggaggcttggtacggcctgggggggtccctgagactctcctgtgcagcctctggactaatctttagtaaatacgccatgatctgggtccgccaggctccagggaaggggctggagtgggtctcagccatttccggcaatggtggtggcacacactacgcagactccgtgaagggccgttcaccgtctccagagacaattccaggaacactctctatctaggaaatgaatagcctgagacgcgacgacacggccatatattattgtagacgaaacgaacccccgaacgggtgaacccactacgttaggagtctttttacgactttcggtggggacccgaagggaaaccaacgggtcacccgtctccttacacgtcctaccaccaacgggccccagttcccggtcccttcccccgtggcccgcccttgcctccgaggcgacctaccctccggggaagacgccaacgcgcccggcccgtgggcctcgcccgtcggtacgaacggaaccttccttccctaacgttacggtcgcggaccgttggaccgggcgggtacgtcgggacaacgggcgaacgaagtg

SEQ ID NO: 308607 - DNA, 548 bp, Homo sapiens
  misc_feature: GZ8MTXP01BSBOB.39.59.F04.1.454.CMB.2.raw
  modified_base (443)..(443): a, c, t, g, unknown or other
  misc_feature (443)..(443): n is a, c, g, or t
  modified_base (449)..(449): a, c, t, g, unknown or other
  misc_feature (449)..(449): n is a, c, g, or t
tcagtcgcactagtcacgaccggtgctcgatttagtacacacacttagggattgggaggcttggtacggcctggggggtccctgagactctcctgtgcagcctctggactaatctttagtaaatacgccatgatctggtccgccaggctccagggaaggggctggagtgggtctcagccattttccggcaatggtggtggcacacactacgcagactccgtgaagggccggttcaccgtctccagagacaattccaggaacactctctatctggaaatgaatagcctgagagccgacgacacggccatatattattgtgacgaaagaccccaaacggtgaccacattggagtcttttcgacttctggggccaaggggaacaaacggtcaccgtctcttcagcctccacaacgggggccatcgtcttcccctcgcgccctcgcnccacgngcacctccggagagcacacgcggccctgggctcgtccgtcggtcaaggaactacttccaccttagtcgcgacttgagcggctcggcaggcgcaagtaag

SEQ ID NO: 308608 - DNA, 635 bp, Homo sapiens
  misc_feature: GZ8MTXP01DP15R.39.59.F04.1.454.CMB.2.raw
tcagtcgcactagtcacgaccggtgctcgatttagtacacacacttagggattgggaggcttggtacggcctgggggggtccctgagactctcctgtgcagcctctggactaatctttagtaaatacgccatgatctgggtccgccaggctccagggaaggggctggagtgggtctcagccatttccggcaatggtggtggcacacactacgcagactccgtgaagggccggttcaccgtctccagagacaattccaggaacactctctatctaggaaatagaatagcctgagagccgacgacgacggcaatatattattgtgacgaaacgaccccaacggtgaaccactagttggagtcttttcgactttcgtggggaccaagggaaccaacggtcaccgtctcttacacgtcctaccgaaccgaacgggcccagttccggtcccttcccccgtggcccgtcccctgcccgtccgaacgggcgacctaccccgtcggggaacgcggaccacgacggccggccccgttgggggcctcggtcccgtaggttaccgaaagggtaacccttactttcccgaacgttggtccgcgttacgttcggacggcggggccgtggcggacggacgtcgaagaag

SEQ ID NO: 308609 - DNA, 603 bp, Homo sapiens
  misc_feature: GZ8MTXP01EB2FS.39.59.F04.1.454.CMB.2.raw
  modified_base (290)..(290): a, c, t, g, unknown or other
  misc_feature (290)..(290): n is a, c, g, or t
  modified_base (351)..(351): a, c, t, g, unknown or other
  misc_feature (351)..(351): n is a, c, g, or t
  modified_base (452)..(452): a, c, t, g, unknown or other
  misc_feature (452)..(452): n is a, c, g, or t
  modified_base (472)..(472): a, c, t, g, unknown or other
  misc_feature (472)..(472): n is a, c, g, or t
  modified_base (507)..(507): a, c, t, g, unknown or other
  misc_feature (507)..(507): n is a, c, g, or t
  modified_base (581)..(581): a, c, t, g, unknown or other
  misc_feature (581)..(581): n is a, c, g, or t
tcagtcgcactagtcacgaccggtgctcgatttagtacacacacttagggattgggaggcttggtacggcctgggggggtccctgagactctcctgtgcagcctctggactaatctttaagtaaatacgccatgatctgggtccgccaggctccgaggggaaggggctggagtgggtctcagccatttccggcaagtgggtggtggcacacactacgcagactccgtggaacgggccgttcaccgtctccagagacaattccaggaacactctctatctaggaaatgaanagcctgagacgccgacgacacggccaatatatttattgtgacgaaacgaccccaacgggtnaccactagttggagtctttttgacctttcggtggggaccaagggaaccaaacggtccaccgtctcttcacgcctccacgacggccagtcgtccttccccgngccgccctgcctccgaggcnccacccgtcgggagacgccaacgtcgccggccccnggggtcctcggtcctggtaccaaacggtccttaccgttacccagttacgtcgcgttacgttggacgggcgggtncgggacgacgggcctgaagtcg

SEQ ID NO: 308610 - DNA, 527 bp, Homo sapiens
  misc_feature: GZ8MTXP02JBJEM.39.59.F04.1.454.CMB.2.raw
  modified_base (424)..(424): a, c, t, g, unknown or other
  misc_feature (424)..(424): n is a, c, g, or t
  modified_base (437)..(437): a, c, t, g, unknown or other
  misc_feature (437)..(437): n is a, c, g, or t
tcagtcgcactagtcacgaccggtgctcgatttagtacacacacttagggattgggaggcttggtacggcctgggggtccctgagactctcctgtgcagcctctggactaatctttagtaaatacgccatgatctgggtccgccaggctccagggaaggggctggagtgggtctcagccatttccggcaatggtggtggcacacactacgcagactccgtgaagggccggttcaccgtctccagagacaattccaggaacactctctatctggaaatgaatagcctgagagccgacgacacggccatatattatgtgcgaaagaccccaacggtgaccacattggagcttttgacttctggggccaagggcaacggtcaccgtctcttcagcctccaccaaggcccatcgtcttcccctggccnccctgcctccagncaccctccgagacgcacagccggccctggggctgccctggtcaaggctacttccactagtcgcgactgagcgggctggcaaggcgcatag

SEQ ID NO: 308611 - DNA, 589 bp, Homo sapiens
  misc_feature: GZ8MTXP02GEQCP.39.59.F04.1.454.CMB.2.raw
  modified_base (341)..(341): a, c, t, g, unknown or other
  misc_feature (341)..(341): n is a, c, g, or t
  modified_base (367)..(367): a, c, t, g, unknown or other
  misc_feature (367)..(367): n is a, c, g, or t
  modified_base (440)..(440): a, c, t, g, unknown or other
  misc_feature (440)..(440): n is a, c, g, or t
  modified_base (470)..(470): a, c, t, g, unknown or other
  misc_feature (470)..(470): n is a, c, g, or t
tcagtcgcactagtcacgaccggtgctcgatttagtacacacacttagggattgggaggcttggtacggcctgggggggtccctgagactctcctgtgcagcctctggactaatctttagtaaatacgccatgatctgggtccgccaggctccagggaaggggctggagtgggtctcagccatttccggcaatggtggtggcacacactacgcagactccgtgaagggccgttcaccgtctcagagacaatccaggaacactctctatctggaaatgaaatgaaaacctgagagccgacgacacggcaatatattattgtgacgaaaacgaccccaaggtnaccacattggagtctttgactttcgnggggaccaaggacaacggtcaccgtctcttcagccctcaccaaacgggcccagtcgtccttcccccgtgcccnccctgcctccgaggcgccaccctcgaacgngcaacgacgcccggtccgtgggctcgcccgtggtaccaaaacggtaccttaccgttaccaacgttacggtcgaccgtaacgtcggacggcggtcgacggacgaacggctacgaagtacg

SEQ ID NO: 308612 - DNA, 536 bp, Homo sapiens
  misc_feature: GZ8MTXP02FIPXF.39.59.F04.1.454.CMB.2.raw
  modified_base (361)..(361): a, c, t, g, unknown or other
  misc_feature (361)..(361): n is a, c, g, or t
tcagtcgcactagtcacgaccggtgctcgatttagtacacacacttagggattgggaggcttggtacggcctggggggtccctgagactctcctgtgcagcctctggactaatctttagtaaatacgccatgatctgggtccgccaggctccagggaaggggctggagtgggtctcagccatttccggcaatggtggtggcacacactacgcagactccgtgaagggccggttcaccgtctccagagacaattccaggaacactctctatctggaaatgaatagcctgagagccgacgacacggccatatattattgtgcgaaagaccccaacggtgaccacattggagcttttgacttcnggggccaagggacaacgggtcaccgtctcttcagcctccaccaaacgggcccatcggtcttccccctgccgccctgctccaggacgccaccctcgagagcacagccgccctgggctgcctggtcaaggctacttccactagtcgcgactgacgcgggctcggcaaggcgacatag

SEQ ID NO: 308613 - DNA, 583 bp, Homo sapiens
  misc_feature: GZ8MTXP02GNK7L.39.59.F04.1.454.CMB.2.raw
  modified_base (248)..(248): a, c, t, g, unknown or other
  misc_feature (248)..(248): n is a, c, g, or t
  modified_base (463)..(463): a, c, t, g, unknown or other
  misc_feature (463)..(463): n is a, c, g, or t
tcagtcgcactagtcacgaccggtgctcgatttagtacacacacttagggattgggaggcttggtacggcctggggggtccctgagactctcctgtgcagcctctggactaatctttagtaaatacgccatgatctgggtccgccaggctccaggggaaggggctggagtgggtctcagccatttccggcaatggtggtggcacacactacgcagactccgtgaagggccggttcaccgtctccaganacaattccaggaacactctctatctggaaatgaatagcctgagagccgacgacacgcatatatatgtgacgaaaagaccccaaggtgaaccacagttggagtctttttagactttcgtggggaccaagggacaacggtcaccgtctcttcacgcctccaccaaacgggcccaagtccggtccttcccccgtggcccgccctgcctccgagggacncccgaacctccggaagacgaccacgacgcccggcccgtgggcctgcccgtggtacaacggacttaccttccacgtaggtcgccgactggaacggccgggctaggcgaacggcgacagtag

SEQ ID NO: 308614 - DNA, 620 bp, Homo sapiens
  misc_feature: GZ8MTXP02G8KAF.39.59.F04.1.454.CMB.2.raw
  modified_base (479)..(479): a, c, t, g, unknown or other
  misc_feature (479)..(479): n is a, c, g, or t
  modified_base (485)..(485): a, c, t, g, unknown or other
  misc_feature (485)..(485): n is a, c, g, or t
  modified_base (619)..(619): a, c, t, g, unknown or other
  misc_feature (619)..(619): n is a, c, g, or t
tcagtcgcactagtcacgaccggtgctcgatttagtacacacacttagggattgggaggcttggtacggcctggggggtccctgagactctcctgtgcagcctctggactaatctttagtaaatacgccatgatctgggtccgccaggctccgagggaaggggctggagtgggtctcagccatttccggcaagtggtggtggcacacactacgcagactccgtgaagggccgttcaccgtctccagagacaattccgaggacactctctatctggaaatgaatgcctgagacgccgacgacacggccatactatttatgtagaccgaaaacgacccccaagggtcgaacccacgtagttcgggagttctttttcgacctttcgtcggggaccaaaggggacctaaacgggtccaacccggttctccgttaccacgcccctaccgaaccgaaacgggcccacgtccgtcccttcccccgnggcccnccctgccctccgaggccaccacccgtcgacgacgccaacgcgccggcccgtgggctcggccgtgaccgaaggtaccttacttccacgttagcgaccgtactggacggcgggctcgggaccaagggccacgtagng

SEQ ID NO: 308615 - DNA, 481 bp, Homo sapiens
  misc_feature: GZ8MTXP01DYMF6.44.34.D01.1.454.CMB.2.raw
  modified_base (200)..(200): a, c, t, g, unknown or other
  misc_feature (200)..(200): n is a, c, g, or t
  modified_base (327)..(327): a, c, t, g, unknown or other
  misc_feature (327)..(327): n is a, c, g, or t
  modified_base (354)..(354): a, c, t, g, unknown or other
  misc_feature (354)..(354): n is a, c, g, or t
  modified_base (390)..(390): a, c, t, g, unknown or other
  misc_feature (390)..(390): n is a, c, g, or t
  modified_base (417)..(417): a, c, t, g, unknown or other
  misc_feature (417)..(417): n is a, c, g, or t
  modified_base (423)..(423): a, c, t, g, unknown or other
  misc_feature (423)..(423): n is a, c, g, or t
  modified_base (462)..(462): a, c, t, g, unknown or other
  misc_feature (462)..(462): n is a, c, g, or t
tcagacagtatatacacgaccggtgctcgatttagatcgtctgtgttgggtttggggcagaagtctctctcagtcaggacacagcatggacatgagggtccctgctcagctcctgggactcctgctgctctggctcccagatactagatgtgacttccagatgacccagtctccatcctccctgtctgcatctgtggganacagagtcaccatcacttgccggcagtcaggccattagcaatattagcctggtatcagcagaaaccagggaaacctctaactcctgatctttgctgcatcacttgcaatcagggtccatctcgttcngcgcagtgatcgtgggacagtatttcnctctcacatcagcagcctgcagcctagaagatgttnctaacttattactgtacaaagtacaanaagtcnccctcactactttcgcccgttgggaccaagtcgaattanacaaacgtaacttgtaacg

SEQ ID NO: 308616 - DNA, 507 bp, Homo sapiens
  misc_feature: GZ8MTXP01EV57Z.44.34.D01.1.454.CMB.2.raw
  modified_base (332)..(332): a, c, t, g, unknown or other
  misc_feature (332)..(332): n is a, c, g, or t
  modified_base (345)..(345): a, c, t, g, unknown or other
  misc_feature (345)..(345): n is a, c, g, or t
  modified_base (399)..(399): a, c, t, g, unknown or other
  misc_feature (399)..(399): n is a, c, g, or t
  modified_base (433)..(433): a, c, t, g, unknown or other
  misc_feature (433)..(433): n is a, c, g, or t
tcagacagtatatacacgaccggtgctcgatttagatcgtctgtgttgggtttgggggcagaagtctctctcagtcaggacacagcatggacatgagggtccctgctcagctcctgggactcctgctgctctggctcccagatactagatgtgacttccagatgacccagtctccatcctccctgtctgcatctgtgggagacagagtcaccatcacttgccgggcgagtcaggccattagcaatattagcctgtatcagcagaaccaggaaacctcctaactcctgatctttgctgcatccatttgcaactcagggtcccatctcggttcngcggcagtgatcngggacagtattctctctcaccatcagcagccctgcagccgtagaagtatggttnactaacttatactgtacaaaagtacaacaagtcncccctacactacgtttcccggaccgttcgggaaccctaaaggtggtaactaatacaaaacgtaacgttggtcgg

SEQ ID NO: 308617 - DNA, 548 bp, Homo sapiens
  misc_feature: GZ8MTXP01EM0QU.44.34.D01.1.454.CMB.2.raw
  modified_base (201)..(201): a, c, t, g, unknown or other
  misc_feature (201)..(201): n is a, c, g, or t
  modified_base (226)..(226): a, c, t, g, unknown or other
  misc_feature (226)..(226): n is a, c, g, or t
  modified_base (340)..(340): a, c, t, g, unknown or other
  misc_feature (340)..(340): n is a, c, g, or t
  modified_base (403)..(403): a, c, t, g, unknown or other
  misc_feature (403)..(403): n is a, c, g, or t
  modified_base (411)..(411): a, c, t, g, unknown or other
  misc_feature (411)..(411): n is a, c, g, or t
tcagacagtatatacacgaccggtgctcgatttagatcgtctgtgttgggtttgggggcagaagtctctctcagtcaggacacagcatggacatgagggtccctgctcagctcctgggactcctgctgctctggctcccagatactagatgtgacttccagatgacccagtctccatcctccctgtctgcatctgtggganacagagtcaccatcacttgccgggnagtcaggccattagcaatattagcctggtatcagcaagaaaccagggaaacctcctaactcctgatcttgctgcatccactttgacaactcgacggggtcccatcctcggttcngcggcagtgatcgtagggacagtatttctctctcacatcagcagcctgacagcctaggaagtnttacggtntactaactttattacgtataactaaaagtacaaacgtaacgtcttacccctacttaaccgtaccgtttcccgggacccgttcgggaaaccctaaaggtacggtaactacgtaccaaaacgtaaccgttggtaaccgg

SEQ ID NO: 308618 - DNA, 529 bp, Homo sapiens
  misc_feature: GZ8MTXP01BYC29.44.34.D01.1.454.CMB.2.raw
  modified_base (332)..(332): a, c, t, g, unknown or other
  misc_feature (332)..(332): n is a, c, g, or t
  modified_base (396)..(396): a, c, t, g, unknown or other
  misc_feature (396)..(396): n is a, c, g, or t
  modified_base (446)..(446): a, c, t, g, unknown or other
  misc_feature (446)..(446): n is a, c, g, or t
tcagacagtatatacacgaccggtgctcgatttagatcgtctgtgttgggtttgggggcagaagtctctctcagtcaggacacagcatggacatgagggtccctgctcagctcctgggactcctgctgctctggctcccagatactagatgtgacttccagatgacccagtctccatcctccctgtctgcatctgtgggagacagagtcaccatcacttgccgggcagtcaggccattagcaatattagcctggtatcagcaagaaaccagggaaacctcctaacctcctgatctttgctgcatccatttgcaatcagggtcccatctcgtngcggcagtggatcgtgggacagtattctctctcacatcagcagccctgcacgccgtagaaagtntgttagactaacttattaacctgtaacaaaacgttacaaactaaggtccncccctacactaccgttccgggacccgttggggaaccctaaaggtggaacttaacgtacgttaaacgtaaacgttcggtaacgg

SEQ ID NO: 308619 - DNA, 532 bp, Homo sapiens
  misc_feature: GZ8MTXP01C38VC.44.34.D01.1.454.CMB.2.raw
tcagacagtatatacacgaccggtgctcgatttagatcgtctgtgttgggtttgggggcagaagtctctctcagtcaggacacagcatggacatgagggtccctgctcagctcctgggactcctgctgctctggctccagatactagatgtgacttccagatgacccagtctccatcctccctgtctgcatctgtgggagacagagtcaccatcacttgccggcgagtcaggccattagcaatattagcctggtatcagcagaaccaggaaacctctaacctctgatcttgctgcatccacttgctaactcaggggtcccatctacggttcaagcggcaggtggatcgtgggactagtatttctctctcacatcagcagcctgcagccgtgaagtatgttagactaacctttattacctagtacaaaagtaccaaacgaagtaccgccccttacaccgtacgtttccggacccgttcgggaaccctaaaagtcgggaacttaacgacttaaaacgtaaccgttaagtccggg

SEQ ID NO: 308620 - DNA, 581 bp, Homo sapiens
  misc_feature: GZ8MTXP01CVVWE.44.34.D01.1.454.CMB.2.raw
  modified_base (202)..(202): a, c, t, g, unknown or other
  misc_feature (202)..(202): n is a, c, g, or t
  modified_base (229)..(229): a, c, t, g, unknown or other
  misc_feature (229)..(229): n is a, c, g, or t
  modified_base (348)..(348): a, c, t, g, unknown or other
  misc_feature (348)..(348): n is a, c, g, or t
tcagacagtatatacacgaccggtgctcgatttagatcgtctgtgttgggtttgggggcagaagtctctctcagtcaggacacagcatggacatgagggtccctgctcagctcctgggactcctgctgctctggctcccagatactagatgtgacttccagatgacccagtctccatcctccctgtctgcatctggtggganacagagtcaccatcacgttggccgggnagtcaggccattagctaatattagctggtatcagcaagaaaccacggaaacctcctaaacctcctagtatctttgcttgctatccactttgctaactcgagggtcccatcgtacgttcnggtcgcaggtgatcgtagggactagtattctctctcacatcagcacgcctcgacacgacgtacgtaagtagtagttacgtactaaacttaacttaacttacgtaactaaaacgtaaactaaactaacggtaccgttaccctaccttaccgttaccgttaccggttacccgttaccggttaaccgtaaacgtacggtaacgtaacttaacgaaacgtaacgttaacgttaacgg

SEQ ID NO: 308621 - DNA, 576 bp, Homo sapiens
  misc_feature: GZ8MTXP01BA039.44.34.D01.1.454.CMB.2.raw
  modified_base (201)..(201): a, c, t, g, unknown or other
  misc_feature (201)..(201): n is a, c, g, or t
tcagacagtatatacacgaccggtgctcgatttagatcgtctgtgttgggtttgggggcagaagtctctctcagtcaggacacagcatggacatgagggtccctgctcagctcctgggactcctgctgctctggctcccagatactagatgtgacttccagatgacccagtctccatcctccctgtctgcatctgtggganacagagtcaccatcacttgccgggcgagtcaggccattagctaatattagcctggtatcagacaagaaaccaggaaaccctcctaacctcctgatctttgctgcactcctactttgactaactcgacggggtcccatccgtcgggttcaacggcggacgaggtggacttcggtgggtactagttatttctctctcactactcagcacgcctgctagccgtagtaagtagttgtacgtacttaaactttattaacgtagtaacaaaagtaccaagtaacggttccaccctacgttacctaccggttttccggaccccgttaggggaaccctaagggtcggtaactaactaccgaaaacgtaacgttcggtaaccgg

SEQ ID NO: 308622 - DNA, 484 bp, Homo sapiens
  misc_feature: GZ8MTXP01D0GQE.44.34.D01.1.454.CMB.2.raw
  modified_base (201)..(201): a, c, t, g, unknown or other
  misc_feature (201)..(201): n is a, c, g, or t
  modified_base (338)..(338): a, c, t, g, unknown or other
  misc_feature (338)..(338): n is a, c, g, or t
  modified_base (396)..(396): a, c, t, g, unknown or other
  misc_feature (396)..(396): n is a, c, g, or t
  modified_base (434)..(434): a, c, t, g, unknown or other
  misc_feature (434)..(434): n is a, c, g, or t
  modified_base (439)..(439): a, c, t, g, unknown or other
  misc_feature (439)..(439): n is a, c, g, or t
  modified_base (466)..(466): a, c, t, g, unknown or other
  misc_feature (466)..(466): n is a, c, g, or t
tcagacagtatatacacgaccggtgctcgatttagatcgtctgtgttgggtttgggggcagaagtctctctcagtcaggacacagcatggacatgagggtccctgctcagctcctgggactcctgctgctctggctcccagatactagatgtgacttccagatgacccagtctccatcctccctgtctgcatctgtggganacagagtcaccatcacttgccgggcgagtcaggccattagcaatattagcctggtatcagcagaaaccagggaaacctcctaaacctcctgatctttgctgcatccactttgcaactcaggggtcccatctcgttcngcgcagtggatcgtgggacagtattctctactcacatcagcagcctgcagcctgaagntgtgactacttattactgtaacaaagtacactaagtcnccctnactacttcgccttggaccaagtgaatnacaactaacgttgtaacg

SEQ ID NO: 308623 - DNA, 484 bp, Homo sapiens
  misc_feature: GZ8MTXP01BYBZ9.44.34.D01.1.454.CMB.2.raw
  modified_base (333)..(333): a, c, t, g, unknown or other
  misc_feature (333)..(333): n is a, c, g, or t
  modified_base (422)..(422): a, c, t, g, unknown or other
  misc_feature (422)..(422): n is a, c, g, or t
tcagacagtatatacacgaccggtgctcgatttagatcgtctgtgttgggtttggggcagaagtctctctcagtcaggacacagcatggacatgagggtccctgctcagctcctgggactcctgctgctctggctcccagatactagatgtgacttccagatgacccagtctccatcctccctgtctgcatctgtgggagacagagtcaccatcacttgccggcgagtcaggccattagcaatattagcctggtatcagcagaaaccagggaaacctcctaacctcctgatcttgctgcatccactttgcaatcaggggtcccatctcgttcngcgcagtggatctgggacagattctctctcaccatcagcagcctgcagcctgaagtatgttgcaacttattactgtacaaaagtacaanaagtgccctcacactttcggcccttgggaccaaagtggaatatcaaacgtaacttgtaacgg

SEQ ID NO: 308624 - DNA, 553 bp, Homo sapiens
  misc_feature: GZ8MTXP01EJXXA.44.34.D01.1.454.CMB.2.raw
  modified_base (201)..(201): a, c, t, g, unknown or other
  misc_feature (201)..(201): n is a, c, g, or t
  modified_base (226)..(226): a, c, t, g, unknown or other
  misc_feature (226)..(226): n is a, c, g, or t
  modified_base (343)..(343): a, c, t, g, unknown or other
  misc_feature (343)..(343): n is a, c, g, or t
  modified_base (479)..(479): a, c, t, g, unknown or other
  misc_feature (479)..(479): n is a, c, g, or t
tcagacagtatatacacgaccggtgctcgatttagatcgtctgtgttgggtttgggggcagaagtctctctcagtcaggacacagcatggacatgagggtccctgctcagctcctgggactcctgctgctctggctcccagatactagatgtgacttccagatgacccagtctccatcctccctgtctgcatctgtggganacagagtcacatcacgttgccgggngagtcaggccattagctaatattagcctggtatcagcaagaaaccaaggaaacctcctaacctctagtactctttgcttgcatccattgctaactcgacgggtcccatcgtcgttcnggcggcgagtggatcgtagggactagtatttctctctccactactcagcacggcctagacgtacgaccggtagtaaacgtattggttactactaaacctttattacctaggtaaactaaaagtacaacgaacgtcncccctacacgtacccgtttcggacccgttacgggaacctaaaggtcgaattacgacaaacgtaacgttgtaacg

SEQ ID NO: 308625 - DNA, 647 bp, Homo sapiens
  misc_feature: GZ8MTXP01BGY9V.44.34.D01.1.454.CMB.2.raw
  modified_base (201)..(201): a, c, t, g, unknown or other
  misc_feature (201)..(201): n is a, c, g, or t
tcagacagtatatacacgaccggtgctcgatttagatcgtctgtgttgggtttgggggcagaagtctctctcagtcaggacacagcatggacatgagggtccctgctcagctcctgggactcctgctgctctggctcccagatactagatgtgacttccagatgacccagtctccatcctccctgtctgcatctgtggganacagatcacatcacttggccgggcagtcaggccattagactaattattagcctggtatcagcaacgaaaccaggaaaccctcctaacctcctgtacttctttcgctcgctactcctactttgactaacgtccgtacggggttccctacgttccgtccgggttacgaacgggccgggtaccgtagggttcgggtaacgttccgggtagggggtaacctaggttacttttcctccttcctacctaccctacgtcaacgtcgacgtcctcgacgtacggacctaggtaagtacgttagttacgtaccttaaacgtttacttaaccgtagtaaaccgtaaaacgtaccaaacgtaaccgtccgttacccctacttaccgtaccgttccggacccgttacgggaacctaaggtacggtaactaacgtacgaaacgtaacgttcgtaaccgg

SEQ ID NO: 308626 - DNA, 620 bp, Homo sapiens
  misc_feature: GZ8MTXP01BXDU8.44.34.D01.1.454.CMB.2.raw
  modified_base (203)..(203): a, c, t, g, unknown or other
  misc_feature (203)..(203): n is a, c, g, or t
  modified_base (523)..(523): a, c, t, g, unknown or other
  misc_feature (523)..(523): n is a, c, g, or t
tcagacagtatatacacgaccggtgctcgatttagatcgtctgtgttgggtttgggggcagaagtctctctcagtcaggacacagcatggacatgagggtccctgctcagctcctgggactcctgctgctctggctcccagatactagatgtgacttccagatgacccagtctccactcctccctgtctgcatcgtgtggganacagatcaccatcactcggccgggcagtcaggccattagactaatattagccttggtatcagacaagaaaccgaggaaaccctcctaactcctagtactcttgctgtcactcctattgactaacgtcgacggtccctatcgtacgttcgaaggcgtactaggtgtactcggtagggacctagttctttctactcctaccaactacgtacacgcgaccgtccgtacgacgtacgaccggtaagtaagtagtttacggttactaaccttaaactttactaaccttagtaaaccctaaaaagtaccaaacgtaacggtacccnccccgttacaccgttaccggttacccggttaccgttacgggttaaaccgtaaaggtacgaaattaaccgtaacgttaaaccgtaacgttgtaaccgg

SEQ ID NO: 308627 - DNA, 647 bp, Homo sapiens
  misc_feature: GZ8MTXP01EH4FX.44.34.D01.1.454.CMB.2.raw
tcagacagtatatacacgaccggtgctcgatttagatcgtctgtgttgggtttgggggcagaagtctctctcagtcaggacacagcatggacatgagggtccctgctcagctcctgggactcctgctgctctggctcccagatactagatgtgacttccagatgacccagtctccatcctccctgtctgcatctgtgggagacagagtcaccatcacgttgccgggcgagtcaggccattagactaattattagcctggtatcgagacaagaaaccgaaggaaaccctcctaacctcctagtattctttgctgcattcctacttgactactcgtacgggtcccagttccgtacggttcaacggcggtcgtagggttcggaacgttcggtaggggtaactagttacttttcctcgttcctaccaacctaactccgaacgccgaacgtccctacgacgacgtaccgtaaggaacgttagttacgttacgaaccttaaacttttacgttaaccgttaacgtaaactaaaacgttaccaaacgtaacgtcccgttacccctaacgttaccgttaccgtttcccgggacccgttaacggggaaacctaaagggtcgtaattaaccgaacgaaacgttaaccgttggtaaccg

SEQ ID NO: 308628 - DNA, 551 bp, Homo sapiens
  misc_feature: GZ8MTXP01BGG16.44.34.D01.1.454.CMB.2.raw
tcagacagtatatacacgaccggtgctcgatttagatcgtctgtgttgggtttgggggcagaagtctctctcagtcaggacacagcatggacatgagggtccctgctcagctcctgggactcctgctgctctggctcccagatactagatgtgacttccagatgacccagtctccatccctccctgtctgcatctggtgggagacagagtcaccatcacttggccgggcgagtcaggccattagcaatatttagcctggtatcagcagaaaccagggaaacctcctaactctgatctttgctgcatcctactttgactaacgtccgtacgggggtcccagttccgtacgggttcaacggcgggccaggtgggacgttcgtagggactagtactttctctctcacctatcagcacgcctgcagccgtagaagtatgttagactaactttataactgtaaacaaagtacaagtaactcgcccctacaccgtcgtttcccggcccgttaggacccgtaaagtgtaactactacgaaacgtaagttcgtaaccgg

SEQ ID NO: 308629 - DNA, 626 bp, Homo sapiens
  misc_feature: GZ8MTXP01AULA8.44.34.D01.1.454.CMB.2.raw
  modified_base (387)..(387): a, c, t, g, unknown or other
  misc_feature (387)..(387): n is a, c, g, or t
tcagacagtatatacacgaccggtgctcgatttagatcgtctgtgttgggtttgggggcagaagtctctctcagtcaggacacagcatggacatgagggtccctgctcagctcctgggactcctgctgctctggctcccagatactagatgtgacttccagatgacccagtctccatccctccctgtctgcatcgtggtgggacacagacgtccacatcacgttcggccgggcgagtcgacggcctaagttacgactaattattacgccgttaggtactacgagacaaacgaaaccgaacggtaaaccctcctaacctctacgtacttcttgctgactacttcctacttcgactacgtccgacgggtccctagtccgtacggttacncggcgcgtaggtcggtagtcggtaggtactacgttactttctctactaccactactcgacgtccacgtcctacgcacggtccggtaagtaacgttattacggttactacttaaactttacttaacgtacgtaaactaaactaccaacgtaacgtcccgttaccctacttaccgttaccggtcccggaccgttacggttaaccgtaagtagaactaacgtaacaacgtaagttcgtaacg

SEQ ID NO: 308630 - DNA, 569 bp, Homo sapiens
  misc_feature: GZ8MTXP01BVMXG.44.34.D01.1.454.CMB.2.raw
  modified_base (201)..(201): a, c, t, g, unknown or other
  misc_feature (201)..(201): n is a, c, g, or t
  modified_base (227)..(227): a, c, t, g, unknown or other
  misc_feature (227)..(227): n is a, c, g, or t
  modified_base (382)..(382): a, c, t, g, unknown or other
  misc_feature (382)..(382): n is a, c, g, or t
  modified_base (384)..(384): a, c, t, g, unknown or other
  misc_feature (384)..(384): n is a, c, g, or t
tcagacagtatatacacgaccggtgctcgatttagatcgtctgtgttgggtttgggggcagaagtctctctcagtcaggacacagcatggacatgagggtccctgctcagctcctgggactcctgctgctctggctcccagatactagatgtgacttccagatgacccagtctccatcctccctgtctgcatctgtggganacagagtcaccatcacttggccgggngagtcaggccattagctaatattagctggtatcagacaagaaaccaggaaacctcctaactcctgatctttgctgcatccattgctaatcgaggtcccatctacggtcaagtcgcagtgatcgtagggacagtattcactctcaccatcagcacncncgacacgacgtagaagtaagtagttacgtaactaaacttaacttaacttaacgtaaacgtaaaacgtaaactaaactaacgtaccgttaccctaccttaaccgtaccgttaccggttacccggttaccggttaaccgtaaacgtaacgtaacgtaactaacgttaaacgtaacgttaacgtaacg

SEQ ID NO: 308631 - DNA, 553 bp, Homo sapiens
  misc_feature: GZ8MTXP01EG053.44.34.D01.1.454.CMB.2.raw
  modified_base (201)..(201): a, c, t, g, unknown or other
  misc_feature (201)..(201): n is a, c, g, or t
  modified_base (229)..(229): a, c, t, g, unknown or other
  misc_feature (229)..(229): n is a, c, g, or t
  modified_base (336)..(336): a, c, t, g, unknown or other
  misc_feature (336)..(336): n is a, c, g, or t
tcagacagtatatacacgaccggtgctcgatttagatcgtctgtgttgggtttgggggcagaagtctctctcagtcaggacacagcatggacatgagggtccctgctcagctcctgggactcctgctgctctggctcccagatactagatgtgacttccagatgacccagtctccatcctccctgtctgcatgtgtggganacagagtcaaccatcacgttggccgggnagtcaggccattagctaatattagcctggtatcagcaagaaaccaggaaaccctcctaaacctctagatcttgctgcatccattgacaactcgaggtccatctcgtngcgcagtgatcgagggacagtattctctctcacatcagcagcctcgcacgaccgtagtaagtagttagttagtactaacttaacttaacttacgtaactaaaacgtaaactaaactaacgtacgttaccctaccttacctaccgttaccgttacccgttaccggttaaccgtaaacgtaggtaacgtaacttaacgaacgtaacgttaagtaaccgg

SEQ ID NO: 308632 - DNA, 543 bp, Homo sapiens
  misc_feature: GZ8MTXP01CZSYH.44.34.D01.1.454.CMB.2.raw
  modified_base (201)..(201): a, c, t, g, unknown or other
  misc_feature (201)..(201): n is a, c, g, or t
  modified_base (261)..(261): a, c, t, g, unknown or other
  misc_feature (261)..(261): n is a, c, g, or t
  modified_base (336)..(336): a, c, t, g, unknown or other
  misc_feature (336)..(336): n is a, c, g, or t
tcagacagtatatacacgaccggtgctcgatttagatcgtctgtgttgggtttgggggcagaagtctctctcagtcaggacacagcatggacatgagggtccctgctcagctcctgggactcctgctgctctggctcccagatactagatgtgacttccagatgacccagtctccatcctccctgtctgcatctgtggganacagagtcaccatcacttggccggcgagtcaggccattagcaatattagcctggtatcancagaaaccacggaaacctcctaacctctgatctttgctgctatccactttgcaactcgagggtccatctcgttcngcgcagtgatcgtgggactagtattcgtctctcaccatcagcacgctgcagccgtgaaagcttgtgactaactttagttactgtaaacaaaacgtaccaaacgtcgtcgacccctcaaccgttaaccgtttcccgggaccccgttaggggaaccctaaaggtacgggtaacttaactaccgttaaaacgtaacgttcggtaaccggg

SEQ ID NO: 308633 - DNA, 806 bp, Homo sapiens
  misc_feature: GZ8MTXP01DC2M4.44.34.D01.1.454.CMB.2.raw
  modified_base (202)..(202): a, c, t, g, unknown or other
  misc_feature (202)..(202): n is a, c, g, or t
  modified_base (287)..(287): a, c, t, g, unknown or other
  misc_feature (287)..(287): n is a, c, g, or t
tcagacagtatatacacgaccggtgctcgatttagatcgtctgtgttgggtttgggggcagaagtctctctcagtcaggacacagcatggacatgagggtccctgctcagctcctgggactcctgctgctctggctcccagatactagatgtgacttccagatcgacccagtctccatcctccctgtctgcatctgtggganacagagtcaccatcacttgccgggcgagtcaggccattagctaatattagcctggtatcagcagaaccaggaaacctcctaaccncctagatctttgctgcatcctactttgacctaagtccgtacgggggttacccctaagttcccgttaaccgggtttcgaacgggccgggtacccgtagggttgggaacttcggttagggggtaacctagggttaacttttccgttacttcccttaccctaaacccgtaaacttccgtaacgtacccgaacgggtaccccttcggtaccgaaaccggttccccgggttaaacgggttaaacggtaaacggtttggtttacggtaacccgttaaaacccgtttttaaagtttaaaccctttaaggttaaaccggtaaaaaaaaccgttaccctaaaaaccggtaaaaccggttcccggttaccccccgtttaacccttaaacccgtttaaacccgggttttccccggggttaacccccggttacgggggttaaaaccccgttaaaaggggttaaccgggtaaactttaaaccgtaaaccggttaaaaacccgggtaaccgtttaacggggtttaacccgggg

SEQ ID NO: 308634 - DNA, 610 bp, Homo sapiens
  misc_feature: GZ8MTXP01EZ4RU.44.34.D01.1.454.CMB.2.raw
  modified_base (201)..(201): a, c, t, g, unknown or other
  misc_feature (201)..(201): n is a, c, g, or t
  modified_base (228)..(228): a, c, t, g, unknown or other
  misc_feature (228)..(228): n is a, c, g, or t
  modified_base (400)..(400): a, c, t, g, unknown or other
  misc_feature (400)..(400): n is a, c, g, or t
  modified_base (442)..(442): a, c, t, g, unknown or other
  misc_feature (442)..(442): n is a, c, g, or t
tcagacagtatatacacgaccggtgctcgatttagatcgtctgtgttgggtttgggggcagaagtctctctcagtcaggacacagcatggacatgagggtccctgctcagctcctgggactcctgctgctctggctcccagatactagatgtgacttccagatgacccagtctccatcctccctgtctgcatctgtggganacagagtcaccatcacgttcgccgggngagtcaggccattagactaatattagcctggtatcgagacaagaaaccgacgggtaaaccctaccctaacctcctagtacttcgtttgctgctacttcctactttcgactaacgtccgtacggggtccctagtcgtcgttcaagtcgcaggtgatcgtgggactagtcttcnctctacactatcagcacgcctgacgacgtccgtagtaaggtnttacggttacaaccttaactttaacttaaccttacggtaaacctaaaaacggtacctaaacgtaaccggtacccgttacccctacttacccgttaccgtttccccggaccgttacggaaaccgtaaggtacggtaacttaacgacgaaaccgtaacgttcggtaaccg

SEQ ID NO: 308635 - DNA, 650 bp, Homo sapiens
  misc_feature: GZ8MTXP01EGWJ8.44.34.D01.1.454.CMB.2.raw
  modified_base (202)..(202): a, c, t, g, unknown or other
  misc_feature (202)..(202): n is a, c, g, or t
  modified_base (230)..(230): a, c, t, g, unknown or other
  misc_feature (230)..(230): n is a, c, g, or t
  modified_base (467)..(467): a, c, t, g, unknown or other
  misc_feature (467)..(467): n is a, c, g, or t
  modified_base (477)..(477): a, c, t, g, unknown or other
  misc_feature (477)..(477): n is a, c, g, or t
tcagacagtatatacacgaccggtgctcgatttagatcgtctgtgttgggtttgggggcagaagtctctctcagtcaggacacagcatggacatgagggtccctgctcagctcctgggactcctgctgctctggctcccagatactagatgtgacttccagatgacccagtctccatcctccctgtctgcatctggtggganacagacgtcaccatcacgttggccgggnagtcaggccattagactaattattagcctaggtatcagacaagaaaccaggaaaccctcctaacctctgactctttgctgctatcctattgctaaacgtcgtaacggggtccctagttccgtacgggttacaacgggcggtcgtaagggtggtacgtcggtaggggtaacctagttactttctctcctacacctaactcaaggtccacggcctagacgacgtccggtaagaaacgtnttacggttanaccttaaacttattaaacgtaacgtaaacgtaaaaaacgttaccaaacgtaacggtccgacccccttaacgttaaccgttacccgttacccgggttacccggttaaccgggaaaccctaaaaggtttaccggaaattacgtaaaccgaaaacggttaacttcggggtaaccgg

SEQ ID NO: 308636 - DNA, 630 bp, Homo sapiens
  misc_feature: GZ8MTXP01D4EOA.44.34.D01.1.454.CMB.2.raw
  modified_base (205)..(205): a, c, t, g, unknown or other
  misc_feature (205)..(205): n is a, c, g, or t
tcagacagtatatacacgaccggtgctcgatttagatcgtctgtgttgggtttgggggcagaagtctctctcagtcaggacacagcatggacatgagggtccctgctcagctcctgggactcctgctgctctggctcccagatactagatgtgacttccagatgacccagtcctccatccctccctgtctgcatcgtggtggganacagacgtcaccatcacgttcggccgggcgagtcgaggccattagactaattattgcctggtatcgagacaacgaaaccgaacggtaaaccctaccgtaaacctctagtacttctttacgctcgctacttaccctactttagactacgtccgtacggggtccctagttcccgtacggttacgaacggcgggtccgtagggttcggaacgttcggtaggggaccttagttactttccctctactccaacctacgtacacgaccagcccgtcgacacgtacgtagaacggttattagttacgacttaaacttattaccgtataaaccaaacgttacaagtaaccgtacttccctacgaccgttacgtaccggaccgttacgggaaccaaggttacgaacttactaacgaactaaccgttgtaaccgg

SEQ ID NO: 308637 - DNA, 666 bp, Homo sapiens
  misc_feature: GZ8MTXP01C0P6A.44.34.D01.1.454.CMB.2.raw
  modified_base (190)..(190): a, c, t, g, unknown or other
  misc_feature (190)..(190): n is a, c, g, or t
  modified_base (422)..(422): a, c, t, g, unknown or other
  misc_feature (422)..(422): n is a, c, g, or t
  modified_base (498)..(498): a, c, t, g, unknown or other
  misc_feature (498)..(498): n is a, c, g, or t
tcagacagtatatacacgaccggtgctcgatttagatcgtctgtgttgggtttgggggcagaagtctctctcagtcaggacacagcatggacatgagggtccctgctcagctcctgggactcctgctgctctggctccagatactagatgtgacttccagatcgacccagtctccactccctccctgtcngctatcgtggtgggagacgagtacgtcaacctatcctaccggttggcccgggagacgtcgacggacctaattacgactaattacgttagccgttaggtatacgagaaccgaaagaaacccgaaacgggtaaacccctaccctaaacctccgtagtacttcgttcgctcgacctacttcctacgtttcgacctaaacgtccggtacgggtaccctacttcggttaccgttacncgggtcgacgtagggtcggtaactcggtaggacttacgttacttctctactacctacagtcacgccgacgttccgntaccgacgtcgtaagtaaggttcttaggtactaaccttaaactttagtaacgtaagtaaaactaaacgtaactaacgtaacgtcccttacccttacaaccgtttccggttaccgacccgttaggaaacctaagtacgtaactacgtaacgaaacgtcgttcgtaaccg

SEQ ID NO: 308638 - DNA, 551 bp, Homo sapiens
  misc_feature: GZ8MTXP01E08WO.44.34.D01.1.454.CMB.2.raw
  modified_base (226)..(226): a, c, t, g, unknown or other
  misc_feature (226)..(226): n is a, c, g, or t
  modified_base (339)..(339): a, c, t, g, unknown or other
  misc_feature (339)..(339): n is a, c, g, or t
  modified_base (393)..(393): a, c, t, g, unknown or other
  misc_feature (393)..(393): n is a, c, g, or t
tcagacagtatatacacgaccggtgctcgatttagatcgtctgtgttgggtttgggggcagaagtctctctcagtcaggacacagcatggacatgagggtccctgctcagctcctgggactcctgctgctctggctcccagatactagatgtgacttccagatcgacccagtctccatcctccctgtctgcatctggtggagacagatcaccatcacgtgccgggngagtcaggccattagactaatattagcctggtatcagcaagaaaccaggaaacctcctaactcctgattcttgctgctatccgattgctaactcgagggtccatctcggttcngcgcagtggatcgagggactagtactttctctctaccactactcgagcacgtcncgcacgccgtagaagtagtagttactactaacttaacttactacgtaactaaaactaacaactaacggtacgttaccctaccttacctaccgttaccggttacccggttcggttaaccgtaagtaggtaagtaactaacaacgtaaccgttaagtcgg

SEQ ID NO: 308639 - DNA, 768 bp, Homo sapiens
  misc_feature: GZ8MTXP01EULYV.44.34.D01.1.454.CMB.2.raw
  modified_base (634)..(634): a, c, t, g, unknown or other
  misc_feature (634)..(634): n is a, c, g, or t
tcagacagtatatacacgaccggtgctcgatttagatcgtctgtgttgggtttgggggcagaagtctctctcagtcaggacacagcatggacatgagggtccctgctcagctcctgggactcctgctgctctggctcccagatactagatgtgacttccagatgacccagtctccatccctccctgtctgcatctggtggagacagagtcacatcacgtggccgggcgagtcgaggtccattagactaattattagcgtggtatcagacgaacgaaaccgacggtaaaccctcccgtaacctcctagtaacttcgtttcgcctagcctacttcccgtaactttcgacctaacgtccggtaacgggggtcccctaacttcccgtaccgggtttacgaacgggtcgggaccgtaggggtacgtacggttacggtacgggggtaactaggtttactttcttcctaccttacccaacttacgtaccaacgccgtaacgtcccgtcgaccgtaacgtcccggttaaaggaaaggttagttacggttaaccgtaacctttaaaacgttttaacggtttaaacctaaacggtttaaaaccaaaaaacggtttaaacccgaaactaaccgggttaacccccnccccgtttaaccgttaaccccgtttaaccccggtttaccgggaccccggttaaaacgggttaccccgttaaaagggttagggtaaacctttaaacgtaaaccgttaaaaccgtaaccgtttaacgggtaaccgg

SEQ ID NO: 308640 - DNA, 760 bp, Homo sapiens
  misc_feature: GZ8MTXP01BL9TM.44.34.D01.1.454.CMB.2.raw
  modified_base (187)..(187): a, c, t, g, unknown or other
  misc_feature (187)..(187): n is a, c, g, or t
  modified_base (198)..(198): a, c, t, g, unknown or other
  misc_feature (198)..(198): n is a, c, g, or t
tcagacagtatatacacgaccggtgctcgatttagatcgtctgtgttgggtttgggggcagaagtctctctcagtcaggacacagcatggacatgagggtccctgctcagctcctgggactcctgctgctctggctccagatactagatgtgacttccagatgacccagtctccatcctcctgtctncatctgtgganacagagtccaccatcacgttcggccgggcgacgtcgaggtcctattacgacttaaattgttaacgccgttaggtactcgaacgaccgtaaacgaaacccgaaacgggtaaacccctacccctaaaccgttcccgtagtacttctttagccttagcctactcctacgtttagaccaaacgttcccggtaacggggtccctaacgtttccggttaacccgggtttaccgaacgggtaccgggtaacgtacggggttacggtacgttaccggggtaacggggtaaactaacgttttccttttaccgtcccgttaccgtttacccaacccttaacgttaccggaaccgtacccgtaccgccgtacggaccgtaccggtacggggttaaagtacgttacgttacgttaaccgtaacctttaaacgtttacttaaaccgttaacgtaaaccgtaaacgtacgaaaccgtccgttacccgttacccgtacgttaaccgtacccgttccggaccgttaccggaacgtaagggtactaacgtaacgtaaccgacgttaacgttcggtaacg

SEQ ID NO: 308641 - DNA, 483 bp, Homo sapiens
  misc_feature: GZ8MTXP02IJ4RC.44.34.D01.1.454.CMB.2.raw
  modified_base (331)..(331): a, c, t, g, unknown or other
  misc_feature (331)..(331): n is a, c, g, or t
tcagacagtatatacacgaccggtgctcgatttagatcgtctgtgttgggtttggggcagaagtctctctcagtcaggacacagcatggacatgagggtccctgctcagctcctgggactcctgctgctctggctcccagatactagatgtgacttccagatgacccagtctccatcctccctgtctgcatctgtgggagacagagtcaccatcacttgccgggcagtcaggccattagcaattattagcctggtatcagcagaaaccaggaaacctcctaacctcctgatcttgctgcatccactttgcatcagggtcccatctcgttcngcgcagtgatcgtgggacagtattctctctcacatcagcagctgcagcctgagtatttgactaacttattactgtcagtctagtttaatacttacctctctacgttacggcgtaacggacaaggtgagacgtacgaaacgacgtcgtggacg

SEQ ID NO: 308642 - DNA, 478 bp, Homo sapiens
  misc_feature: GZ8MTXP02F7PLQ.44.34.D01.1.454.CMB.2.raw
  modified_base (331)..(331): a, c, t, g, unknown or other
  misc_feature (331)..(331): n is a, c, g, or t
  modified_base (357)..(357): a, c, t, g, unknown or other
  misc_feature (357)..(357): n is a, c, g, or t
  modified_base (387)..(387): a, c, t, g, unknown or other
  misc_feature (387)..(387): n is a, c, g, or t
tcagacagtatatacacgaccggtgctcgatttagatcgtctgtgttgggtttgggggcagaagtctctctcagtcaggacacagcatggacatgagggtccctgctcagctcctgggactcctgctgctctggctcccagatactagatgtgacttccagatgacccagtctccatcctccctgtctgcatctgtgggagacagagtcaccatcacttgccggcagtcaggccattagcaatatttagcctggtatcagcagaaaccaggaaacctcctaacctcctgatctttgctgcatccatttgcaatcagggtccatctcgttcngcgcagtgatcgtgggacagatttcnctctcacatcagcagcctgcagcctagaantgttgactattattactagtacaaaagtacaacagtcaccctcactacttcgacctggaaccaaagtcgaatactacaaacgtactgtacg

SEQ ID NO: 308643 - DNA, 495 bp, Homo sapiens
  misc_feature: GZ8MTXP02G7K9A.44.34.D01.1.454.CMB.2.raw
  modified_base (337)..(337): a, c, t, g, unknown or other
  misc_feature (337)..(337): n is a, c, g, or t
tcagacagtatatacacgaccggtgctcgatttagatcgtctgtgttgggtttggggcagaagtctctctcagtcaggacacagcatggacatgagggtccctgctcagctcctgggactcctgctgctctggctcccagatactagatgtgacttccagatgacccagtctccatcctccctgtctgcatctgtgggagacagagtcaccatcacttgccgggcagtcaggccattagcaattatttagcctggtatcagcagaaaccagggaaacctcctaacctcctgatctttgctgcatccactttgcaatcaggggtcccatctcggttcngcgcagtgatctgggacagtatttctctctcaccatcagcagcctgcagcctgagatgtgcaacttattactgtacaaaagtacaaacacgtcgcccctacaccactttccggacccttgggaacccaaagtcggatactacaaacgactacgtacgg

SEQ ID NO: 308644 - DNA, 515 bp, Homo sapiens
  misc_feature: GZ8MTXP02GDWOH.44.34.D01.1.454.CMB.2.raw
  modified_base (339)..(339): a, c, t, g, unknown or other
  misc_feature (339)..(339): n is a, c, g, or t
  modified_base (399)..(399): a, c, t, g, unknown or other
  misc_feature (399)..(399): n is a, c, g, or t
tcagacagtatatacacgaccggtgctcgatttagatcgtctgtgttgggtttggggcagaagtctctctcagtcaggacacagcatggacatgagggtccctgctcagctcctgggactcctgctgctctggctcccagatactagatgtgacttccagatgacccagtctccatcctccctgtctgcatctgtgggagacagagtcaccatcacttgccgggcgagtcaggccattagcaattatttagcctggtatcagcaagaaaccagggaaacctcctaacctcctgatctttgctgcatccactttgcaatcacggggtccatctcggttcnggcgcagtgatctgggacagtatttctctctcaccatcagcagcctgcagcctagaagtntgttgactaaacttattactagtacaaaagtacaaactacgtcgaccctcactacgtttccggacccgtaggaaccctaaagtcggtaatactaccgaaaacgtacgtacgtacgg

SEQ ID NO: 308645 - DNA, 506 bp, Homo sapiens
  misc_feature: GZ8MTXP02JIE7U.44.34.D01.1.454.CMB.2.raw
  modified_base (226)..(226): a, c, t, g, unknown or other
  misc_feature (226)..(226): n is a, c, g, or t
  modified_base (400)..(400): a, c, t, g, unknown or other
  misc_feature (400)..(400): n is a, c, g, or t
  modified_base (407)..(407): a, c, t, g, unknown or other
  misc_feature (407)..(407): n is a, c, g, or t
tcagacagtatatacacgaccggtgctcgatttagatcgtctgtgttgggtttgggggcagaagtctctctcagtcaggacacagcatggacatgagggtccctgctcagctcctgggactcctgctgctctggctcccagatactagatgtgacttccagatgacccagtctccatcctccctgtctgcatctgtgggagacagagtcaccatcacttgccgggnagtcaggccattagcaattattagcctggtatcagcagaaaccagggaaacctcctaacctctgatcttgctgcatccactttgcaactcgacggggtcccatcgtcgttcagtcggcagtgatcgtgggacagtattctactctcacatccagcagcctgcacgcctagaagntggttanactaacttattactagtacaaagtacaactacgtcgaccctacactactttccgacccgtacggaccaaagtcgactacgtacaaacgtacgtagtacg

SEQ ID NO: 308646 - DNA, 529 bp, Homo sapiens
  misc_feature: GZ8MTXP02F3M7J.44.34.D01.1.454.CMB.2.raw
  modified_base (337)..(337): a, c, t, g, unknown or other
  misc_feature (337)..(337): n is a, c, g, or t
  modified_base (350)..(350): a, c, t, g, unknown or other
  misc_feature (350)..(350): n is a, c, g, or t
tcagacagtatatacacgaccggtgctcgatttagatcgtctgtgttgggtttgggggcagaagtctctctcagtcaggacacagcatggacatgagggtccctgctcagctcctgggactcctgctgctctggctcccagatactagatgtgacttccagatgacccagtctccatcctccctgtctgcatctgtgggagacagagtcaccatcacttgccgggcgagtcaggccattagcaattattagcctggtatcagcagaaaccaggaaacctcctaacctcctgatctttgctgcatccactttgcaatcgaggggtccatctcggttcngcgcagtgatcgngggactagatttctctctcacatcagcagcctagcagcctgaagattgttagactaaactttattactagtacaaaagtacaaactacgtacgcccctactaacctaccgtttcccggacccttacgggggaaccctaaaaggtcggaaacttacgtacgaaaacgtaacgtggtacgg

SEQ ID NO: 308647 - DNA, 510 bp, Homo sapiens
  misc_feature: GZ8MTXP02H7UYQ.44.34.D01.1.454.CMB.2.raw
  modified_base (201)..(201): a, c, t, g, unknown or other
  misc_feature (201)..(201): n is a, c, g, or t
  modified_base (226)..(226): a, c, t, g, unknown or other
  misc_feature (226)..(226): n is a, c, g, or t
  modified_base (336)..(336): a, c, t, g, unknown or other
  misc_feature (336)..(336): n is a, c, g, or t
tcagacagtatatacacgaccggtgctcgatttagatcgtctgtgttgggtttgggggcagaagtctctctcagtcaggacacagcatggacatgagggtccctgctcagctcctgggactcctgctgctctggctcccagatactagatgtgacttccagatgacccagtctccatcctccctgtctgcatctgtggganacagagtcaccatcacttgccgggnagtcaggccattagcaattattagcctggtatcagcagaaaccagggaaacctcctaacctcctgatctttgctgcatccactttgcaatcaggggtcccatctcgttcngcggcagtgatcgtgggacagtattctctctcaccatccagcagcctgtagcctgaaagtatgttgactaacttattactgtaactaaagtacaaacacgtacgcccctacactacgtttccgacccgttacgggaccaaaggtgactaagtacaaaacgaactgtacggtacg

SEQ ID NO: 308648 - DNA, 554 bp, Homo sapiens
  misc_feature: GZ8MTXP02FSHII.44.34.D01.1.454.CMB.2.raw
  modified_base (226)..(226): a, c, t, g, unknown or other
  misc_feature (226)..(226): n is a, c, g, or t
  modified_base (476)..(476): a, c, t, g, unknown or other
  misc_feature (476)..(476): n is a, c, g, or t
tcagacagtatatacacgaccggtgctcgatttagatcgtctgtgttgggtttgggggcagaagtctctctcagtcaggacacagcatggacatgagggtccctgctcagctcctgggactcctgctgctctggctcccagatactagatgtgacttccagatgacccagtctccatcctccctgtctgcatctgtgggagacagagtcaccatcacttggccggngagtcaggccattagctaattattagcctggtatcagcaagaaaccgaggaaacctcctaacctctgatctttgctgctactcctactttgactaactccgacggggtccccattccgtccggttcaggtccggacaggtggattcgtggggactagtatttctctctcaccatcaagcacgcctgcacgcctaggaagattgttagacctaatttattacttagtaactaaaagtacaaactacgtccnccctacacctaccgtttccggacccgttagggaaacccaaagttacggaactactaccgaaaacgtaacgtggtacgg

SEQ ID NO: 308649 - DNA, 625 bp, Homo sapiens
  misc_feature: GZ8MTXP02G94J8.44.34.D01.1.454.CMB.2.raw
  modified_base (201)..(201): a, c, t, g, unknown or other
  misc_feature (201)..(201): n is a, c, g, or t
  modified_base (398)..(398): a, c, t, g, unknown or other
  misc_feature (398)..(398): n is a, c, g, or t
tcagacagtatatacacgaccggtgctcgatttagatcgtctgtgttgggtttgggggcagaagtctctctcagtcaggacacagcatggacatgagggtccctgctcagctcctgggactcctgctgctctggctcccagatactagatgtgacttccagatgacccagtctccatcctccctgtctgcatctggtgganacagagtcaccatcacttggccgggcagtcaggccattagctaattattagcctggtatcagcaagaaaccaggaaacctcctaacctctagattcttgcctgctactcctactttcgactaaccgtcgacgggtcccatttccgtcgttacgacggccgggactagggtagtacgtcgagggactaagtctttccnctacctaccacctatccgacgctagcctgactacgaccttaggaacgtgttagtactaccgttaaatttacttaaccgtgtaaaacgtaaaacgtactaaaccggtacgtacctacccccttactaacccgttaccgtttcccgggaacccgtacggggttaaaaacccgtaagggttaacggaactttaaacgaaacccgtaaaacggtaaccgtcggttacccgg

SEQ ID NO: 308650 - DNA, 667 bp, Homo sapiens
  misc_feature: GZ8MTXP02G8CD1.44.34.D01.1.454.CMB.2.raw
  modified_base (201)..(201): a, c, t, g, unknown or other
  misc_feature (201)..(201): n is a, c, g, or t
  modified_base (228)..(228): a, c, t, g, unknown or other
  misc_feature (228)..(228): n is a, c, g, or t
tcagacagtatatacacgaccggtgctcgatttagatcgtctgtgttgggtttgggggcagaagtctctctcagtcaggacacagcatggacatgagggtccctgctcagctcctgggactcctgctgctctggctcccagatactagatgtgacttccagatgacccagtctccatcctccctgtctgcatctgtggganacagagtcaccatcacgttggccgggngagtcaggccattagactaattattagcctggtatcagcaagaaaccgacggaaacctcctaaacctcctagtacttcttgctgctatcctacttgactaacgtccgacgggtccctattccgtcggttcacggtcgacgtaggtggatcggagggactagtactttctctcctacaccactaccacgtcacgtcctagaccgacgtcctaaggtaagtagtttacggtactaaccttaaacgtttaacgtttaaccgttaacggttaaaacctaaaaacggttaaaccaaaaccggttaccggtaccccgttaccccctaaccgtaaacccgtttaccccggtttacccggggtacccccgttaacggggtaaaacccgtaaaggtaccgtaaacttaaaccgtaaaccgtaaaacccgtaacggttcggttaaccgg

SEQ ID NO: 308651 - DNA, 551 bp, Homo sapiens
  misc_feature: GZ8MTXP02IXMZX.44.34.D01.1.454.CMB.2.raw
  modified_base (201)..(201): a, c, t, g, unknown or other
  misc_feature (201)..(201): n is a, c, g, or t
  modified_base (344)..(344): a, c, t, g, unknown or other
  misc_feature (344)..(344): n is a, c, g, or t
  modified_base (412)..(412): a, c, t, g, unknown or other
  misc_feature (412)..(412): n is a, c, g, or t
  modified_base (419)..(419): a, c, t, g, unknown or other
  misc_feature (419)..(419): n is a, c, g, or t
tcagacagtatatacacgaccggtgctcgatttagatcgtctgtgttgggtttgggggcagaagtctctctcagtcaggacacagcatggacatgagggtccctgctcagctcctgggactcctgctgctctggctcccagatactagatgtgacttccagatgacccagtctccatcctccctgtctgcatctgtggganacagagtcaccatcacttgccgggcgagtcaggccattagctaattattagcctggtatcagcaagaaaccagggaaacctcctaacctctagactcttgctgctatcctacttgctaactcgacgggtcccatctcggttcngcgacagtgatcgtagggactagtactttctctctcacctatcagcagcctgcacgtcctagaaagtntggttanacttaacttattacgtataacaaaacgtacaaactacggtcctacccctactaaccgtaccgtttccggacccgttacgggaaacccttaaaggcgtaaacgtaactacgtaaaaccgtacttaggtaaccg

SEQ ID NO: 308652 - DNA, 609 bp, Homo sapiens
  misc_feature: GZ8MTXP02JMHTQ.44.34.D01.1.454.CMB.2.raw
  modified_base (199)..(199): a, c, t, g, unknown or other
  misc_feature (199)..(199): n is a, c, g, or t
  modified_base (226)..(226): a, c, t, g, unknown or other
  misc_feature (226)..(226): n is a, c, g, or t
  modified_base (287)..(287): a, c, t, g, unknown or other
  misc_feature (287)..(287): n is a, c, g, or t
  modified_base (346)..(346): a, c, t, g, unknown or other
  misc_feature (346)..(346): n is a, c, g, or t
  modified_base (356)..(356): a, c, t, g, unknown or other
  misc_feature (356)..(356): n is a, c, g, or t
  modified_base (383)..(383): a, c, t, g, unknown or other
  misc_feature (383)..(383): n is a, c, g, or t
  modified_base (433)..(433): a, c, t, g, unknown or other
  misc_feature (433)..(433): n is a, c, g, or t
  modified_base (442)..(442): a, c, t, g, unknown or other
  misc_feature (442)..(442): n is a, c, g, or t
tcagacagtatatacacgaccggtgctcgatttagatcgtctgtgttgggtttgggggcagaagtctctctcagtcaggacacagcatggacatgagggtccctgctcagctcctgggactcctgctgctctggctcccagatactagatgtgacttcagatgacccagtctccatcctcctgtctgcatctgtggganacagagtcaccatcacgttggccgggngagtcaggccattagcaattattagcctggtatcagcaagaaccaggaaacctcctaaccnctgactcttgctgcactcctactttgacaatccgacggggtcccattccgtacggttcncggtccgganaggtgatcgtagggactagtatttccnctcctcaacctataccgagtccacgtcctggaccacgccttagaaacgtnttgggttanaccgttaaatttacgttaacttacggtaaactaaaacgttaacaaccgtacggtcccgtaccctacctaaccgttaacccggtttcccggacccgttaacggggtaaaacctaaagggttacgtaaacttaaaccgaaccgtaaaaacggttacgtacggttaccgg

SEQ ID NO: 308653 - DNA, 553 bp, Homo sapiens
  misc_feature: GZ8MTXP02FNMJU.44.34.D01.1.454.CMB.2.raw
  modified_base (201)..(201): a, c, t, g, unknown or other
  misc_feature (201)..(201): n is a, c, g, or t
  modified_base (226)..(226): a, c, t, g, unknown or other
  misc_feature (226)..(226): n is a, c, g, or t
  modified_base (392)..(392): a, c, t, g, unknown or other
  misc_feature (392)..(392): n is a, c, g, or t
tcagacagtatatacacgaccggtgctcgatttagatcgtctgtgttgggtttgggggcagaagtctctctcagtcaggacacagcatggacatgagggtccctgctcagctcctgggactcctgctgctctggctcccagatactagatgtgacttccagatgacccagtctccatcctccctgtctgcatctgtggganacagagtcaccatcacttggccggnagtcaggccatagctaattattagctgtatcagcaagaaccaggaaacctcctaacctcctgattcttgctgactatcctactttcgacaactccgacggggtcccagttctccggttcaggtcgcgaggtcgatcgtagggactagtactttctctctcacctanccaagcagtaccctgaccacgacctagaagtacgtggttacacttaacttattacctagtaactaaaagtacaatacggtcacccctacgacttacccgtttcggaccccgtagggtaaacctaaagtacggtaatactaacaaaccgtaagtggtaacgg

SEQ ID NO: 308654 - DNA, 572 bp, Homo sapiens
  misc_feature: GZ8MTXP02HECXS.44.34.D01.1.454.CMB.2.raw
  modified_base (200)..(200): a, c, t, g, unknown or other
  misc_feature (200)..(200): n is a, c, g, or t
  modified_base (224)..(224): a, c, t, g, unknown or other
  misc_feature (224)..(224): n is a, c, g, or t
  modified_base (370)..(370): a, c, t, g, unknown or other
  misc_feature (370)..(370): n is a, c, g, or t
  modified_base (409)..(409): a, c, t, g, unknown or other
  misc_feature (409)..(409): n is a, c, g, or t
tcagacagtatatacacgaccggtgctcgatttagatcgtctgtgttgggtttggggcagaagtctctctcagtcaggacacagcatggacatgagggtccctgctcagctcctgggactcctgctgctctggctcccagatactagatgtgacttccagatgacccagtctccatcctccctgtctgcatctgtggganacagagtcaccatcacttgccggnagtcaggccattagcaattattagcctggtatcagcaagaaaccaggaaacctcctaacctcctagatctttagctgcactcctactttgacaacttccgacggggttccccagttcgtcggttcacggcggtacaggtgattcgngggactagtatttcctctctacaccatacagcagtcccncgacacgcgtagtaagtagtagtacgtactaacttaacttaacgttaacgtaaacgtaaacgtaaactaacgtaacgtaccgtaccctacctaccgtaccgttaccgtaccgtacggtaacgtaacgtacgtaacgtaactaacgaaacgtaacgtacgtacg

SEQ ID NO: 308655 - DNA, 516 bp, Homo sapiens
  misc_feature: GZ8MTXP02IK71M.44.34.D01.1.454.CMB.2.raw
  modified_base (252)..(252): a, c, t, g, unknown or other
  misc_feature (252)..(252): n is a, c, g, or t
  modified_base (278)..(278): a, c, t, g, unknown or other
  misc_feature (278)..(278): n is a, c, g, or t
  modified_base (282)..(282): a, c, t, g, unknown or other
  misc_feature (282)..(282): n is a, c, g, or t
  modified_base (288)..(289): a, c, t, g, unknown or other
  misc_feature (288)..(289): n is a, c, g, or t
  modified_base (291)..(292): a, c, t, g, unknown or other
  misc_feature (291)..(292): n is a, c, g, or t
  modified_base (294)..(294): a, c, t, g, unknown or other
  misc_feature (294)..(294): n is a, c, g, or t
  modified_base (296)..(296): a, c, t, g, unknown or other
  misc_feature (296)..(296): n is a, c, g, or t
  modified_base (298)..(299): a, c, t, g, unknown or other
  misc_feature (298)..(299): n is a, c, g, or t
  modified_base (302)..(302): a, c, t, g, unknown or other
  misc_feature (302)..(302): n is a, c, g, or t
  modified_base (307)..(307): a, c, t, g, unknown or other
  misc_feature (307)..(307): n is a, c, g, or t
  modified_base (313)..(313): a, c, t, g, unknown or other
  misc_feature (313)..(313): n is a, c, g, or t
  modified_base (315)..(315): a, c, t, g, unknown or other
  misc_feature (315)..(315): n is a, c, g, or t
  modified_base (317)..(317): a, c, t, g, unknown or other
  misc_feature (317)..(317): n is a, c, g, or t
  modified_base (328)..(328): a, c, t, g, unknown or other
  misc_feature (328)..(328): n is a, c, g, or t
  modified_base (352)..(352): a, c, t, g, unknown or other
  misc_feature (352)..(352): n is a, c, g, or t
  modified_base (354)..(354): a, c, t, g, unknown or other
  misc_feature (354)..(354): n is a, c, g, or t
tcagacagtatatacacgaccggtgctcgatttagatcgtctgtgttgggtttgggggcagaagtctctctcagtcaggacacagcatggacatgagggtccctgctcagctcctgggactcctgctgctctggctcccagatactagatgtgacttccagatgacccagtctccatcctcctgtctgcatctgtgggagacagagtcacatcactgccggcagtcaggccattagcaattattagctgtancagcaagaaacaggaaacctcaaacnctanatcttnntnnancntnnacnacgcntctgtngngnagtgatgtganatatctctctcacatacacacacncncgcacgactagtaagagtagtagtactaacttaattaactaagtaaataaaactaaaactaaaactaacgtacctaccctacctaactaccgttaccgtaccgtacggaaaccgaaacgtaaacggtaacgtaaactaaactaaaacgtaaacgtacgtacg

SEQ ID NO: 308656 - DNA, 517 bp, Homo sapiens
  misc_feature: GZ8MTXP02I004O.44.34.D01.1.454.CMB.2.raw
  modified_base (201)..(201): a, c, t, g, unknown or other
  misc_feature (201)..(201): n is a, c, g, or t
  modified_base (227)..(227): a, c, t, g, unknown or other
  misc_feature (227)..(227): n is a, c, g, or t
  modified_base (358)..(358): a, c, t, g, unknown or other
  misc_feature (358)..(358): n is a, c, g, or t
  modified_base (374)..(374): a, c, t, g, unknown or other
  misc_feature (374)..(374): n is a, c, g, or t
  modified_base (388)..(388): a, c, t, g, unknown or other
  misc_feature (388)..(388): n is a, c, g, or t
  modified_base (392)..(392): a, c, t, g, unknown or other
  misc_feature (392)..(392): n is a, c, g, or t
  modified_base (401)..(401): a, c, t, g, unknown or other
  misc_feature (401)..(401): n is a, c, g, or t
  modified_base (404)..(404): a, c, t, g, unknown or other
  misc_feature (404)..(404): n is a, c, g, or t
  modified_base (407)..(407): a, c, t, g, unknown or other
  misc_feature (407)..(407): n is a, c, g, or t
  modified_base (416)..(416): a, c, t, g, unknown or other
  misc_feature (416)..(416): n is a, c, g, or t
  modified_base (421)..(421): a, c, t, g, unknown or other
  misc_feature (421)..(421): n is a, c, g, or t
  modified_base (438)..(438): a, c, t, g, unknown or other
  misc_feature (438)..(438): n is a, c, g, or t
  modified_base (501)..(501): a, c, t, g, unknown or other
  misc_feature (501)..(501): n is a, c, g, or t
tcagacagtatatacacgaccggtgctcgatttagatcgtctgtgttgggtttgggggcagaagtctctctcagtcaggacacagcatggacatgagggtccctgctcagctcctgggactcctgctgctctggctcccagatactagatgtgacttccagatgacccagtctccatcctcctgtctgcatctggtggganacagagtcaccatcacgttggccggnagtcaggccattagactaattattacgctaggtatcagacaagaaaccgacggaaacctcctaaacctcctagacttctttgactgactacttcctatttcgactaacgtcgacgggtccagtctcgttcngtcgactagtgatcgnggactagtatttcnctcncacatccancanctncagctagantgtanactaattatatagtaanaaaatacaactacgtcaccctactaactaccgttcgacccgtagaacctaagtcgaatactanaaaccgtagtagtacg

SEQ ID NO: 308657 - DNA, 600 bp, Homo sapiens
  misc_feature: GZ8MTXP02F1FQM.44.34.D01.1.454.CMB.2.raw
  modified_base (201)..(201): a, c, t, g, unknown or other
  misc_feature (201)..(201): n is a, c, g, or t
  modified_base (349)..(349): a, c, t, g, unknown or other
  misc_feature (349)..(349): n is a, c, g, or t
  modified_base (418)..(418): a, c, t, g, unknown or other
  misc_feature (418)..(418): n is a, c, g, or t
tcagacagtatatacacgaccggtgctcgatttagatcgtctgtgttgggtttgggggcagaagtctctctcagtcaggacacagcatggacatgagggtccctgctcagctcctgggactcctgctgctctggctcccagatactagatgtgacttccagatgacccagtctccatcctccctgtctgcatctgtggganacagagtcaccatcacttggccggcgagtcaggccattagctaattatttagcctggtatcagcaagaaaccaggaaacctcctaaccgtcctagacttctttgctgctatccactttgacaactcgacggggtccatcgtccggttngcgcaggtgatcgtgggactagtatttctctctacacctatcatcacgcctgacacgcctaggaacgtnttacggttagaccttaactttattacgttaacggttaaactaaaacggtaactaaaccgtacgtaccgtaaccccctcgtaaacccgtaccgttttacccggaccccggttacggtaacccgtaaaaggttacgggtaaacttaactaaccggtaaaacgtaacccgtttagggttaaccgg

SEQ ID NO: 308658 - DNA, 595 bp, Homo sapiens
  misc_feature: GZ8MTXP02ILCGI.44.34.D01.1.454.CMB.2.raw
  modified_base (201)..(201): a, c, t, g, unknown or other
  misc_feature (201)..(201): n is a, c, g, or t
tcagacagtatatacacgaccggtgctcgatttagatcgtctgtgttgggtttgggggcagaagtctctctcagtcaggacacagcatggacatgagggtccctgctcagctcctgggactcctgctgctctggctcccagatactagatgtgacttccagatgacccagtctccatcctccctgtctgcatctgtggganacagagtcaccatcacttgccgggcagtcaggcattagcaattattagctggtatcagacaacgaaaccgacgggaaacctccctaacctcctagtacttcttgctgcctatccctattgactaactccgacggggtcccatcgtccggttcacgggcgacgtaggtgtacgtcgtagggactattacgttctctctaccacctatccagctacgccgtgacctacgtacctaggaaagtagttgttaccgactaactttaattacgtaagtaaactaaaagtaccaaactacgtaccgtaccccctctaaacctaccgtttaccggacccggttacggaaaccgtaaaggtacggaaacttactaaaaccgtaacgtaaacgtacggtaccgg

SEQ ID NO: 308659 - DNA, 599 bp, Homo sapiens
  misc_feature: GZ8MTXP02JHUZL.44.34.D01.1.454.CMB.2.raw
  modified_base (201)..(201): a, c, t, g, unknown or other
  misc_feature (201)..(201): n is a, c, g, or t
  modified_base (226)..(226): a, c, t, g, unknown or other
  misc_feature (226)..(226): n is a, c, g, or t
  modified_base (458)..(458): a, c, t, g, unknown or other
  misc_feature (458)..(458): n is a, c, g, or t
tcagacagtatatacacgaccggtgctcgatttagatcgtctgtgttgggtttgggggcagaagtctctctcagtcaggacacagcatggacatgagggtccctgctcagctcctgggactcctgctgctctggctcccagatactagatgtgacttccagatgacccagtctccatcctccctgtctgcatctgtggganacagagtcaccatcacttggccggngagtcaggccattagctaattatttagcctggtatcagcaagaaaccgacggaaacctcctaaacctctagacttcttgctgctactcctactttgacaacgtcgacggggtccctagttcgttcggttcacggccgggacgtaggtcgggtattcggtacggggaactagtactttcctctcctccaaccactaccacgccgtacgcccgtgaccaggtcctagtaaacgnttacggttacgacttaaactttaacgttactacgtaactaaaagtacaaacgtaacgtccgacccctacgacctaccgtttcccggaccgttacggaaaccgtaagacggtaactaacgtacgaaaacgtacgtggtacgg

SEQ ID NO: 308660 - DNA, 621 bp, Homo sapiens
  misc_feature: GZ8MTXP02G3VA3.44.34.D01.1.454.CMB.2.raw
  modified_base (202)..(202): a, c, t, g, unknown or other
  misc_feature (202)..(202): n is a, c, g, or t
  modified_base (227)..(227): a, c, t, g, unknown or other
  misc_feature (227)..(227): n is a, c, g, or t
  modified_base (365)..(365): a, c, t, g, unknown or other
  misc_feature (365)..(365): n is a, c, g, or t
  modified_base (407)..(407): a, c, t, g, unknown or other
  misc_feature (407)..(407): n is a, c, g, or t
tcagacagtatatacacgaccggtgctcgatttagatcgtctgtgttgggtttgggggcagaagtctctctcagtcaggacacagcatggacatgagggtccctgctcagctcctgggactcctgctgctctggctcccagatactagatgtgacttccagatgacccagtctccatcctccctgtctgcatctggtggganacagagtcaccatcacttgccgggnagtcaggccattagactaattattagcctggtatcagacaaagaaaccgaggaaaccccttcctaaaccctcctagtacttctttgacctgctactcctactttgactaactcggacgggtcccagttccgtcggttnacggcggtactaggtggactcggtagggactagtactttccnctcacactatcgacgcacgtcctgaccacgtacgtaagtagtagttacggttactaactttaaatttaacttaacgtaaacgtaaaacctaaaacgtaactaaacgtacgtaccctacccttaccgtaaaccgtttaccggtttacccggacccggtaaggtaaaccgtaaaggtacgtaaactaaacgtaaacgtaaacgtacggtacgtacg

SEQ ID NO: 308661 - DNA, 606 bp, Homo sapiens
  misc_feature: GZ8MTXP02HUM6F.44.34.D01.1.454.CMB.2.raw
  modified_base (203)..(203): a, c, t, g, unknown or other
  misc_feature (203)..(203): n is a, c, g, or t
  modified_base (229)..(229): a, c, t, g, unknown or other
  misc_feature (229)..(229): n is a, c, g, or t
  modified_base (373)..(373): a, c, t, g, unknown or other
  misc_feature (373)..(373): n is a, c, g, or t
  modified_base (419)..(419): a, c, t, g, unknown or other
  misc_feature (419)..(419): n is a, c, g, or t
tcagacagtatatacacgaccggtgctcgatttagatcgtctgtgttgggtttgggggcagaagtctctctcagtcaggacacagcatggacatgagggtccctgctcagctcctgggactcctgctgctctggctcccagatactagatgtgacttccagatcgacccagtctccatcctccctgtctgcatctggtggganacagagtcaccatcacgttggccggngagtcaggccagttagactaatttattacgccttaggtactcaggacaaacgaaaccgaacggtaaaccctcctaaacctcctagtacttcttgactgactactcctattgactaacgtccgacgggtccagttcgtcgttacnggcgactagtgagtcgagggactgtacttctctctacactatccancgacgtcacgacacgtaccgtagtaagtagttagttacgtaacgtaacttaattaacgttaacgtaaacgtaaaacgtaaacgtaaacgtaacgtaccgtaccctacctaccttaccgttaccgtacccgtaaccggtaacgtaaacgtaacgtaacgtaacgtaactaaacgtaacgtaggtacgg

SEQ ID NO: 308662 - DNA, 562 bp, Homo sapiens
  misc_feature: GZ8MTXP02HUFK6.44.34.D01.1.454.CMB.2.raw
  modified_base (254)..(254): a, c, t, g, unknown or other
  misc_feature (254)..(254): n is a, c, g, or t
  modified_base (380)..(380): a, c, t, g, unknown or other
  misc_feature (380)..(380): n is a, c, g, or t
  modified_base (418)..(418): a, c, t, g, unknown or other
  misc_feature (418)..(418): n is a, c, g, or t
  modified_base (426)..(426): a, c, t, g, unknown or other
  misc_feature (426)..(426): n is a, c, g, or t
  modified_base (455)..(455): a, c, t, g, unknown or other
  misc_feature (455)..(455): n is a, c, g, or t
  modified_base (497)..(497): a, c, t, g, unknown or other
  misc_feature (497)..(497): n is a, c, g, or t
  modified_base (502)..(502): a, c, t, g, unknown or other
  misc_feature (502)..(502): n is a, c, g, or t
  modified_base (534)..(534): a, c, t, g, unknown or other
  misc_feature (534)..(534): n is a, c, g, or t
  modified_base (553)..(553): a, c, t, g, unknown or other
  misc_feature (553)..(553): n is a, c, g, or t
tcagacagtatatacacgaccggtgctcgatttagatcgtctgtgttgggtttgggggcagaagtctctctcagtcaggacacagcatggacatgagggtccctgctcagctcctgggactcctgctgctctggctcccagatactagatgtgacttccagatcgacccagtctccactccctccctgtctgcatcgtgtgggagacagacgtcacatcacttggccggcgagtcaggccaattagctaatttnttacgccttggtatcagacaacgaaaccgaacggtaaaaccccttcctaaaccctcctagactttccgtttgcttcgactactcctaactttgacaacgtccgtacgggtccattcgtcggttacnggtcggcaggtggatcggtagggactagttactttccncttcaccnctatcagcacgctgcagtcctagaacgtnttgttacactattatacgagtaacaaagtacaactcgtaccnccctnaacttccggtaccggcctaggaaacctaaggnaaacgttacaacgtaaacncgttggacc

SEQ ID NO: 308663 - DNA, 550 bp, Homo sapiens
  misc_feature: GZ8MTXP02HXPP8.44.34.D01.1.454.CMB.2.raw
  modified_base (201)..(201): a, c, t, g, unknown or other
  misc_feature (201)..(201): n is a, c, g, or t
  modified_base (341)..(341): a, c, t, g, unknown or other
  misc_feature (341)..(341): n is a, c, g, or t
  modified_base (401)..(401): a, c, t, g, unknown or other
  misc_feature (401)..(401): n is a, c, g, or t
tcagacagtatatacacgaccggtgctcgatttagatcgtctgtgttgggtttgggggcagaagtctctctcagtcaggacacagcatggacatgagggtccctgctcagctcctgggactcctgctgctctggctcccagatactagatgtgacttccagatgacccagtctccatcctccctgtctgcatctgtggganacagagtcaccatcacttgccgggcgagtcaggccattagactaattattagcctggtatcagacaagaaaccgaggaaacctcctaacctctagattcttgctgcatcctatttgacactcgacggtccagtctcgtcngcgcagtgatcgaggactagtcttctctctcactatcagcacgctgcacgcctagaagtnttgttacgacttaacttagttacgtagtaaacaaaacgtacaaaccgtacgtacgtacccctacgtaccgttaccgttcccgggtaccctaacgggtaaccctaaaaggtcgttaaactaccgtaaaccgaaacggtacttacggtacg

SEQ ID NO: 308664 - DNA, 558 bp, Homo sapiens
  misc_feature: GZ8MTXP02GWFCQ.44.34.D01.1.454.CMB.2.raw
  modified_base (202)..(202): a, c, t, g, unknown or other
  misc_feature (202)..(202): n is a, c, g, or t
  modified_base (226)..(226): a, c, t, g, unknown or other
  misc_feature (226)..(226): n is a, c, g, or t
  modified_base (337)..(337): a, c, t, g, unknown or other
  misc_feature (337)..(337): n is a, c, g, or t
  modified_base (351)..(351): a, c, t, g, unknown or other
  misc_feature (351)..(351): n is a, c, g, or t
  modified_base (363)..(363): a, c, t, g, unknown or other
  misc_feature (363)..(363): n is a, c, g, or t
  modified_base (371)..(371): a, c, t, g, unknown or other
  misc_feature (371)..(371): n is a, c, g, or t
  modified_base (380)..(380): a, c, t, g, unknown or other
  misc_feature (380)..(380): n is a, c, g, or t
tcagacagtatatacacgaccggtgctcgatttagatcgtctgtgttgggtttgggggcagaagtctctctcagtcaggacacagcatggacatgagggtccctgctcagctcctgggactcctgctgctctggctcccagatactagatgtgacttccagatgacccagtctccatcctccctgtctgccatctgtggganacagagtcaccatcacttgccggnagtcaggccattagctaattattagcctggtatcagcaagaaaccaggaaacctcctaactcctgatcttgctgacatcctattgacaactccgaggtccatcgtcgttcngcgcagtggatcgnggacagtattcnctctcacntcatcatcngcagcctagactagttcgtagacttaacttattaacgtacgtaactaaaaagtactaaaccgtacggtaccctaccctactaaccgttacccgtttacccgggacccgttaacgggtaaaccctaaggggtactaaacgttaactaaccgtaaaacggttaccgtttacggtacccgg

SEQ ID NO: 308665 - DNA, 612 bp, Homo sapiens
  misc_feature: GZ8MTXP02HT8DY.44.34.D01.1.454.CMB.2.raw
  modified_base (229)..(229): a, c, t, g, unknown or other
  misc_feature (229)..(229): n is a, c, g, or t
  modified_base (361)..(361): a, c, t, g, unknown or other
  misc_feature (361)..(361): n is a, c, g, or t
tcagacagtatatacacgaccggtgctcgatttagatcgtctgtgttgggtttgggggcagaagtctctctcagtcaggacacagcatggacatgagggtccctgctcagctcctgggactcctgctgctctggctcccagatactagatgtgacttccagatcgacccagtctccatcctccctgtctgcatctggtggagacagagtcaccatcacttcggccgggngagtcaggcctagttacgctaattattagcctggtatcagcaagaaaccacgggaaacctccctaacctcctagtattctttagctgccagtcctacttgacctagtcgtacgggtcccagttctcggttanggcgacagtgatcggtaggacagtattccgtctctcactatcagcacgcctagccgtaacgtccgtaaggtaagtagttacggtactaactaaattactttaacgtagtaaactaaaacgtaaccaacgtacggttaccgtacccctaactacccgtttaccggttacccgtacccggtaacgggtaaaacctaaaggggtaacgtaaacgttaaccgaacgttaaaaacccgtacggtttacgtaccggg

SEQ ID NO: 308666 - DNA, 709 bp, Homo sapiens
  misc_feature: GZ8MTXP02FK545.44.34.D01.1.454.CMB.2.raw
  modified_base (200)..(200): a, c, t, g, unknown or other
  misc_feature (200)..(200): n is a, c, g, or t
tcagacagtatatacacgaccggtgctcgatttagatcgtctgtgttgggtttgggggcagaagtctctctcagtcaggacacagcatggacatgagggtccctgctcagctcctgggactcctgctgctctggctcccagatactagatgtgacttccagatgacccagtctccatcctcctgtctgcatctgtggganacagagtcacatcacgttcggccgggcgagtcgacggcctattagactaattattagcctaggtactcgagacaacgaaaccgacggaaacctacctaaccctctgacttcttgctcgactacttacctatttcgactaacgtacgtaccggggttacccagttcccgttaccggttacgacgggaccgggtacgtaggtacggtacgttcggtaggggtaacctagttacttttcccccttccaacctaaccacttacacgtacgaccgtccgtaccgtgtaaccgacggacgtaaggtaacgtttacggttacggttaaccgttaaacctttaacgttttacgtaaacgtttaaacgaaaaactaaaccgtaaaccgtaaccgtacccggttacccctacccgttaaaccgttaccgtttaccccgggtaccgtaaccggaacgtaaaaccggttaaggtaaccgttaaataaacccgtaaaacgtaaaccctgggtacgtaaccgg

SEQ ID NO: 308667 - DNA, 604 bp, Homo sapiens
  misc_feature: GZ8MTXP02HG4K1.44.34.D01.1.454.CMB.2.raw
  modified_base (207)..(207): a, c, t, g, unknown or other
  misc_feature (207)..(207): n is a, c, g, or t
  modified_base (236)..(236): a, c, t, g, unknown or other
  misc_feature (236)..(236): n is a, c, g, or t
  modified_base (378)..(378): a, c, t, g, unknown or other
  misc_feature (378)..(378): n is a, c, g, or t
  modified_base (380)..(380): a, c, t, g, unknown or other
  misc_feature (380)..(380): n is a, c, g, or t
  modified_base (426)..(426): a, c, t, g, unknown or other
  misc_feature (426)..(426): n is a, c, g, or t
  modified_base (455)..(455): a, c, t, g, unknown or other
  misc_feature (455)..(455): n is a, c, g, or t
tcagacagtatatacacgaccggtgctcgatttagatcgtctgtgttgggtttgggggcagaagtctctctcagtcaggacacagcatggacatgagggtccctgctcagctcctgggactcctgctgctctggctcccagatactagatgtgacttccagatcgacccagtcctccactccctccctgtctgcatcgtggtggganacagacgtcacctatctacgttggccggnagtcgaggcctattagactaaattattacgcctaggtatcagacaaacgaaccgaacggtaaaccctcctaaacctcctagtactttcgttacgctcgctactcctacgtttgactaacgtcgacggtccagttctcggtcngngctaggtgacttcggaggactagttacttctctctcactatcgaancgacgtccagactacgtacgtagtaagtnttgggtacttaaacttaactttagttacgtaaacgtaaactaaaacgtacaaacgttacgtaccctaccctaactaccgttaccgttcccggacccgttaacggaaacctaagggtacgtaaactactaaacgaactaacgtcgtacgg

SEQ ID NO: 308668 - DNA, 620 bp, Homo sapiens
  misc_feature: GZ8MTXP02GM4IO.44.34.D01.1.454.CMB.2.raw
  modified_base (206)..(206): a, c, t, g, unknown or other
  misc_feature (206)..(206): n is a, c, g, or t
  modified_base (235)..(235): a, c, t, g, unknown or other
  misc_feature (235)..(235): n is a, c, g, or t
  modified_base (414)..(414): a, c, t, g, unknown or other
  misc_feature (414)..(414): n is a, c, g, or t
  modified_base (473)..(473): a, c, t, g, unknown or other
  misc_feature (473)..(473): n is a, c, g, or t
  modified_base (478)..(478): a, c, t, g, unknown or other
  misc_feature (478)..(478): n is a, c, g, or t
  modified_base (494)..(494): a, c, t, g, unknown or other
  misc_feature (494)..(494): n is a, c, g, or t
tcagacagtatatacacgaccggtgctcgatttagatcgtctgtgttgggtttgggggcagaagtctctctcagtcaggacacagcatggacatgagggtccctgctcagctcctgggactcctgctgctctggctcccagatactagatgtgacttccagatcgacccagtcctccatccctccctgtctgcatcgtggtggganacagagtccaccatcacgttcggccgggngagtcacggcctattagactaattagttacgccttaggtactacgagaccgaaacggaaaacccgacgggtaaaccccttacccttaacccgtcctagtactttcgtttcgactcgctactacccttacgttacgactaaccgtcggtaccggggtccctacttccggttccggttacncggggtcgtacgtaggttggacgttgtacgggactagttacttctctcacacatcagcncgacncgactgaccagtagtntagtcacttattattacgtactaaactaagtaacgactaccgtccgaccctaccgtacgtccgttaccggaccgtacggtaaaccgaagtcgtaaactacgtaaccgtaaaacgtcgttaggaccg

SEQ ID NO: 308669 - DNA, 541 bp, Homo sapiens
  misc_feature: GZ8MTXP02IUB2B.44.34.D01.1.454.CMB.2.raw
  modified_base (202)..(202): a, c, t, g, unknown or other
  misc_feature (202)..(202): n is a, c, g, or t
  modified_base (228)..(228): a, c, t, g, unknown or other
  misc_feature (228)..(228): n is a, c, g, or t
  modified_base (372)..(372): a, c, t, g, unknown or other
  misc_feature (372)..(372): n is a, c, g, or t
  modified_base (377)..(377): a, c, t, g, unknown or other
  misc_feature (377)..(377): n is a, c, g, or t
  modified_base (393)..(393): a, c, t, g, unknown or other
  misc_feature (393)..(393): n is a, c, g, or t
  modified_base (399)..(399): a, c, t, g, unknown or other
  misc_feature (399)..(399): n is a, c, g, or t
tcagacagtatatacacgaccggtgctcgatttagatcgtctgtgttgggtttgggggcagaagtctctctcagtcaggacacagcatggacatgagggtccctgctcagctcctgggactcctgctgctctggctcccagatactagatgtgacttccagatgacccagttctccatcctccctgtctgcatctgtggganacagagtccaccatcacttgccgggnagtcaggccattagctaattatttagcctggtatcagcaagaaaccagggaaacctacctaacctcctgacttctttgctgctactcctactttgctactcgacgggtcccattctcggtcaggcgcagtgactgtggatagtntttcnctactcacatacgacncacgcncgacgacgtactaggagtgtgttactaacgttaattacttactacgtaaacaaacgtaacaacgtacgtcctaccctacgtaccgtaccgttaccgaccgtaagaaacgtaagtacgaactacgacaaacgtacgtcggtac

SEQ ID NO: 308670 - DNA, 572 bp, Homo sapiens
  misc_feature: GZ8MTXP02HXDK9.44.34.D01.1.454.CMB.2.raw
  modified_base (201)..(201): a, c, t, g, unknown or other
  misc_feature (201)..(201): n is a, c, g, or t
  modified_base (225)..(225): a, c, t, g, unknown or other
  misc_feature (225)..(225): n is a, c, g, or t
  modified_base (345)..(345): a, c, t, g, unknown or other
  misc_feature (345)..(345): n is a, c, g, or t
  modified_base (358)..(358): a, c, t, g, unknown or other
  misc_feature (358)..(358): n is a, c, g, or t
tcagacagtatatacacgaccggtgctcgatttagatcgtctgtgttgggtttgggggcagaagtctctctcagtcaggacacagcatggacatgagggtccctgctcagctcctgggactcctgctgctctggctcccagatactagatgtgacttccagatgacccagtctccatcctccctgtctgcatctgtggganacagagtcaccatcacttgccggnagtcaggccattagctaattattagcctaggtatcagacaagaaaccaggaaacctcctaacctcctagattcttgctgactactcctacttgactactcgacggtcccagttctcggtngcgcagtgatcgnggacagtacttctctctcactatcagcacgcctgacacgaccgttaggaacgtagttgttacgaccttaaacgtttattacgtacgtaaactaaaaacgtaccaaacgtacgtaccctaccccttactaaccgttaccgtttaccgacccgttacgggaaaaccctaaaggtagtaaacgttactaaaccgtaaaacggtaccgtttaggacgg

SEQ ID NO: 308671 - DNA, 681 bp, Homo sapiens
  misc_feature: GZ8MTXP02GQ896.44.34.D01.1.454.CMB.2.raw
  modified_base (207)..(207): a, c, t, g, unknown or other
  misc_feature (207)..(207): n is a, c, g, or t
  modified_base (261)..(261): a, c, t, g, unknown or other
  misc_feature (261)..(261): n is a, c, g, or t
  modified_base (275)..(275): a, c, t, g, unknown or other
  misc_feature (275)..(275): n is a, c, g, or t
tcagacagtatatacacgaccggtgctcgatttagatcgtctgtgttgggtttgggggcagaagtctctctcagtcaggacacagcatggacatgagggtccctgactcagctcctgggactcctgctgctctggctcccagatactagatgtgacttccagatcgacccagtctccatccctccctgtctgctatcgtggtggganacagagtccaccatcacgttcggccgggcgagtcaggcctaattagctaaattnttacgcctgtactnacgacaaacgaaaccgaacggtaaaccctccgtaacctccgttagactttcgttagctgcctacttctacttcgacgaaccgttcggaaccggggttcctagttccgtccggttacgcggtccggctaagggtgtacgttacgggtacgggtaactacgttacttttcctcttacctactaaccgtctaccgacgcctcgcctcgacgacgtaccgtagtaacgtagttacggttacgtacttaaactttaacttaacgttaacgtaaaacgtaaaacgtaaaccgtaacgtaaccggttaccgtacccttacccgttaaccgttaccgttacccggtaccggtaaccggtaaccggtaaacggtacggtaacttaacgtaacgtaaacgtaacgtacggttacgg

SEQ ID NO: 308672 - DNA, 608 bp, Homo sapiens
  misc_feature: GZ8MTXP02FU9IZ.44.34.D01.1.454.CMB.2.raw
  modified_base (203)..(203): a, c, t, g, unknown or other
  misc_feature (203)..(203): n is a, c, g, or t
  modified_base (231)..(231): a, c, t, g, unknown or other
  misc_feature (231)..(231): n is a, c, g, or t
tcagacagtatatacacgaccggtgctcgatttagatcgtctgtgttgggtttgggggcagaagtctctctcagtcaggacacagcatggacatgagggtccctgctcagctcctgggactcctgctgctctggctcccagatactagatgtgacttcagatgacccagtcctccatcctccctgtctgcatcgtggtggganacagactcaccatcacgttcggccgggnagtcgaggccattagactaattattacgcctggtatcagcaagaaaccaggaaacctccgtaaacctcctagacttcttagctgctactccactttgactacgtcgacggggtccctagtcgtcgttcgacggcggtcgtaggtcggacgtcgtaggggactagtactttcctctcctcaaccctagaccagactcgcctcgaccgtacgcctaggaatgttacgtgtaaccttaacgtttattacgttacggaaactaaaacgtaactaaacgtacgtacccgtaccctacgtaacccttaccgtttaccggacccgttaacgggaacctaaaaggtcgtaacgtaaacttaaccgaaaacgtaccgtagtaccgg

SEQ ID NO: 308673 - DNA, 637 bp, Homo sapiens
  misc_feature: GZ8MTXP02GCAH8.44.34.D01.1.454.CMB.2.raw
  modified_base (200)..(200): a, c, t, g, unknown or other
  misc_feature (200)..(200): n is a, c, g, or t
tcagacagtatatacacgaccggtgctcgatttagatcgtctgtgttgggtttgggggcagaagtctctctcagtcaggacacagcatggacatgagggtccctgctcagctcctgggactcctgctgctctggctccagatactagatgtgacttccagatgacccagtctccatcctcctgtctgcatctggtggganacagagtcaccatcacgttggccggcgagtcgaggctatagactaattattagcctggtatcgagacaacgaaaccgaacggaaacctcctaaacctctagtacttcgtttgctgctactcctattgacacgtccgtacggggtcctagtcgtcgttacgacggtcggcgtaggtacggagttacgtaggggaacctagttactttccgtcctactacctaacctatacgaacgtcgaacgtccgtacgacgttaccgaccgtagtaagtagttacggttactaaccttaagttacttaccggtaataaacgtaaaacgttacgaaacttacggtaccctaccctaacgtaaccgttaccggttcccgtaacccgtacggtaaaccgtaagggttactaaacgtaccgtaaccgtaaaacggtacgtacggtaaccg

SEQ ID NO: 308674 - DNA, 500 bp, Homo sapiens
  misc_feature: GZ8MTXP01DPO26.8.4.A04.1.454.CMB.2.raw
  modified_base (253)..(253): a, c, t, g, unknown or other
  misc_feature (253)..(253): n is a, c, g, or t
  modified_base (376)..(376): a, c, t, g, unknown or other
  misc_feature (376)..(376): n is a, c, g, or t
  modified_base (381)..(381): a, c, t, g, unknown or other
  misc_feature (381)..(381): n is a, c, g, or t
  modified_base (440)..(440): a, c, t, g, unknown or other
  misc_feature (440)..(440): n is a, c, g, or t
  modified_base (465)..(465): a, c, t, g, unknown or other
  misc_feature (465)..(465): n is a, c, g, or t
tcagctcgcgtgtccacgaccggtgctcgatttagagtagtgatcagggggaagcctgagaacacttagccttcatgagtgtccccaccatggcctggatgatgcttctcctcggactccttgcttatggatcaggagtggattctgagactgtggtgacccaggagccgtcgttctccgtgtcccctggagagacagtcacactcacttgtggcttgagctctggctacagtctctcgtggttactcccctnttggtaccagcagaccccaggccaggctccacgcatgctcatgtacagcacaaacattcgcacttctggggtcccccctgatcgcttctctggctccatcccttagggaacaagctcgccctnaccancgacggggcccaggcagatgatgaatctctattattactgtgcactgctatttgcgtgntgtcaattattggttgttcggcggngggaccaagctgaccgtcttaggtcaagaaccccg

SEQ ID NO: 308675 - DNA, 526 bp, Homo sapiens
  misc_feature: GZ8MTXP01EWBB9.8.4.A04.1.454.CMB.2.raw
  modified_base (344)..(344): a, c, t, g, unknown or other
  misc_feature (344)..(344): n is a, c, g, or t
  modified_base (466)..(466): a, c, t, g, unknown or other
  misc_feature (466)..(466): n is a, c, g, or t
  modified_base (487)..(487): a, c, t, g, unknown or other
  misc_feature (487)..(487): n is a, c, g, or t
tcagctcgcgtgtccacgaccggtgctcgatttagagtagtgatcagggggaaaaggccctgaggaaaacaaaccccagctgggaagcctgagaacacttagccttcatgagtgtccccaccatggcctggatgatgcttctcctcggactccttgcttatggatcaggagtggattctgagactgtggtgacccaggagccgtcgttctccgtgtcccctggagagacagtcacactcacttgtggcttgagctctggctcagtctctcgtggttacctccccctcttggtaccagcagaccccaggccaggctccacgcatgctcatgtacagccacaaacntcgcaacttcgtcggggtccctgactcgcttctctggcctccatccgttagggaacaaagctcgccctcaccatccgacgggggccccaggggctaagatgatgaatctcatttattactgngcacttgcttagttgcgttgnttgtaactattaagtgtggttcggcggttaaggggaacc

SEQ ID NO: 308676 - DNA, 530 bp, Homo sapiens
  misc_feature: GZ8MTXP01ECWXZ.8.4.A04.1.454.CMB.2.raw
  modified_base (285)..(285): a, c, t, g, unknown or other
  misc_feature (285)..(285): n is a, c, g, or t
  modified_base (325)..(325): a, c, t, g, unknown or other
  misc_feature (325)..(325): n is a, c, g, or t
  modified_base (343)..(343): a, c, t, g, unknown or other
  misc_feature (343)..(343): n is a, c, g, or t
tcagctcgcgtgtccacgaccggtgctcgatttagagtagtgatcagggggaaaaggccctgaggaaaacaaaccccagctgggaagcctgagaacacttagccttcatgagtgtccccaccatggcctggatgatgcttctcctcggactccttgcttatggatcaggagtggattctgagactgtggtgacccaggagccgtcgttctccgtgtcccctggagagacagtcacactcacttgtggcttgagctctggctcagtctctcgtgttacctcccctnttggtaccagcacgaccccaggccagctccacgcatgctnatgtacagcccacaaacnttcgctaacttcgtcggggtccctgactcgtcttctcgtcgctccattccgtagggaacaagctcgccctcaccatcgacggggcccagggggcagatgatgactctactattattactgtgcacttgacttagttgcgttgagttcgtaataagttgtggtcggttcggggcggaaggggtaaccg

SEQ ID NO: 308677 - DNA, 557 bp, Homo sapiens
  misc_feature: GZ8MTXP01EBNQ2.8.4.A04.1.454.CMB.2.raw
  modified_base (288)..(288): a, c, t, g, unknown or other
  misc_feature (288)..(288): n is a, c, g, or t
  modified_base (426)..(426): a, c, t, g, unknown or other
  misc_feature (426)..(426): n is a, c, g, or t
  modified_base (488)..(488): a, c, t, g, unknown or other
  misc_feature (488)..(488): n is a, c, g, or t
tcagctcgcgtgtccacgaccggtgctcgatttagagtagtgatcagggggaaaaggccctgaggaaaacaaaccccagctgggaagcctgagaacacttagccttcatgagtgtccccaccatggcctggatgatgcttctcctcggactccttgcttatggataaggagtggattctgagactgtggtgacccaggagccgtcgttctccgtgtcccctggagagacagtcacactcacttgtggcttgagctctggctcagtctctcgtcggttacctccccctnttggtaccagcagaccccaggccaggctccacgcatcgctcatgtacagcaaccaaactattcgctacttcgtcggggtccctgactcgtctttctctggctccattccgttagggaaacctaaggccttcgcccctnacccagtacccgacgggggccccagggccaagataggattgaactctcaattttctatggtnctaactcgctgttgcgttgttagttgttacttaattgtggttcgggtcgggacgggtaacggaactaag

SEQ ID NO: 308678 - DNA, 516 bp, Homo sapiens
  misc_feature: GZ8MTXP01E3IVO.8.4.A04.1.454.CMB.2.raw
  modified_base (267)..(267): a, c, t, g, unknown or other
  misc_feature (267)..(267): n is a, c, g, or t
  modified_base (381)..(381): a, c, t, g, unknown or other
  misc_feature (381)..(381): n is a, c, g, or t
  modified_base (455)..(455): a, c, t, g, unknown or other
  misc_feature (455)..(455): n is a, c, g, or t
  modified_base (458)..(458): a, c, t, g, unknown or other
  misc_feature (458)..(458): n is a, c, g, or t
  modified_base (474)..(474): a, c, t, g, unknown or other
  misc_feature (474)..(474): n is a, c, g, or t
  modified_base (479)..(479): a, c, t, g, unknown or other
  misc_feature (479)..(479): n is a, c, g, or t
tcagctcgcgtgtccacgaccggtgctcgatttagagtagtgatcagggggaaaaggccctgaggaaaacaaaccccagctgggaagcctgagaacacttagccttcatgagtgtccccaccatggcctggatgatgcttctcctcggactccttgcttatggatcaggagtggattctgagactgtggtgacccaggagccgtcgttctccgtgtcccctggagagacagtcacactcacttgtggcttgagctctggctcagtcnctcgtggttacctcccctcttggtaccagcacgaccccaggccaggctccacgcatgctcatgtacagcccaacaaacattcgctaacttctgggggtcccctgactcgcttcnctgctcatccttagggaacaagctgccctcacatcgacggggcccaggggcagatgatgaatctcattattacngtncacttgcttagtttgngttgnttgtaatattgtggtcggttcggaacggaacggaacg

SEQ ID NO: 308679 - DNA, 521 bp, Homo sapiens
  misc_feature: GZ8MTXP01ETWVS.8.4.A04.1.454.CMB.2.raw
  modified_base (384)..(384): a, c, t, g, unknown or other
  misc_feature (384)..(384): n is a, c, g, or t
  modified_base (419)..(419): a, c, t, g, unknown or other
  misc_feature (419)..(419): n is a, c, g, or t
  modified_base (465)..(465): a, c, t, g, unknown or other
  misc_feature (465)..(465): n is a, c, g, or t
  modified_base (467)..(467): a, c, t, g, unknown or other
  misc_feature (467)..(467): n is a, c, g, or t
  modified_base (469)..(469): a, c, t, g, unknown or other
  misc_feature (469)..(469): n is a, c, g, or t
  modified_base (471)..(471): a, c, t, g, unknown or other
  misc_feature (471)..(471): n is a, c, g, or t
  modified_base (484)..(484): a, c, t, g, unknown or other
  misc_feature (484)..(484): n is a, c, g, or t
  modified_base (487)..(487): a, c, t, g, unknown or other
  misc_feature (487)..(487): n is a, c, g, or t
tcagctcgcgtgtccacgaccggtgctcgatttagagtagtgatcagggggaaaaggccctgaggaaaacaaaccccagctgggaagcctgagaacacttagccttcatgagtgtccccaccatggcctggatgatgcttctcctcggactccttgcttatggatcaggagtggattctgagactgtggtgacccaggagccgtcgttctccgtgtcccctggagagacagtcacactcacttgtggcttgagctctggctcagtctctcgtggttacctccccctcttggtaccagcacgaccccaggccaggctccacgcatgctcatgtacagccaacaaaacattccgctaacttctgggggtcccctggatcgctttcnctggctcatcctaggaacaaagctgccctcaccancgacgggggcccaggggcagatgatgaatctactattattactgtncncntnttgtgtgttgttnttntaatattaagtgtggttcggtcgggaacggaacg

SEQ ID NO: 308680 - DNA, 567 bp, Homo sapiens
  misc_feature: GZ8MTXP01BSU8I.8.4.A04.1.454.CMB.2.raw
  modified_base (254)..(254): a, c, t, g, unknown or other
  misc_feature (254)..(254): n is a, c, g, or t
  modified_base (435)..(435): a, c, t, g, unknown or other
  misc_feature (435)..(435): n is a, c, g, or t
  modified_base (453)..(453): a, c, t, g, unknown or other
  misc_feature (453)..(453): n is a, c, g, or t
tcagctcgcgtgtccacgaccggtgctcgatttagagtagtgatcagggggggaagcctgagaacacttagccttcatgagtgtccccaccatggcctggatgatgcttctcctcggactccttgcttatggatcaggagtggattctgagactgtggtgacccaggagccgtcgttctccgtgtcccctggagagacagtcacactcacttgtggcttgagctctggctcagtctctcgtgttacctcccctntgtaccagcacgacccaggccaggcctccacgcatgctcatgtacagacaacaaacattcgctacttcgtggggtcccccctgactcgtcttctctcggctccatccgttagggaaacaagctcgccctacaccagtcgacggggcccaggcagatgatgaatctactatttattactgtncactgacttagtttcggngtagtataagttaacttaaagttgttcgggttacgggtaccggggacggggaacgggaccgtaaggtccgttaaccggtacccggtccggttacggtcccgaaccggtaacccg

SEQ ID NO: 308681 - DNA, 505 bp, Homo sapiens
  misc_feature: GZ8MTXP01BIRTN.8.4.A04.1.454.CMB.2.raw
  modified_base (254)..(254): a, c, t, g, unknown or other
  misc_feature (254)..(254): n is a, c, g, or t
  modified_base (260)..(260): a, c, t, g, unknown or other
  misc_feature (260)..(260): n is a, c, g, or t
  modified_base (377)..(377): a, c, t, g, unknown or other
  misc_feature (377)..(377): n is a, c, g, or t
  modified_base (427)..(427): a, c, t, g, unknown or other
  misc_feature (427)..(427): n is a, c, g, or t
  modified_base (441)..(441): a, c, t, g, unknown or other
  misc_feature (441)..(441): n is a, c, g, or t
  modified_base (444)..(444): a, c, t, g, unknown or other
  misc_feature (444)..(444): n is a, c, g, or t
  modified_base (446)..(446): a, c, t, g, unknown or other
  misc_feature (446)..(446): n is a, c, g, or t
tcagctcgcgtgtccacgaccggtgctcgatttagagtagtgatcagggggggaagcctgagaacacttagccttcatgagtgtccccaccatggcctggatgatgcttctcctcggactccttgcttatggatcaggagtggattctgagactgtggtgacccaggagccgtcgttctcccgtgtcccctggagagacagtcacactcacttgtggcttgagctctggctcagtctctcgtgttactcccctntgtacngcacgacccagccagctccacgcatgctcatgtaacagcaacaaaacattcgctacttcgtcggggtccccctgatcgcttctctggctccatccttgggaaacaaagctcgccctnaccatcgacggggcccagggcagatgatgaatctactatttattactgtncactgctatttggntgntntattattgttgtggtcgggcggacggacaagcgtcgtaccgtcgttacgtcgaacgccg

SEQ ID NO: 308682 - DNA, 594 bp, Homo sapiens
  misc_feature: GZ8MTXP01A74FA.8.4.A04.1.454.CMB.2.raw
  modified_base (253)..(253): a, c, t, g, unknown or other
  misc_feature (253)..(253): n is a, c, g, or t
  modified_base (313)..(313): a, c, t, g, unknown or other
  misc_feature (313)..(313): n is a, c, g, or t
  modified_base (496)..(496): a, c, t, g, unknown or other
  misc_feature (496)..(496): n is a, c, g, or t
tcagctcgcgtgtccacgaccggtgctcgatttagagtagtgatcagggggggaagcctgagaacacttagccttcatgagtgtccccaccatggcctggatgatgcttctcctcggactccttgcttatggatcaggagtggattctgagactgtggtgacccaggagccgtcgttctccgtgtccctggagagacagtcacactcacttgtggcttgagctctggctcagtctctcgtgttacctcccctnttggtaccagcacgaccccaggccaggcctccacgcatcgctcatgtacagcaacaaacncttcgctacttcgtcggggtccccctggactcgtcttctctcgggcctcctacgttcccgttaggggaaacctaaacggcctccgcccctacaccacgtccggaccgggggcccaagggcaagatgatagaatctacgtatttattactgtacgctacgtgtaccttagttcggacgttggtntaaggttacttaaagtttcgttgggttacggttcggggacgggttacgggacctaaggtccgtcggtaacccgtccgttaggccgttaacggccccgg

SEQ ID NO: 308683 - DNA, 509 bp, Homo sapiens
  misc_feature: GZ8MTXP01C7BW7.8.4.A04.1.454.CMB.2.raw
  modified_base (448)..(448): a, c, t, g, unknown or other
  misc_feature (448)..(448): n is a, c, g, or t
  modified_base (456)..(456): a, c, t, g, unknown or other
  misc_feature (456)..(456): n is a, c, g, or t
tcagctcgcgtgtccacgaccggtgctcgatttagagtagtgatcaggggggaagcctgagaacacttagccttcatgagtgtccccaccatggcctggatgatgcttctcctcggactccttgcttatggatcaggagtggattctgagactgtggtgacccaggagccgtcgttctccgtgtcccctggagagacagtcacactcacttgtggcttgagctctggctcagtctctcgtggttactccccctcttggtaccagcagaccccaggccaggctccacgcatgctcatgtacagcaacaaacattcgcacttctcgggggtccccctgatcgcttctctgctccatccttagggaacaaagctcgccctcaccatcgacggggcccaaggcagatgatgaatctcatttattactgtgcactgctatttgcgtgaatgtnttaattangttggttcgggaggcgggaccaaaggtctgaccgtcttaggtcaacgaacccg

SEQ ID NO: 308684 - DNA, 565 bp, Homo sapiens
  misc_feature: GZ8MTXP01AB78V.8.4.A04.1.454.CMB.2.raw
  modified_base (288)..(288): a, c, t, g, unknown or other
  misc_feature (288)..(288): n is a, c, g, or t
  modified_base (468)..(468): a, c, t, g, unknown or other
  misc_feature (468)..(468): n is a, c, g, or t
  modified_base (474)..(474): a, c, t, g, unknown or other
  misc_feature (474)..(474): n is a, c, g, or t
  modified_base (525)..(525): a, c, t, g, unknown or other
  misc_feature (525)..(525): n is a, c, g, or t
tcagctcgcgtgtccacgaccggtgctcgatttagagtagtgatcagggggaaaaggccctgaggaaaacaaaccccagctgggaagcctgagaacacttagccttcatgagtgtccccaccatggcctggatgatgcttctcctcggactccttgcttatggatcaggagtggattctgagactgtggtgacccaggagccgtcgttctccgtgtcccctggagagacagtcacactcacttgtggcttgagctctggctcagtctctcgtcggttacctccccctnttcggtaccagccacgaccccaggcccaggcctccacgcatcgctcattcgacagcccaacaaactattccgctaacgttcgtcggggtccctggactccgtcttctcgtcggctccattccgttagggaaacaacgctcgccctacaccacgtccggaccgggggcccagggggcaggntgagtnaatctactatttacttacgtgttcgcctagttgtcttagtttgcgttgttnttgtaactaattgtgtcggttacgggcgggaacggaaccg

SEQ ID NO: 308685 - DNA, 541 bp, Homo sapiens
  misc_feature: GZ8MTXP01BSU1E.8.4.A04.1.454.CMB.2.raw
  modified_base (502)..(502): a, c, t, g, unknown or other
  misc_feature (502)..(502): n is a, c, g, or t
tcagctcgcgtgtccacgaccggtgctcgatttagagtagtgatcagggggaaaaggccctgaggaaaacaaaccccagctgggaagcctgagaacacttagccttcatgagtgtccccaccatggcctggatgatgcttctcctcggactccttgcttatggatcaggagtggattctgagactgtggtgacccaggagccgtcgttctccgtgtcccctggagagacagtcacactcacttgtggcttgagctctggctcagtctctcgtggttacctccccctcttcggtaccagcacgacccccaggcccaggcctccacgcatgctcatgtacagacccaacaaacattccgctaacctttcgtcgggggtcccctgactccgctttctctcgctccatccgttagggaacaagctcgccctcaccatccgacgggggcccagggggcaggatgatgaatctactattattactgtgcacttgcttagttgcgttgnttgtaactaattgtgtggttcgggcggttaagggaaccg

SEQ ID NO: 308686 - DNA, 539 bp, Homo sapiens
  misc_feature: GZ8MTXP01DJMNX.8.4.A04.1.454.CMB.2.raw
  modified_base (346)..(346): a, c, t, g, unknown or other
  misc_feature (346)..(346): n is a, c, g, or t
  modified_base (489)..(489): a, c, t, g, unknown or other
  misc_feature (489)..(489): n is a, c, g, or t
tcagctcgcgtgtccacgaccggtgctcgatttagagtagtgatcagggggaaaaggccctgaggaaaacaaaccccagctgggaagcctgagaacacttagccttcatgagtgtccccaccatggcctggatgatgcttctcctcggactccttgcttatggatcaggagtggattctgagactgtggtgacccaggagccgtcgttctccgtgtcccctggagagacagtcacactcacttgtggcttgagctctggctcagtctctcgtgttacctcccctcttcggtaccagcacgaccccaggccaggctccacgcatgctcatgtacagcccaacaaacnttcgctaacttcgtggggtccctgactcgcttctctcgctcatcgtaggaacaacgctcgccctcacacgtcgacggggcccagggggcaggatgatgaatctactattagttactgtgctacttgacttagtttgcgttagnttgttaataaatttgttggttcggttccgggcgggttaacggggtaaccg

SEQ ID NO: 308687 - DNA, 543 bp, Homo sapiens
  misc_feature: GZ8MTXP01DO426.8.4.A04.1.454.CMB.2.raw
  modified_base (350)..(350): a, c, t, g, unknown or other
  misc_feature (350)..(350): n is a, c, g, or t
  modified_base (501)..(501): a, c, t, g, unknown or other
  misc_feature (501)..(501): n is a, c, g, or t
tcagctcgcgtgtccacgaccggtgctcgatttagagtagtgatcagggggaaaaggccctgaggaaaacaaaccccagctgggaagcctgagaacacttagccttcatgagtgtccccaccatggcctggatgatgcttctcctcggactccttgcttatggatcaggagtggattctgagactgtggtgacccaggagccgtcgttctccgtgtcccctggagagacagtcacactcacttgtggcttgagctctggctcatctctcgtcggttacctccccctcttcggtaccagccacgaccccaggccacggctccacgcatgctcatgtacagacccacaaacnttcgctaaccttcgtcgggggtccctggactcgcttctctggcctccatccgtaggaacaagctcgccctcaccagtccgaccgggggcccagggggcagatagatgaactctactatttatatgtgcacttgtcttagtttcgcgttagnttgtaactattaagtcgtggttcggcgggttaacgggaaccg

SEQ ID NO: 308688 - DNA, 579 bp, Homo sapiens
  misc_feature: GZ8MTXP01BWOT8.8.4.A04.1.454.CMB.2.raw
  modified_base (259)..(259): a, c, t, g, unknown or other
  misc_feature (259)..(259): n is a, c, g, or t
  modified_base (304)..(304): a, c, t, g, unknown or other
  misc_feature (304)..(304): n is a, c, g, or t
tcagctcgcgtgtccacgaccggtgctcgatttagagtagtgatcagggggggaagcctgagaacacttagccttcatgagtgtccccaccatggcctggatgatgcttctcctcggactccttgcttatggatcaggagtggattctgagactgtggtgacccaggagccgtcgttctccgtgtcccctggagagacagtcacactcacttgtggcttgagctcgtggctcagttctctcgttcgttacctccccctnttcggtaccagcacgaccccaggccaggcctccacgcagtcgctnatcgtacagacaacaactattccgctacgttcgtcggggtccccctgactcgtcttctctcgctcagtccgtaggaacaacgctacgccctacaccagtccggaccgggccagggcaggactgatgaaattcctataattttacttaccgtgtacgcctagtcgtacttatttggcgttagtcttaagtaacttaagttaggttggttcgggtcgggacggttacgggacctaagtcgtaacggtaccgtcgttacgggtccttaacggaacccg

SEQ ID NO: 308689 - DNA, 522 bp, Homo sapiens
  misc_feature: GZ8MTXP01EO93B.8.4.A04.1.454.CMB.2.raw
  modified_base (383)..(383): a, c, t, g, unknown or other
  misc_feature (383)..(383): n is a, c, g, or t
  modified_base (475)..(475): a, c, t, g, unknown or other
  misc_feature (475)..(475): n is a, c, g, or t
  modified_base (480)..(480): a, c, t, g, unknown or other
  misc_feature (480)..(480): n is a, c, g, or t
  modified_base (486)..(486): a, c, t, g, unknown or other
  misc_feature (486)..(486): n is a, c, g, or t
tcagctcgcgtgtccacgaccggtgctcgatttagagtagtgatcagggggaaaaggccctgaggaaaacaaaccccagctgggaagcctgagaacacttagccttcatgagtgtccccaccatggcctggatgatgcttctcctcggactccttgcttatggatcaggagtggattctgagactgtggtgacccaggagccgtcgttctccgtgtcccctggagagacagtcacactcacttgtggcttgagctctggctcagtctctcgtggttacctccccctcttcggtaccagccagacccccaggcccaggcctccacgcatgctcatgtacagcccacaaacattcgcaacttcgtcggggtccctgatcgcttcnctgctccatcctggaacaagctcgccctcaccatcgacggggcccaggggcagatgatgatctctatttatactgtgcacttgcttagttgngttgnttcgtntaatttaatggtcggttcgggcggttaagggaaccg

SEQ ID NO: 308690 - DNA, 533 bp, Homo sapiens
  misc_feature: GZ8MTXP01EF6OX.8.4.A04.1.454.CMB.2.raw
  modified_base (287)..(287): a, c, t, g, unknown or other
  misc_feature (287)..(287): n is a, c, g, or t
  modified_base (415)..(415): a, c, t, g, unknown or other
  misc_feature (415)..(415): n is a, c, g, or t
  modified_base (462)..(462): a, c, t, g, unknown or other
  misc_feature (462)..(462): n is a, c, g, or t
  modified_base (485)..(485): a, c, t, g, unknown or other
  misc_feature (485)..(485): n is a, c, g, or t
tcagctcgcgtgtccacgaccggtgctcgatttagagtagtgatcagggggaaaaggccctgaggaaaacaaaccccagctgggaagcctgagaacacttagccttcatgagtgtccccaccatggcctggatgatgcttctcctcggactccttgcttatggatcaggagtggattctgagactgtggtgacccaggagccgtcgttctccgtgtcccctggagagacagtcacactcacttgtggcttgagctctggctcagtctctcgtggttacctccccctnttggtaccagcacgaccccaggccaggctccacgcatgctcatgtacagccaacaaacattcgctaacttctcggggtccctgactcgcttctctgctcatcctagggaacaagctcgccctcaccancgacggggcccaggggcagatgatgaactctactattattactgtcnctacttgtcttagtttgcgttgnttcgtaactaatttaagtggtggttcgggcgggttaacgggtaacccg

SEQ ID NO: 308691 - DNA, 511 bp, Homo sapiens
  misc_feature: GZ8MTXP01ECHZZ.8.4.A04.1.454.CMB.2.raw
  modified_base (253)..(253): a, c, t, g, unknown or other
  misc_feature (253)..(253): n is a, c, g, or t
  modified_base (426)..(426): a, c, t, g, unknown or other
  misc_feature (426)..(426): n is a, c, g, or t
  modified_base (441)..(441): a, c, t, g, unknown or other
  misc_feature (441)..(441): n is a, c, g, or t
  modified_base (443)..(443): a, c, t, g, unknown or other
  misc_feature (443)..(443): n is a, c, g, or t
tcagctcgcgtgtccacgaccggtgctcgatttagagtagtgatcagggggggaagcctgagaacacttagccttcatgagtgtccccaccatggcctggatgatgcttctcctcggactccttgcttatggatcaggagtggattctgagactgtggtgacccaggagccgtcgttctccgtgtcccctggagagacagtcacactcacttgtggcttgagctctggctcagtctctcgtgttactcccctnttggtaccagcagaccccaggccaggctccacgcatgctcatgtacagcaacaaacattcgctacttcgtcggggtccccctgatcgcttctctgctcatcctagggaacaagctacgccctcaccactcgaccggggcccaggcagatgatgaatctactattattactgtncactgctattgctgntntcttattagttgtggttcgggcggagggaccaagtctcggtaccgtcgaacggtccgaacgaacccgg

SEQ ID NO: 308692 - DNA, 527 bp, Homo sapiens
  misc_feature: GZ8MTXP01AGM4W.8.4.A04.1.454.CMB.2.raw
  modified_base (254)..(254): a, c, t, g, unknown or other
  misc_feature (254)..(254): n is a, c, g, or t
  modified_base (473)..(473): a, c, t, g, unknown or other
  misc_feature (473)..(473): n is a, c, g, or t
tcagctcgcgtgtccacgaccggtgctcgatttagagtagtgatcagggggggaagcctgagaacacttagccttcatgagtgtccccaccatggcctggatgatgcttctcctcggactccttgcttatggatcaggagtggattctgagactgtggtgacccaggagccgtcgttctccgtgtcccctggagagacagtcacactcacttgtggcttgagctctggctcagtctctcgtgttactccccctnttggtaccagcacgaccccaggccaggctccacgcatgctcatgtacagcaacaaacattcgctacttcgtcggggtcccccctgatcgtcttctctggctccatccgtagggaacaagctcgccctcaccagtccgaccgggggcccaggcagactgatgaactctactattacttactgtgcacgtgtctagtttgcgttgattgtacttaaagttnttggtgttcgggacggacggaccaagcgtcgaccgtcgttaggtcgcgaacccg

SEQ ID NO: 308693 - DNA, 577 bp, Homo sapiens
  misc_feature: GZ8MTXP01DTWXS.8.4.A04.1.454.CMB.2.raw
  modified_base (285)..(285): a, c, t, g, unknown or other
  misc_feature (285)..(285): n is a, c, g, or t
  modified_base (349)..(349): a, c, t, g, unknown or other
  misc_feature (349)..(349): n is a, c, g, or t
  modified_base (499)..(499): a, c, t, g, unknown or other
  misc_feature (499)..(499): n is a, c, g, or t
  modified_base (526)..(526): a, c, t, g, unknown or other
  misc_feature (526)..(526): n is a, c, g, or t
tcagctcgcgtgtccacgaccggtgctcgatttagagtagtgatcagggggaaaaggccctgaggaaaacaaaccccagctgggaagcctgagaacacttagccttcatgagtgtccccaccatggcctggatgatgcttctcctcggactccttgcttatggatcaggagtggattctgagactgtggtgacccaggagccgtcgttctccgtcgtcccctggagagacagtcacactcacttgtgcttgagctctggctcagtctctcgtgttacctcccctnttcgtaccagcacgaccccaggccacggcctccacgcatgctcatgtacagacccaacaaactnttccgctaaccttcgtcggggtcccctggacttccgtctttctcgtcgccttccattccgtagggaaacaaacgcctcgccctacaccacgtccggaccgggggcccagggggcaggtatcggatagtacttctactatttattactgtnctattcgtcttagtttcgcgttagttnttacgtaattaaagttgttggtcggttcgggaacgggttaacgggtaaccg

SEQ ID NO: 308694 - DNA, 623 bp, Homo sapiens
  misc_feature: GZ8MTXP01D2Y94.8.4.A04.1.454.CMB.2.raw
tcagctcgcgtgtccacgaccggtgctcgatttagagtagtgatcagggggaaaagccctgaggaaaacaaaccccagctgggaagcctgagaacacttagccttcatgagtcgtccccaccatggcctggatgatgcttctcctcggactccttgcttatggatcaggagtggattctgagactggtggtcgacccgaggacgtccgttcgttctccggtcgtcccctggagagacagtcacactcacttggtgcttgagtctcgtggctcgtagtctctcgttcggttacctccccctgttcggtaccagcacgaccccgaggccaggcctaccgacgcatcgctcgatacgacacgacccaaacaaaactctttccgacctaaccgtttcgtcggggttccctggtacctcgtcttcgtcgtcgcctaccacttccgtagggaaacaacgtcctcgtccctacgaccgcgtacccggaccgggggacccagggggaccaaggtactaggaatacgtaacttcgtactaactttattacgtgttcgaacctagttgtcttagtttcgcgttgttacttgtaatagttaagtcggtggttacgggaacgggaacggtaaccg

SEQ ID NO: 308695 - DNA, 578 bp, Homo sapiens
  misc_feature: GZ8MTXP01A7PAN.8.4.A04.1.454.CMB.2.raw
  modified_base (256)..(256): a, c, t, g, unknown or other
  misc_feature (256)..(256): n is a, c, g, or t
tcagctcgcgtgtccacgaccggtgctcgatttagagtagtgatcaggggggggaagcctgagaacacttagccttcatgagtgtccccaccatggcctggatgatgcttctcctcggactccttgcttatggatcaggagtggattctgagactggtggtgacccaggagccgtcgttctccgtgtcccctggagagacagtcacactcacttgtggcttgagctctggctcagtctctcgtcgttactcccctntgtacagcacgacccagccaggcctccacgcatcgctcatgtaacacgacaacaaactattcgactacttcgtcggggtccccctgtatcgtcttcgtctcggtcctcctacgttccgttagggaaacaacgccttcgcccctacaccagtccggaccgggggcccagggtacagatgatagaacttctagtatttacttagtgtacgcacgtgacttagttgcgtagtattgttaattaaagtttgttggtcgggttacgggacgggttacggacgtaacgtcgtaacggtaccgtcgttacggtccaacggtaaccccgg

SEQ ID NO: 308696 - DNA, 584 bp, Homo sapiens
  misc_feature: GZ8MTXP01EE95Q.8.4.A04.1.454.CMB.2.raw
  modified_base (359)..(359): a, c, t, g, unknown or other
  misc_feature (359)..(359): n is a, c, g, or t
  modified_base (516)..(516): a, c, t, g, unknown or other
  misc_feature (516)..(516): n is a, c, g, or t
  modified_base (543)..(543): a, c, t, g, unknown or other
  misc_feature (543)..(543): n is a, c, g, or t
tcagctcgcgtgtccacgaccggtgctcgatttagagtagtgatcagggggaaaaggccctgaggaaaacaaaccccagctgggaagcctgagaacacttagccttcatgagtgtccccaccatggcctggatgatgcttctcctcggactccttgcttatggatcaggagtggattctgagactgtggtgacccaggagccgtcgttctccgtcgtcccctggagagacagtcacactcacttgtggcttgagctctggctcagtctctcgtcggttacctcccccttcgttcggtacccagccacgacccccgaggcccaggcctccacgcatcgctcatgtacagcccaacaaacnttccgcctaactttccgtcgggggtcccctggacttccgctttctcgtcggtcctcctacttccgttagggaaaccaaagtcctcgcccctcaaccacgtacggacccgggggaccacgggggacagtatcgatagaatctactattatactggtancacttgtcttagttgcgttagttgttntaataattaagttggtcggttcgggcggttaacggtaaccg

SEQ ID NO: 308697 - DNA, 781 bp, Homo sapiens
  misc_feature: GZ8MTXP01AJGHX.8.4.A04.1.454.CMB.2.raw
tcagctcgcgtgtccacgaccggtgctcgatttagagtagtgatcagggggaaaaggccctgaggaaaacaaaccccagctgggaagcctgagaacacttagccttcatgagtgtccccaccatggcctggatgatgcttctcctcggactccttgcttatggatcaggagtggattctgagactgtggtgacccaggagccgtcgttctccgtgtcccctggagagacagtcacactcacttgtggcttgagctctggctcagtctctcgtcgttaccctccccctgttgtaccagccacgacccccgagccgacggcctccgacgcatcgactcagtacgtacacgacccaaaccaactacgttcccgaccgtaaccgtttccggttccggggtcccctagggtaccttcccgttcctttccgtcgtccggtacccttaccgtaaccgttcccgggttaacggggaaaccctaaacggtcccgtacccggtacccccttaccgtaaccccgaaccggtacccccgggggaaccccggggggaccccctaggggggtaacccgaacgggttaagtaccgggtaacgttaaccggtaaccgtttaccctttaaccgtttaaattttaaccgtttaaccggttcggtcccggtaaccttacggttccgggttaacttagggtttttaccgggtacggttagttacgtttacgttaacgtttaagtttcgggtttcggggttaccggggttaccgggggtaaccggggttaaccgggtaaccg

SEQ ID NO: 308698 - DNA, 603 bp, Homo sapiens
  misc_feature: GZ8MTXP01AN6A3.8.4.A04.1.454.CMB.2.raw
  modified_base (262)..(262): a, c, t, g, unknown or other
  misc_feature (262)..(262): n is a, c, g, or t
  modified_base (325)..(325): a, c, t, g, unknown or other
  misc_feature (325)..(325): n is a, c, g, or t
tcagctcgcgtgtccacgaccggtgctcgatttagagtagtgatcagggggggaagcctgagaacacttagccttcatgagtgtccccaccatggcctggatgatgcttctcctcggactccttgcttatggatcaggagtggattctgagactgtggtgacccaggagccgtcgttctccgtgtcccctggagagacagtcacactcacttgtgcttgagcttcgtggctcagttctctcggttcggttacctcccccttnttcggtaccagccacgaccccaggccacggctccacgcatcgctcatgtacagcaacaaactntcgctacttcgtcggtccctgatcgtcttctcgtcgtcctccgtacttaccgttacgggaaactaacgctacccgccctacaccgacgtccggaccgggggacccagggcagataggatagaacttctacgtatttagttactgtcgactactggtacttagtttcggcgttagtattcggtaacttagtttagttgggttcgggtttcggggacgggttacggttaaccgaagtcgtaaccggtaacccgtcgttaacggtccgaacggtaaccccg

SEQ ID NO: 308699 - DNA, 541 bp, Homo sapiens
  misc_feature: GZ8MTXP01BUXU5.8.4.A04.1.454.CMB.2.raw
  modified_base (254)..(254): a, c, t, g, unknown or other
  misc_feature (254)..(254): n is a, c, g, or t
  modified_base (259)..(259): a, c, t, g, unknown or other
  misc_feature (259)..(259): n is a, c, g, or t
  modified_base (267)..(267): a, c, t, g, unknown or other
  misc_feature (267)..(267): n is a, c, g, or t
  modified_base (273)..(273): a, c, t, g, unknown or other
  misc_feature (273)..(273): n is a, c, g, or t
  modified_base (279)..(279): a, c, t, g, unknown or other
  misc_feature (279)..(279): n is a, c, g, or t
  modified_base (302)..(302): a, c, t, g, unknown or other
  misc_feature (302)..(302): n is a, c, g, or t
  modified_base (431)..(431): a, c, t, g, unknown or other
  misc_feature (431)..(431): n is a, c, g, or t
  modified_base (452)..(452): a, c, t, g, unknown or other
  misc_feature (452)..(452): n is a, c, g, or t
tcagctcgcgtgtccacgaccggtgctcgatttagagtagtgatcagggggggaagcctgagaacacttagccttcatgagtgtccccaccatggcctggatgatgcttctcctcggactccttgcttatggatcaggagtggattctgagactgtggtgacccaggagccgtcgttctccgtgtcccctggagagacagtcacactcacttgtggcttgagctctggctcagtctatcgtcgttactcccctntgacngcagcccngcagcnccacgnatgctcatgacagacaacaaacnttcgctacgttcgtcggggtccccctgactcgtcttctctgctccatccgtagggaacaagctcgccctcaccacgtccggaccgggggcccagggcagatgatgaattctactatttacttactggtnctacgtgctagtttgcgttgnttgtacttaagtttgttcgggttaggttcggggacggttacggacccgaagtccgtcggaacccgtcgttacggtccaacggaaccccg

SEQ ID NO: 308700 - DNA, 593 bp, Homo sapiens
  misc_feature: GZ8MTXP01APFE0.8.4.A04.1.454.CMB.2.raw
  modified_base (285)..(285): a, c, t, g, unknown or other
  misc_feature (285)..(285): n is a, c, g, or t
  modified_base (351)..(351): a, c, t, g, unknown or other
  misc_feature (351)..(351): n is a, c, g, or t
  modified_base (542)..(542): a, c, t, g, unknown or other
  misc_feature (542)..(542): n is a, c, g, or t
tcagctcgcgtgtccacgaccggtgctcgatttagagtagtgatcagggggaaaaggccctgaggaaaacaaaccccagctgggaagcctgagaacacttagccttcatgagtgtccccaccatggcctggatgatgcttctcctcggactccttgcttatggatcaggagtggattctgagactgtggtgacccaggagccgtcgttctccgtgtcccctggagagacagtcacactcacttgtgcttgagctctggctcagtctctcgtcgttacctcccctnttcggtaccagcacgaccccaggccaggcctccacgcatgctcatcgtacacgacccaacaaactnttccgctaaccgttcgtcggggtccctgactccgtcttctcgtcggccttaccacttccgttagggaaaccaaacggtcctccgccctaccaccgtacgtccggaccgggggccccaagggggacctaggactggaatcgaacttcctactatttactacgtgtcgcacgttgtcttagttcgcgttgttnttcgtaatagttcgttggtacgggttccgggtaacgggttaacggtaaccg

SEQ ID NO: 308701 - DNA, 600 bp, Homo sapiens
  misc_feature: GZ8MTXP01C6ADF.8.4.A04.1.454.CMB.2.raw
  modified_base (257)..(257): a, c, t, g, unknown or other
  misc_feature (257)..(257): n is a, c, g, or t
  modified_base (318)..(318): a, c, t, g, unknown or other
  misc_feature (318)..(318): n is a, c, g, or t
tcagctcgcgtgtccacgaccggtgctcgatttagagtagtgatcagggggggaagcctgagaacacttagccttcatgagtgtccccaccatggcctggatgatgcttctcctcggactccttgcttatggatcaggagtggattctgagactgtggtgacccaggagccgtcgttctccgtgtcccctggagagacagtcacactcacttgtggcttgagctctggctcagtctctcgttcgttacctccccctnttcggtaccagcaacgaccccaggccaggcctccacgcatgctcatgacagacaacaaacncttcgctacgttcgtcggggtccccctgactcgtcttctctgcctctactccgttagggaacaagctcgccctcaccacgtccggaccggggcccagggacagagtgaatcgaaacttccttacttaagtttaacttacgtgttcgctaccgtggtacttagtttccgagttggattaacggttattaaagtttgttcgggttacgggttcggggacgggacgggttaacctaaggtccgtaacggtacccggtcgttacggtaaccgaacggtaaccccgg

SEQ ID NO: 308702 - DNA, 569 bp, Homo sapiens
  misc_feature: GZ8MTXP01BOMOF.8.4.A04.1.454.CMB.2.raw
  modified_base (285)..(285): a, c, t, g, unknown or other
  misc_feature (285)..(285): n is a, c, g, or t
  modified_base (347)..(347): a, c, t, g, unknown or other
  misc_feature (347)..(347): n is a, c, g, or t
  modified_base (389)..(389): a, c, t, g, unknown or other
  misc_feature (389)..(389): n is a, c, g, or t
tcagctcgcgtgtccacgaccggtgctcgatttagagtagtgatcagggggaaaaggccctgaggaaaacaaaccccagctgggaagcctgagaacacttagccttcatgagtgtccccaccatggcctggatgatgcttctcctcggactccttgcttatggatcaggagtggattctgagactgtggtgacccaggagccgtcgttctccgtgtcccctggagagacagtcacactcacttgtggcttgagctctggctcagtctctcgtgttacctcccctnttgtaccagcacgaccccaggccaggcctccacgcatgctcatgacagacccaaacaaactnttccgctaaaccgttcgtcggggtccctgagtccgtctttcnctcggtctccgtatccgttagggaaacaaagcctacgccctcaccacgtcgaccgggggcccagggggacgagtcgtagatgacttctacctaagttattacgtgtcgcaacttcgacttgttagtcgttagttcttacgtaataagttgttgtcggttacgggaacggttcggaaaccg

SEQ ID NO: 308703 - DNA, 486 bp, Homo sapiens
  misc_feature: GZ8MTXP02I2N0P.8.4.A04.1.454.CMB.2.raw
tcagctcgcgtgtccacgaccggtgctcgatttagagtagtgatcaggggaagcctgagaacacttagccttcatgagtgtcccaccatggcctggatgatgcttctcctcggactccttgcttatggatcaggagtggattctgagactgtggtgacccaggagccgtcgttctccgtgtcccctggagagacagtcacactcacttgtggcttgagctctggctcagtctctcgtggttactcccctcttggtaccagcagaccccaggccaggctccacgcatgctcatgtacagcacaaacattcgcactctggggtccccctgatcgcttctctggctccatccttgggaacaaagctgccctcaccatcacgggggcccaggcagatgatgaaatctcattattactgtgcactgcatttgcgtgatgtcaaattatgtgttcggcggaggaccaagctgaccgtctacggtcagacccg

SEQ ID NO: 308704 - DNA, 517 bp, Homo sapiens
  misc_feature: GZ8MTXP02IMF2A.8.4.A04.1.454.CMB.2.raw
tcagctcgcgtgtccacgaccggtgctcgatttagagtagtgatcagggggaagcctgagaacacttagccttcatgagtgtccccaccatggcctggatgatgcttctcctcggactccttgcttatggatcaggagtggattctgagactgtggtgacccaggagccgtcgttctccgtgtcccctggagagacagtcacactcacttgtggcttgagctctggctcagtctctcgtggttacctccccctcttggtaccagccacgaccccaggcccaggcctccacgcatgctcatgtacagcaacaaacattcgctacttcgtggggtccccctgactcgcttctctggcctccatccgttagggaacaaagctcgccctcaccatcgaccggggcccaggcagatgatgaatctactatttatactgtgctactgctagtttgcgtgatgtactaattagtgtgttcggacggacggacctaagctacgaccgtactacggtcacgacccg

SEQ ID NO: 308705 - DNA, 509 bp, Homo sapiens
  misc_feature: GZ8MTXP02GPDLV.8.4.A04.1.454.CMB.2.raw
  modified_base (374)..(374): a, c, t, g, unknown or other
  misc_feature (374)..(374): n is a, c, g, or t
  modified_base (421)..(421): a, c, t, g, unknown or other
  misc_feature (421)..(421): n is a, c, g, or t
tcagctcgcgtgtccacgaccggtgctcgatttagagtagtgatcagggggaagcctgagaacacttagccttcatgagtgtccccaccatggcctggatgatgcttctcctcggactccttgcttatggatcaggagtggattctgagactgtggtgacccaggagccgtcgttctccgtgtcccctggagagacagtcacactcacttgtggcttgagctctggctcagtctctcgtggttactccccctcttggtaccagcagaccccaggccaggctccacgcatgctcatgtacagcacaaaacattcgcacttctggggtccccctgatcgcttctctggctccatccttgggaacaaagctgccctnaccatcacgggggcccaggcagatgatgaaatctcattattactgtncatgctattgtgtgtatagtataattatgttcggttcggtacggacggacgaacgacgtacgtaccgtaccgtacggtacgacgaccg

SEQ ID NO: 308706 - DNA, 524 bp, Homo sapiens
  misc_feature: GZ8MTXP02HPMTR.8.4.A04.1.454.CMB.2.raw
  modified_base (349)..(349): a, c, t, g, unknown or other
  misc_feature (349)..(349): n is a, c, g, or t
  modified_base (387)..(387): a, c, t, g, unknown or other
  misc_feature (387)..(387): n is a, c, g, or t
  modified_base (471)..(471): a, c, t, g, unknown or other
  misc_feature (471)..(471): n is a, c, g, or t
  modified_base (476)..(476): a, c, t, g, unknown or other
  misc_feature (476)..(476): n is a, c, g, or t
tcagctcgcgtgtccacgaccggtgctcgatttagagtagtgatcagggggaaaaggccctgaggaaaacaaaccccagctgggaagcctgagaacacttagccttcatgagtgtccccaccatggcctggatgatgcttctcctcggactccttgcttatggatcaggagtggattctgagactgtggtgacccaggagccgtcgttctccgtgtcccctggagagacagtcacactcacttgtggcttgagctctggctcagtctctcgtcggttacctccccctcttcggtaccagcacgaccccaggccaggctccacgcatgctcatgtacagcccaacaaacnttccgctacttcgtcgggggtccctgactccgtcttcnctgctccatccgttagggaacaaagctacgccctcaccatcgacggggcccaggcagatgatgaatctactattatactgtacnctatnctgttcgcgtatatagtaatattagtcgtcggtcggacggtacggacg

SEQ ID NO: 308707 - DNA, 524 bp, Homo sapiens
  misc_feature: GZ8MTXP02IHQZ1.8.4.A04.1.454.CMB.2.raw
tcagctcgcgtgtccacgaccggtgctcgatttagagtagtgatcagggggaaaaggccctgaggaaaacaaaccccagctgggaagcctgagaacacttagccttcatgagtgtccccaccatggcctggatgatgcttctcctcggactccttgcttatggatcaggagtggattctgagactgtggtgacccaggagccgtcgttctccgtgtcccctggacagacagtcacactcacttgtggcttgagctctggctcagtctctcgtggttacctccccctcttggtaccagcacgaccccaggcccaggcctccacgcatgctcatgtacagccaacaaacattcgcacttctgggggtccctgactccgtccttctctggcctcattcctgggaacaaagctacgccctcaccatccgaccggggcccaggcagatgatgatctctattattactgtgcacttgcttagttgacgtgtatgtaactaattattgtggtttcgggcggtacggaaccg

SEQ ID NO: 308708 - DNA, 598 bp, Homo sapiens
  misc_feature: GZ8MTXP02IG6IZ.8.4.A04.1.454.CMB.2.raw
  modified_base (264)..(264): a, c, t, g, unknown or other
  misc_feature (264)..(264): n is a, c, g, or t
  modified_base (289)..(289): a, c, t, g, unknown or other
  misc_feature (289)..(289): n is a, c, g, or t
tcagctcgcgtgtccacgaccggtgctcgatttagagtagtgatcagggggaaaaggccctgaggaaaacaaaccccagctgggaagcctgagaacacttagccttcatgagtgtccccaccatggcctggatgatgcttctcctcggactccttgcttatggatcaggagtggattctgagactggtggtgacccaggagccgtcgttctccgtgtcccctggagagacagtcacactcacttgtggcttggagctctggctnagtctctcgtggttacctccccctnttcggtaccagcacgaccccaggccaggcctccacgcatcgctcatcgtaacagcccaacaaaactcttccgctacgttcgtcgggggtccctgactcgcttctctgcctccattccgtaggaaacaagctcgccctacacctagccgaccggggcccaggctagactgatagaatctactatttacttactgtacgtacctacgttgtccttaagttttcggccgttaggtaacttaggttaaccttaaaagttttggttacgggttccggggtttaccggggacgggggtaaacgggtaaaccccgg

SEQ ID NO: 308709 - DNA, 507 bp, Homo sapiens
  misc_feature: GZ8MTXP02JU66K.8.4.A04.1.454.CMB.2.raw
  modified_base (287)..(287): a, c, t, g, unknown or other
  misc_feature (287)..(287): n is a, c, g, or t
tcagctcgcgtgtccacgaccggtgctcgatttagagtagtgatcagggggaaaaggccctgaggaaaacaaaccccagctgggaagcctgagaacacttagccttcatgagtgtccccaccatggcctggatgatgcttctcctcggactccttgcttatggatcaggagtggattctgagactgtggtgacccaggagccgtcgttctccgtgtcccctggagagacagtcacactcacttgtggcttgagctctggctcagtctctcgtggttacctccccctnttggtaccagcacgaccccaggccaggctccacgcatgctcatgtacagccacaaacattcgcacttctggggtccctgactcgcttctctggctccatccttagggaacaaagctcgccctcaccatccgacgggggcccaggcagatgatgaatctacattattactgtgcactgctattgcgtgatgtcaatttatggtgttcggcggacggaaccg

SEQ ID NO: 308710 - DNA, 591 bp, Homo sapiens
  misc_feature: GZ8MTXP02G8SKL.8.4.A04.1.454.CMB.2.raw
  modified_base (291)..(291): a, c, t, g, unknown or other
  misc_feature (291)..(291): n is a, c, g, or t
  modified_base (354)..(354): a, c, t, g, unknown or other
  misc_feature (354)..(354): n is a, c, g, or t
tcagctcgcgtgtccacgaccggtgctcgatttagagtagtgatcagggggaaaaggccctgaggaaaacaaaccccagctgggaagcctgagaacacttagccttcatgagtgtccccaccatggcctggatgatgcttctcctcggactccttgcttatggatcaggagtggattctgagactggtggtgacccaggagccgtcgttctccgtcgtcccctggagagacagtcacactcacttgtggtcttgagctcgtggctcagtctctcgtcgttacctccccctnttcggtaccagcacgaccccaggcccaggcctccacgcatgctcatgtacagaccaacaaacncttcgactacttcgtcggggtccctggactccgcttctcgtcgtcctccagttcccgtagggaaaccaaagcctccgccctaccacccagtcccggaccgggggcccaggcacgatgactagtactcttactaatttataccgtgtcgtctacgttgtccgttagtttggaccgttaggtatttacgtaacttaagtttacgtggttcgggtttcgggacggggaacggtaaaccgg

SEQ ID NO: 308711 - DNA, 539 bp, Homo sapiens
  misc_feature: GZ8MTXP02H4BUE.8.4.A04.1.454.CMB.2.raw
  modified_base (345)..(345): a, c, t, g, unknown or other
  misc_feature (345)..(345): n is a, c, g, or t
  modified_base (356)..(356): a, c, t, g, unknown or other
  misc_feature (356)..(356): n is a, c, g, or t
  modified_base (376)..(376): a, c, t, g, unknown or other
  misc_feature (376)..(376): n is a, c, g, or t
tcagctcgcgtgtccacgaccggtgctcgatttagagtagtgatcagggggaaaaggccctgaggaaaacaaaccccagctgggaagcctgagaacacttagccttcatgagtgtccccaccatggcctggatgatgcttctcctcggactccttgcttatggatcaggagtggattctgagactgtggtgacccaggagccgtcgttctccgtgtcccctggagagacagtcacactcacttgtggcttgagctctggctcagtctctcgtggttacctcccctcttggtaccagcacgaccccaggcccaggctccacgcatgctcatgtacagccacaaacnttcgcacttcnggggtccctgactcgcttcnctgctcatccttagggaacaaagctacgccctacaccactccgaccgggggcccagggcagagtagatagaatcttcaatttattactgtgcacttgctagtttcggcgtagtattacgtaactaagtttacgttcggttacggtacggacgggtaacggacg

SEQ ID NO: 308712 - DNA, 567 bp, Homo sapiens
  misc_feature: GZ8MTXP02JU628.8.4.A04.1.454.CMB.2.raw
  modified_base (315)..(315): a, c, t, g, unknown or other
  misc_feature (315)..(315): n is a, c, g, or t
  modified_base (458)..(458): a, c, t, g, unknown or other
  misc_feature (458)..(458): n is a, c, g, or t
  modified_base (474)..(474): a, c, t, g, unknown or other
  misc_feature (474)..(474): n is a, c, g, or t
tcagctcgcgtgtccacgaccggtgctcgatttagagtagtgatcaggggggaagcctgagaacacttagccttcatgagtgtccccaccatggcctggatgatgcttctcctcggactccttgcttatggatcaggagtggattctgagactgtggtgacccaggagccgtcgttctccgtgtcccctggagagacagtcacactcacttgtggcttgagctctggctcagtctctcgtcggttacctcccctcttggtaccagcacgaccccaggccaggcctccacgcatcgctcatgtacagcaacaaacnttcgctacttcgtcggggtccccctgactcgtcttctcgtcggctccattccgttagggaaacaaacgctcgacccctacaccgacgtccggaccgggggcccaggccagatgatagaacttctactatttactacgtgtacnctactgtctagttcgngtagtattacgtacttaaagttcgtggttcgggttccgggacgggtaacgacgaacgcgtacggtaccgtacggtacggaccaccgtacccgg

SEQ ID NO: 308713 - DNA, 602 bp, Homo sapiens
  misc_feature: GZ8MTXP02H7SUD.8.4.A04.1.454.CMB.2.raw
  modified_base (269)..(269): a, c, t, g, unknown or other
  misc_feature (269)..(269): n is a, c, g, or t
  modified_base (474)..(474): a, c, t, g, unknown or other
  misc_feature (474)..(474): n is a, c, g, or t
tcagctcgcgtgtccacgaccggtgctcgatttagagtagtgatcagggggaaaaggccctgaggaaaacaaaccccagctgggaagcctgagaacacttagccttcatgagtgtcccccaccatggcctggatgatgcttctcctcggactccttgcttatggatcaggagtggattctgagactggtggtgacccagggacgccgttcgttctccgtcgtcccctggagagacagtcacactcacttgtggcttgagctctggctcngtctctcgttcggtttaccctcccccttgttcggtaccacgccaaccggacccccaggcccacggcctcccacgcatcgctcatcgtacagacccaacaaaactctacgctacgttccgtcggggtccctgactcgtcttcgctcgcctccattccgtaggaacaagtctcgccctcaccagtccggaccggggccaagggcagntagatgaactctactatttactacgtgtacgactacgttcgactttagtttcgtcgttacgtaacgttagttaacttaaagtttcggttagggttcgggttacggggaccgggtaacgggtaaacccg

SEQ ID NO: 308714 - DNA, 519 bp, Homo sapiens
  misc_feature: GZ8MTXP02IMTXA.8.4.A04.1.454.CMB.2.raw
  modified_base (253)..(253): a, c, t, g, unknown or other
  misc_feature (253)..(253): n is a, c, g, or t
  modified_base (378)..(378): a, c, t, g, unknown or other
  misc_feature (378)..(378): n is a, c, g, or t
  modified_base (459)..(459): a, c, t, g, unknown or other
  misc_feature (459)..(459): n is a, c, g, or t
tcagctcgcgtgtccacgaccggtgctcgatttagagtagtgatcaggggggaagcctgagaacacttagccttcatgagtgtccccaccatggcctggatgatgcttctcctcggactccttgcttatggatcaggagtggattctgagactgtggtgacccaggagccgtcgttctccgtgtcccctggagagacagtcacactcacttgtggcttgagctctggctcagtctctcgtgttacctcccctnttgtacagcacgacccaggccaggctccacgcatgctcatgtacagcaacaaacattcgctacttcgtcggggtccccctgactcgcttctctgcctcatcctagggaacaagctcgcctcaccntcgacggggcccaggcagatgatgaatctctaatttatactgtacgctactgtctagtttgcgtagattgtactaaatttntggtcggtttcgggacggtaacggaccaagtcgtacgtaccgtcgtacggtcacgacccg

SEQ ID NO: 308715 - DNA, 515 bp, Homo sapiens
  misc_feature: GZ8MTXP02FK6IZ.8.4.A04.1.454.CMB.2.raw
tcagctcgcgtgtccacgaccggtgctcgatttagagtagtgatcaggggggaagcctgagaacacttagccttcatgagtgtccccaccatggcctggatgatgcttctcctcggactccttgcttatggatcaggagtggattctgagactgtggtgacccaggagccgtcgttctccgtgtcccctggagagacagtcacactcacttgtggcttgagctctggctcagtctctcgtggttactccccctcttggtaccagcagacccccaggccaggcctccacgcatgctcatgtacagcacaaacattcgcacttctggggtcccccctgactcgcttctctggctccatccgttagggaacaaagctgccctcaccatcgacgggggcccaggccagatgatgaaatctactattattactgtgctactgctattgcgtgatgtactattactggtcgttacgggcggaggaaccaagtcgtacgaccgtcgtacggtcgacgacccg

SEQ ID NO: 308716 - DNA, 587 bp, Homo sapiens
  misc_feature: GZ8MTXP02HM9U0.8.4.A04.1.454.CMB.2.raw
  modified_base (351)..(351): a, c, t, g, unknown or other
  misc_feature (351)..(351): n is a, c, g, or t
tcagctcgcgtgtccacgaccggtgctcgatttagagtagtgatcagggggaaaaggccctgaggaaaacaaaccccagctgggaagcctgagaacacttagccttcatgagtgtccccaccatggcctggatgatgcttctcctcggactccttgcttatggatcaggagtggattctgagactgtggtgacccaggagccgtcgttctccgtgtcccctggagagacagtcacactcacttgtggcttgagctctggctcagtctctcgtcggttacctccccctcttcggtaccagccacgaccccaggcccaggcctccacgcatcgctcatgacagccaacaaacnttccgctacttcgtcgggggtccctgactccgtcttctctcggcctccgacgttccgttacgggaaactaaacgctccgcccctaccgacccacgtaccggacccgggggccccaaggccgaagacttaggaatacgtaaactctactactttattacgtgtcgactactgcttagttcgcgttacgattagtaactaagtttacgtcggtaggttccgggacggtacggtaaccg

SEQ ID NO: 308717 - DNA, 523 bp, Homo sapiens
  misc_feature: GZ8MTXP02JFE7Y.8.4.A04.1.454.CMB.2.raw
  modified_base (440)..(440): a, c, t, g, unknown or other
  misc_feature (440)..(440): n is a, c, g, or t
tcagctcgcgtgtccacgaccggtgctcgatttagagtagtgatcaggggggaagcctgagaacacttagccttcatgagtgtccccaccatggcctggatgatgcttctcctcggactccttgcttatggatcaggagtggattctgagactgtggtgacccaggagccgtcgttctccgtgtcccctggagagacagtcacactcacttgtggcttgagctctggctcaatctctcgtcggttactccccctcttggtaccagcacgaccccaggccaggctccacgcatgctcatgtacagcaacaaacattcgctacttcgtcggggtcccccctgactcgcttctctgctccatccgtagggaacaaagctcgccctcaccatccgacggggccccaggccagtactagatgaaatctactattattactggtcnctactgctagttgcgtgatcgtataattatgtacggttcggacggaggaccaagtctacgacccgtactacggtcacgacccg

SEQ ID NO: 308718 - DNA, 585 bp, Homo sapiens
  misc_feature: GZ8MTXP02JM5Z2.8.4.A04.1.454.CMB.2.raw
  modified_base (363)..(363): a, c, t, g, unknown or other
  misc_feature (363)..(363): n is a, c, g, or t
  modified_base (367)..(367): a, c, t, g, unknown or other
  misc_feature (367)..(367): n is a, c, g, or t
tcagctcgcgtgtccacgaccggtgctcgatttagagtagtgatcagggggaaaaggccctgaggaaaacaaaccccagctgggaagcctgagaacacttagccttcatgagtgtccccaccatggcctggatgatgcttctcctcggactccttgcttatggatcaggagtggattctgagactgtggtgacccgaggacgccgtcgttctccgtcgtcccctggagagacagtcacactcacttgtggcttgagctcgtggctcagtctctcgtcgttaccctccccctgtcggtaccagccacgaccccgaggccacggcctccgacgcatcgcctacatcgtacagacccaacaaactntccnctacgttcgtcggggtcctgactcgcttctctacggtcctcctacgttccgtaggaacaacgctccgccctacaccacgtccggaccggggcccaggaccagatgactataactctatactttactacgtgtcgtactacgtgtacttagttcgacgttacgtagttagtaacttaagttacggttggtacggttacggggacgggtaacggtaaccg

SEQ ID NO: 308719 - DNA, 558 bp, Homo sapiens
  misc_feature: GZ8MTXP02GN871.8.4.A04.1.454.CMB.2.raw
  modified_base (288)..(288): a, c, t, g, unknown or other
  misc_feature (288)..(288): n is a, c, g, or t
  modified_base (308)..(308): a, c, t, g, unknown or other
  misc_feature (308)..(308): n is a, c, g, or t
tcagctcgcgtgtccacgaccggtgctcgatttagagtagtgatcagggggaaaaggccctgaggaaaacaaaccccagctgggaagcctgagaacacttagccttcatgagtgtccccaccatggcctggatgatgcttctcctcggactccttgcttatggatcaggagtggattctgagactgtggtgacccaggagccgtcgttctccgtgtcccctggagagacagtcacactcacttgtggcttgagctctggctcagtctctcgtcggttacctccccctnttggtaccagcacgaccccnggccaggcctccacgcatcgctcaatgtaacagcccaacaaaactcttcgctaccttcgtcggggtccctgtactccgcttctctcggcctccatccgtaggaaactaaacgctcgccctcgaccacgtccgaccgggggcccaggcagactgatagtaatctactatttacttactgtacgctacgtgtctagttcgcgttcgattgtaacttaagttcgtggttacggttcggacgggacggtaaccg

SEQ ID NO: 308720 - DNA, 567 bp, Homo sapiens
  misc_feature: GZ8MTXP02HZ01D.8.4.A04.1.454.CMB.2.raw
  modified_base (286)..(286): a, c, t, g, unknown or other
  misc_feature (286)..(286): n is a, c, g, or t
  modified_base (349)..(349): a, c, t, g, unknown or other
  misc_feature (349)..(349): n is a, c, g, or t
  modified_base (492)..(492): a, c, t, g, unknown or other
  misc_feature (492)..(492): n is a, c, g, or t
tcagctcgcgtgtccacgaccggtgctcgatttagagtagtgatcagggggaaaaggccctgaggaaaacaaaccccagctgggaagcctgagaacacttagccttcatgagtgtccccaccatggcctggatgatgcttctcctcggactccttgcttatggatcaggagtggattctgagactgtggtgacccaggagccgtcgttctccgtcgtcccctggagagacagtcacactcacttgtggcttgagctcgtgctcagtctctcgtgttacctcccctnttggaccagcacgaccccaggccaggcctccacgcatcgctcatcgacagaccaacaaacctnttcgctaccgttcgtcgggggtccctgactccgtcttctctcgtcctcctagttccgttagggaaacaaacgtcctccgccctacaccacgtccggaccgggggcccaggcgagagtagatagaactctatatttatactgtnactacgtgtctagttcgcgttagtacttagtaacttagtttacgtggttcggttccgggacggtaacggtaaccg

SEQ ID NO: 308721 - DNA, 573 bp, Homo sapiens
  misc_feature: GZ8MTXP02HAA7I.8.4.A04.1.454.CMB.2.raw
  modified_base (253)..(253): a, c, t, g, unknown or other
  misc_feature (253)..(253): n is a, c, g, or t
  modified_base (259)..(259): a, c, t, g, unknown or other
  misc_feature (259)..(259): n is a, c, g, or t
  modified_base (309)..(309): a, c, t, g, unknown or other
  misc_feature (309)..(309): n is a, c, g, or t
  modified_base (358)..(358): a, c, t, g, unknown or other
  misc_feature (358)..(358): n is a, c, g, or t
  modified_base (456)..(456): a, c, t, g, unknown or other
  misc_feature (456)..(456): n is a, c, g, or t
tcagctcgcgtgtccacgaccggtgctcgatttagagtagtgatcagggggggaagcctgagaacacttagccttcatgagtgtccccaccatggcctggatgatgcttctcctcggactccttgcttatggatcaggagtggattctgagactgtggtgacccaggagccgtcgttctccgtgtcccctggagagacagtcacactcacttgtggcttgagctctggctcagtctctcgtgttactcccctnttgacngcacgacccaggccaggcctccacgcatgctcatgacagacaacaaactnttccgctacttcgtcggggtccccctgactcgcttctcgtcgcctcctntcccgttaggaaccaagcctacgtccctacaccctacgtccggaccgggggcccagggccagacgtgactgtaaactctactatttacttactggtcnctagtcgtactagtttgacgtgattcgtacttaagttcgtggttacggttacggggacgggtaacggaaccgtaagtccgtacggacccgttacgttacggccgaccggtaacccgg

SEQ ID NO: 308722 - DNA, 570 bp, Homo sapiens
  misc_feature: GZ8MTXP02GZKSX.8.4.A04.1.454.CMB.2.raw
tcagctcgcgtgtccacgaccggtgctcgatttagagtagtgatcagggggaaaaggccctgaggaaaacaaaccccagctgggaagcctgagaacacttagccttcatgagtgtccccaccatggcctggatgatgcttctcctcggactccttgcttatggatcaggagtggattctgagactgtggtgacccaggagccgtcgttctccgtgtcccctggagagacagtcacactcacttgtggcttgagctctggctcagtctctcgtcgttacctcccctcgttcggtaccagcacgaccccgaggccaggcctccacgcactgctcatcgtacagacccaacaactacttcgactaccttcggtcggggtccctgacgttccgtccttctcgtcggcctctactcgtacgggaaacaacgtctccgcccctacaccacgtccggaccggggcccaggactaagatcgatacgaacttctactatttattactgtcactactgtctagtttcggcgtagtatagtaattagttcgtcggttcggtacgggacgggaacggtaacg

SEQ ID NO: 308723 - DNA, 514 bp, Homo sapiens
  misc_feature: GZ8MTXP02FFJ7A.8.4.A04.1.454.CMB.2.raw
  modified_base (252)..(252): a, c, t, g, unknown or other
  misc_feature (252)..(252): n is a, c, g, or t
  modified_base (260)..(260): a, c, t, g, unknown or other
  misc_feature (260)..(260): n is a, c, g, or t
  modified_base (299)..(299): a, c, t, g, unknown or other
  misc_feature (299)..(299): n is a, c, g, or t
  modified_base (343)..(343): a, c, t, g, unknown or other
  misc_feature (343)..(343): n is a, c, g, or t
  modified_base (379)..(379): a, c, t, g, unknown or other
  misc_feature (379)..(379): n is a, c, g, or t
tcagctcgcgtgtccacgaccggtgctcgatttagagtagtgatcaggggggaagcctgagaacacttagccttcatgagtgtccccaccatggcctggatgatgcttctcctcggactccttgcttatggatcaggagtggattctgagactgtggtgacccaggagccgtcgttctccgtgtccctggagagacagtcacactcacttgtggcttgagctctggctcagtctctcgtgttacctcccctntggtaccngcacgaccccaggccaggctccacgcatgctcatgtacngcaacaaacattcgcacttcgtggggtccccctgactcgcttcnctggctccatccgtagggaacaagctgccctcaccntcgacgggggcccaggcagactgatgaaactctactattattactgtgcactgctatttgcgttgatgtactaatttatggttcggttcggacgggagggaccaagcgtacgacccgtcgtacggcacgaccccg

SEQ ID NO: 308724 - DNA, 595 bp, Homo sapiens
  misc_feature: GZ8MTXP02INZEL.8.4.A04.1.454.CMB.2.raw
tcagctcgcgtgtccacgaccggtgctcgatttagagtagtgatcaggggggaagcctgagaacacttagccttcatgagtgtcccaccatggcctggatgatgcttctcctcggactccttgcttatggatcaggagtggattctgagactgtggtgacccaggagccgtcgttctccgtgtccctggagagacagtcacactcacttgtggcttgagctctggctcagtctctcgttcggttacctcccctcgttcggtaccagccacgaccccacggccaggcctccacgcatcgctcatgtacagcaacaaactatccgctacttcgtcgggtcccctgactcgtcttctcgtcgctcactccgttagaacaacgctacgccctcaccctagtccggaccggggcccaggtccgagtatagatagtaattccttaatagtttacttacgtgtacgctacctgacttacgttgacgtagtacgtttcgtattaaagtttaggttcggttacggttaccgggggacgggtaacggggtaaccaaggtccgtacggttaacccggtaccgtacgggtaccgacgtaaccccggg

SEQ ID NO: 308725 - DNA, 619 bp, Homo sapiens
  misc_feature: GZ8MTXP02FM7L7.8.4.A04.1.454.CMB.2.raw
  modified_base (231)..(231): a, c, t, g, unknown or other
  misc_feature (231)..(231): n is a, c, g, or t
tcagctcgcgtgtccacgaccggtgctcgatttagagtagtgatcagggggaaaaggccctgaggaaaacaaaccccagctgggaagcctgagaacacttagccttcatgagtgtccccaccatggcctggatgatgcttctcctcggactccttgcttatggatcaggagtggattctgagactgtggtgacccaggagccgtcgttctccgtgtcccctgggggggganagacagtcacactcacttgtggcttgagctcgtggctcagtctctcggtcgttaccctccccctcgttcggtaccagccacgaccccgaggccacggcctccacgcatcgcctcatgtacacgaccaacaaacattcgactacgttcgtcggggtccctgtactcgtcttctcgtcggtcctcctacgttccgtaacgggaaacaaacgcctccgtacccctaccaccgtacgtaccggaccgggggacccgaacgggcgaagtatagaatacgaacttctacttaacttattactgtacgtactacgtgtactagtttcgcgttagtagttacttaagtaaatttacgttacggttcggttacggggtaacggggaacgggtaaccg

SEQ ID NO: 308726 - DNA, 538 bp, Homo sapiens
  misc_feature: GZ8MTXP02GPHZB.8.4.A04.1.454.CMB.2.raw
  modified_base (263)..(263): a, c, t, g, unknown or other
  misc_feature (263)..(263): n is a, c, g, or t
  modified_base (385)..(385): a, c, t, g, unknown or other
  misc_feature (385)..(385): n is a, c, g, or t
  modified_base (452)..(452): a, c, t, g, unknown or other
  misc_feature (452)..(452): n is a, c, g, or t
  modified_base (456)..(456): a, c, t, g, unknown or other
  misc_feature (456)..(456): n is a, c, g, or t
tcagctcgcgtgtccacgaccggtgctcgatttagagtagtgatcaggggggaagcctgagaacacttagccttcatgagtgtccccaccatggcctggatgatgcttctcctcggactccttgcttatggatcaggagtggattctgagactgtggtgacccaggagccgtcgttctccgtgtcccctggagagacagtcacactcacttgtggcttgagctctggctcagtctctcgtggttacctcccctcttggtaccngcagaccccaggccaggctccacgcatgctcatgtacagacaacaaacattcgctacgttcgtcggggtccccctgactcgtcttctctggcctcactccgttagggaacaagctcgccctnaccatccgacggggcccaggccagatgatagaatctacatttagttactgtcgcactgctatttcgngtangttagtacttagttacgtggttacggtcgggacggacggaaccgaagtccgtacggacccgtacgtacggtaccgacgcccg

SEQ ID NO: 308727 - DNA, 554 bp, Homo sapiens
  misc_feature: GZ8MTXP02HTDYT.8.4.A04.1.454.CMB.2.raw
  modified_base (287)..(287): a, c, t, g, unknown or other
  misc_feature (287)..(287): n is a, c, g, or t
  modified_base (348)..(348): a, c, t, g, unknown or other
  misc_feature (348)..(348): n is a, c, g, or t
tcagctcgcgtgtccacgaccggtgctcgatttagagtagtgatcagggggaaaaggccctgaggaaaacaaaccccagctgggaagcctgagaacacttagccttcatgagtgtccccaccatggcctggatgatgcttctcctcggactccttgcttatggatcaggagtggattctgagactgtggtgaccaggagccgtcgttctccgtcgtcccctggagagacagtcacactcacttgtggcttgagctctggctcagtctctcgtcgttacctccccctnttcggtaccagcacgaccccaggccaggcctccacgcatgctcatgtacagccaacaaacnttcgctacttcgtcggggtccctgactcgcttctctcgctccatccgttagggaaactaaacgctcgccctacacccagtccgaccgggggcccaggcagactgactgaatctactattacttactgtacgcacgtgactagttgcgtagtattacgtaactaaagtttacgtggttcggttaccgggacgggtaacggaacccgg

SEQ ID NO: 308728 - DNA, 604 bp, Homo sapiens
  misc_feature: GZ8MTXP02IKKLV.8.4.A04.1.454.CMB.2.raw
  modified_base (355)..(355): a, c, t, g, unknown or other
  misc_feature (355)..(355): n is a, c, g, or t
tcagctcgcgtgtccacgaccggtgctcgatttagagtagtgatcagggggaaaaggccctgaggaaaacaaaccccagctgggaagcctgagaacacttagccttcatgagtgtccccaccatggcctggatgatgcttctcctcggactccttgcttatggatcaggagtggattctgagactgtggtgacccaggacgccgtcgttctccgtcgtcccctggagagacagtcacactcacttgtggcttgagctctggctcagtctctcgtggttacctcccccttcttcggtaccagcacgaccccgacggccaggcctcacgcatgctcatgtacacgaccaacaaactnttccgctaccttcgtcgggggttccctgacttccgtcttctcgtacgctccacttccgtagggaacaacgctccgcctcacctacgcgaccggggccaggcacgatgaatcgtaactcttactaactttacgttactcggtacgtacctacgttgaccgtttagtttacgtcgttacgtagttacggttaaccttaaacgtttagttcgggtttcggttaccggggtaccgggtaacgggtaaacccgg

SEQ ID NO: 308729 - DNA, 580 bp, Homo sapiens
  misc_feature: GZ8MTXP02G06H5.8.4.A04.1.454.CMB.2.raw
  modified_base (253)..(253): a, c, t, g, unknown or other
  misc_feature (253)..(253): n is a, c, g, or t
  modified_base (261)..(261): a, c, t, g, unknown or other
  misc_feature (261)..(261): n is a, c, g, or t
tcagctcgcgtgtccacgaccggtgctcgatttagagtagtgatcaggggggaagcctgagaacacttagccttcatgagtgtccccaccatggcctggatgatgcttctcctcggactccttgcttatggatcaggagtggattctgagactgtggtgacccaggagccgtcgttctccgtgtcccctggagagacagtcacactcacttgtggcttgagctctggctcagtctctcgtgttacctcccctnttggaccngcacgaccccaggccaggcctccacgcatgctcatcgtacagcaacaaactattccgctacttcgtcggggtccccctgactcgcttctctgcctcatccgtagggaacaagctcgccctcaccacgcgtaccggggcccaggcagatagatagaactctactatttattactgtacgactacgtgtacttagttgtacgtagtagttacgtacttaaatttcggttagggttcgggtttaccgggggaacgggtaaccgggtaacgaacggtccgtacggtaccccggttacgtaccggtaccgaccggtaaccccgg

SEQ ID NO: 308730 - DNA, 672 bp, Homo sapiens
  misc_feature: GZ8MTXP02JQH9Y.8.4.A04.1.454.CMB.2.raw
tcagctcgcgtgtccacgaccggtgctcgatttagagtagtgatcagggggaaaaggccctgaggaaaacaaaccccagctgggaagcctgagaacacttagccttcatgagtgtccccaccatggcctggatgatgcttctcctcggactccttgcttatggatcaggagtggattctgagactgtggtgacccaggagccgtcgttctccgtcgtcccctggagagacagtcacactcacttgtgcttgagctctggctcagtctctcgtgttaccctccccctgttcggtaccagcacgaccccgaggccgacggcctccacgcatcgctcatcgtacagacccaacaaactcttcgctacttcgtcggggtcccctgtactccgtcttctctcggtcctcctacgttccgtaacgggaaactaacggtctccgcccctaccaacccgtacgtaccccgggaccggggggaccccagggaccaggtaaacgttcgggaaactttaggaactttaccctatttaacgttttaacgtttaccgtgggttacctaccctaagttcggtacctttaggtttcgggtaccgttcggttaaacttgggtttaacctaaaattttgggttacggttcggggtttacccggggaacgggggttaacggtaaacccgg

SEQ ID NO: 308731 - DNA, 525 bp, Homo sapiens
  misc_feature: GZ8MTXP02FVSDC.8.4.A04.1.454.CMB.2.raw
  modified_base (251)..(251): a, c, t, g, unknown or other
  misc_feature (251)..(251): n is a, c, g, or t
  modified_base (307)..(307): a, c, t, g, unknown or other
  misc_feature (307)..(307): n is a, c, g, or t
  modified_base (410)..(410): a, c, t, g, unknown or other
  misc_feature (410)..(410): n is a, c, g, or t
  modified_base (448)..(448): a, c, t, g, unknown or other
  misc_feature (448)..(448): n is a, c, g, or t
tcagctcgcgtgtccacgaccggtgctcgatttagagtagtgatcaggggggaagcctgagaacacttagccttcatgagtgtccccaccatggcctggatgatgcttctcctcggactccttgcttatggatcaggagtggattctgagactgtggtgacccaggagccgtcgttctccgtgtcccctggagagacagtcacactcacttgtggcttgagctctgctcagtctctcgtgtacctcccctntgtacagcacgacccagccagcctccacgcatgctcatgtacagacaacaaaactnttacgctacttcgtcggggtccccctgtactcgctttctctggcctccatccgttagggaacaagctcgccctcaccactcgacggggcccaggcagatgatnatctctatttattacgtagtgctactgctagtttcggngtgtatctataattgtcggttacggtacggacggacggaaccgaagtcgtacggtaccgtcgtacgtacgacgaccg

SEQ ID NO: 308732 - DNA, 568 bp, Homo sapiens
  misc_feature: GZ8MTXP02I93WP.8.4.A04.1.454.CMB.2.raw
tcagctcgcgtgtccacgaccggtgctcgatttagagtagtgatcagggggaaaaggccctgaggaaaacaaaccccagctgggaagcctgagaacacttagccttcatgagtgtccccaccatggcctggatgatgcttctcctcggactccttgcttatggatcaggagtggattctgagactgtggtgacccaggagccgtcgttctccgtgtcccctggagagacagtcacactcacttgtggcttgagctctggctcagtctctcgtggttacctccccctcttggtaccagcacgaccccaggcccaggcctccacgcatgctcatgtacagcccaacaacattcgctacttcgtcgggggtccctgactcgtcttctctggcctccactccgttagggaacaagctcgccctcaccacgtcgaccgggggcccaggcagactaggatagaatctactatttacttacgtgtcgtctacgtcggtacttagtttgtccgttagtagtacggttaactaaagtttacgttggttcggtttacggggcgggtaacgggaacccg

SEQ ID NO: 308733 - DNA, 573 bp, Homo sapiens
  misc_feature: GZ8MTXP02G70YW.8.4.A04.1.454.CMB.2.raw
  modified_base (286)..(286): a, c, t, g, unknown or other
  misc_feature (286)..(286): n is a, c, g, or t
  modified_base (295)..(295): a, c, t, g, unknown or other
  misc_feature (295)..(295): n is a, c, g, or t
  modified_base (305)..(305): a, c, t, g, unknown or other
  misc_feature (305)..(305): n is a, c, g, or t
  modified_base (345)..(345): a, c, t, g, unknown or other
  misc_feature (345)..(345): n is a, c, g, or t
  modified_base (486)..(486): a, c, t, g, unknown or other
  misc_feature (486)..(486): n is a, c, g, or t
tcagctcgcgtgtccacgaccggtgctcgatttagagtagtgatcagggggaaaaggccctgaggaaaacaaaccccagctgggaagcctgagaacacttagccttcatgagtgtccccaccatggcctggatgatgcttctcctcggactccttgcttatggatcaggagtggattctgagactgtggtgacccaggagccgtcgttctccgtcgtcccctggagagacagtcacactcacttgtggcttgagctctggctcagtctctcgtgttacctcccctntcggtaccngcagaccccnggccaggcctccacgcatgctcatgtacagccaacaaacnttccgctacttcgtcggggtccctgactccgcttctctcggctccacttcctagggaacaagctacgccctcaccacgtccgacggggccccaggccagacgtgatgaactctatacgttaattccgtagtcgactacgtntacttacgtttcgtacggttagtattacggttaataaagtttacggttaggtttcggtttaccggggacggggtacgggtaaacccg

SEQ ID NO: 308734 - DNA, 709 bp, Homo sapiens
  misc_feature: GZ8MTXP02IPSIW.8.4.A04.1.454.CMB.2.raw
  modified_base (334)..(334): a, c, t, g, unknown or other
  misc_feature (334)..(334): n is a, c, g, or t
tcagctcgcgtgtccacgaccggtgctcgatttagagtagtgatcagggggggaagcctgagaacacttagccttcatgagtgtccccaccatggcctggatgatgcttctcctcggactccttgcttatggatcaggagtggattctgagactgtggtgacccaggagccgtcgttctccgtgtcccctggagagacagtcacactcacttgtggcttgagctctggctcagtcctcgtcggttcggtttaccctcccccttcgttcggtaccacgccacgacccccgaggcccaggcctccgacgcatcgctacatgtacagcaactaaacnttcgctacgtcgtcgggtcccctagtactcgtcttctctcggcctccacttccggtacggaaactaacgtcctcgacccctacgacctacggtccggaccgggggcccaggtcaacggtatcgtactagtaacttcctatttaacgtttacgttaaccgttggtaccgtacgtaccgttaggtacctttaacggttttcgggaccggtttacgtaaggttttaccggtaactttaaaaggtttttcgtacggggttttaaccgggggtacccggggtaacgggggtaaaacccgggtaaccgtaaacgggtccggttaccgggtaaccccgggttacccggttaacgggtaccccgtaaacggtaacccccgggg

SEQ ID NO: 308735 - DNA, 591 bp, Homo sapiens
  misc_feature: GZ8MTXP02JILAB.8.4.A04.1.454.CMB.2.raw
tcagctcgcgtgtccacgaccggtgctcgatttagagtagtgatcagggggaaaaggccctgaggaaaacaaaccccagctgggaagcctgagaacacttagccttcatgagtgtccccaccatggcctggatgatgcttctcctcggactccttgcttatggatcaggagtggattctgagactggtggtgacccaggagccgtcgttctccgtgtcccctggagagacagtcacactcacttgtggcttgagctctggctcagtctctcgtcgttacctcccctctcggtaccagcacgaccccaggccaggcctccacgcatcgctcatgtacagccaacaaactctacgctacgttcgtcggggtccctggactcgtccttctcgtcgcctctactccgttagggaaactaacgctcgaccctacaccacgtcggaccggggccaggtacagtactagatacgaaacttctattacttattacgtgtacgtctacgtcggtacctatttggaccgttacgtaggttacgtaacgttaatttacggttggttacgggttaccgggtacggggaaccggttaaacccgg

SEQ ID NO: 308736 - DNA, 587 bp, Homo sapiens
  misc_feature: GZ8MTXP02FITUE.8.4.A04.1.454.CMB.2.raw
  modified_base (511)..(511): a, c, t, g, unknown or other
  misc_feature (511)..(511): n is a, c, g, or t
tcagctcgcgtgtccacgaccggtgctcgatttagagtagtgatcagggggaaaaggccctgaggaaaacaaaccccagctgggaagcctgagaacacttagccttcatgagtgtccccaccatggcctggatgatgcttctcctcggactccttgcttatggatcaggagtggattctgagactgtggtgacccaggagccgtcgttctccgtgtcccctggagagacagtcacactcacttgtggcttgagctctggctcagtctctcgtcggttaccctccccctgttcggtaccagccacgaccccgaggcccaggcctccacgcatcgctcatgtacagacccaacaaacattccgactacgttcgtcggggtccctgtactccgtcttctcgtcggtcctcctattcccgttaagggaaaccaacgtcctcgcccctacaccacgtccgggaccgggggcccagggccagactaggatagtaacttctactattattacgtgtcnctactgtccttagtttcgcgttagtattagtaactaaagtttcgtggttcggttacgggacgggacgggtaacccg

SEQ ID NO: 308737 - DNA, 687 bp, Homo sapiens
  misc_feature: GZ8MTXP02GPOKX.8.4.A04.1.454.CMB.2.raw
tcagctcgcgtgtccacgaccggtgctcgatttagagtagtgatcagggggaaaaggccctgaggaaaacaaaccccagctgggaagcctgagaacacttagccttcatgagtgtccccaccatggcctggatgatgcttctcctcggactccttgcttatggatcaggagtggattctgagactgtggtgacccaggagccgtcgttctccgtcgtcccctggagagacagtcacactcacttgtggtcttgagctcgtggctcagtctctcggtcggtttacctcccctcgttcggtaccagccacgaccccgaggccaggcctccacgcatcgctacatcgtacacgacccaaaccaaactacttccgactaccgtttcggtcgggggttccctagtactccgtccttcgtcgtcggtcctcctacgttacccgttagggaaacctaaacggtcctccgtacccctacccgtaacccgtacgtacccgggaacccgggggaccccaaggggtaccaaggtagtacgggtataaccgtaaacttccttaacttaaactttacttaaccgtggttacgtactaccgttgtaccgttagtttcggtaccgttacgtaacgttacggttaacttaaacgtttggtttacgggtcggtttacgggggaccgggtaacgggtaaacccgg

SEQ ID NO: 308738 - DNA, 652 bp, Homo sapiens
  misc_feature: GZ8MTXP02IPR5W.8.4.A04.1.454.CMB.2.raw
  modified_base (463)..(463): a, c, t, g, unknown or other
  misc_feature (463)..(463): n is a, c, g, or t
  modified_base (607)..(607): a, c, t, g, unknown or other
  misc_feature (607)..(607): n is a, c, g, or t
  modified_base (614)..(614): a, c, t, g, unknown or other
  misc_feature (614)..(614): n is a, c, g, or t
tcagctcgcgtgtccacgaccggtgctcgatttagagtagtgatcagggggaaaaggccctgaggaaaacaaaccccagctgggaagcctgagaacacttagccttcatgagtgtccccaccatggcctggatgatgcttctcctcggactccttgcttatggatcaggagtggattctgagactggtggtgatccgaggacgccgttcgttctccgtcgtcccgtggagagacagtcacactctacttggtggtcttgagtctcgtggtctcagttctctcggttcgttaccctccccgttgtcggtaccagtaccgaccgaccccgaggcccaggcctccgacgctatcgctacatacgtacaccgacaacaaactcttacgcttacgttcgtacggggtcctaggtactccgtctttctcgtacgtcctacctacgtcgttaacgggaactaacggtccnccgtaccccacacccgaccgtacccgggaacccgggggacccacggggcctaaacgggactaggtaaacttacgtaaaccttccgttaactttaacgtttacgttaccgtggttcacttaccgtcgtacttcgtttgacggttntacgttntaattagtttagtcggtacggtacggacgggaaaccgg

SEQ ID NO: 308739 - DNA, 607 bp, Homo sapiens
  misc_feature: GZ8MTXP02JYC0M.8.4.A04.1.454.CMB.2.raw
  modified_base (246)..(246): a, c, t, g, unknown or other
  misc_feature (246)..(246): n is a, c, g, or t
  modified_base (265)..(265): a, c, t, g, unknown or other
  misc_feature (265)..(265): n is a, c, g, or t
  modified_base (270)..(270): a, c, t, g, unknown or other
  misc_feature (270)..(270): n is a, c, g, or t
  modified_base (288)..(288): a, c, t, g, unknown or other
  misc_feature (288)..(288): n is a, c, g, or t
  modified_base (296)..(296): a, c, t, g, unknown or other
  misc_feature (296)..(296): n is a, c, g, or t
  modified_base (336)..(336): a, c, t, g, unknown or other
  misc_feature (336)..(336): n is a, c, g, or t
  modified_base (349)..(349): a, c, t, g, unknown or other
  misc_feature (349)..(349): n is a, c, g, or t
tcagctcgcgtgtccacgaccggtgctcgatttagagtagtgatcagggggaaaaggccctgaggaaaacaaaccccagctgggaagcctgagaacacttagccttcatgagtgtccccaccatggcctggatgatgcttctcctcggactccttgcttatggatcaggagtggattctgagactgtggtgacccaggacgccgtcgttctccgtgtcccctggagagacagtcacactcacttgnggcttgagctctggctacngtctntcgtcgttacctcccctnttggaccngcacgcccctaggccaggcctcacgcatgctcatgtacanccacaacactacncacttcgtcgggtccgtcgtctcgtcttctcttcggctcctactccgttacggtaacgaaacgacccgtccgcctaccaccgacgtaccggaccggggaccggacggacgacgagtagtacgtacgtactactacttacttacttacgtacgtacgtacgtacgtacgtacgttacgttacgttacgtacgtacgttacgttaacgttaacgtttacgttacggttacgggtacggggtacggggtaacgggtaacgg

SEQ ID NO: 308740 - DNA, 598 bp, Homo sapiens
  misc_feature: GZ8MTXP02FUB8O.8.4.A04.1.454.CMB.2.raw
  modified_base (287)..(287): a, c, t, g, unknown or other
  misc_feature (287)..(287): n is a, c, g, or t
tcagctcgcgtgtccacgaccggtgctcgatttagagtagtgatcagggggaaaaggccctgaggaaaacaaaccccagctgggaagcctgagaacacttagccttcatgagtgtccccaccatggcctggatgatgcttctcctcggactccttgcttatggatcaggagtggattctgagactgtggtgacccaggagccgtcgttatccgtgtcccctggagagacagtcacactcacttgtggcttgagctctggctcagtctctcgtcggttacctcccctnttcggtaccagccacgaccccaggccacggcctccacgcatcgctcatgtacagacccaactaaactattcgctacgttcgtcggggtccctgatccgtcttctcgtcgtcctccacttccgtagggaaactaacgcctacgcccctacacccacgtccggaaccgggggcccagggcaaggataggatagtaactctactaatttacttaacgtgtcacctacttcgtaccgttagtttcggacgttacgtaagttgtaacttaagtttagttcggttcggggtttaccggacggggaacggtaacccgg

SEQ ID NO: 308741 - DNA, 638 bp, Homo sapiens
  misc_feature: GZ8MTXP02J0IA5.8.4.A04.1.454.CMB.2.raw
  modified_base (325)..(325): a, c, t, g, unknown or other
  misc_feature (325)..(325): n is a, c, g, or t
tcagctcgcgtgtccacgaccggtgctcgatttagagtagtgatcagggggggaagcctgagaacacttagccttcatgagtgtccccaccatggcctggatgatgcttctcctcggactccttgcttatggatcaggagtggattctgagactgtggtgacccaggagccgtcgttctccgtgtcccctggagagacagtcacactcacttgtggcttgagctctggctcagtctctcgtcggttaccctcccccttcttcggtaccagcacgaccccgacggccacggcctccacgcatgctcatgtacacgacaacaaactntcgctacttcgtcggggtccccctgatcgtcttctctcgcctccacttccgtaggaacaacgcctcgcccctacaccacgtacccgggaaccgggggcccagggaccaaggtataggaactaggtaaacttccttactaactttagttaccgtggttacgacctacgttcggtactttagttttcggcgttagtacgttacggttacttaaagttcggttcgggttacgggttaccgggggaaccggggaacggtaaccgtaacggtccgttaccggtacccgttaccggtacgggtaccaccggtaccccgg

SEQ ID NO: 308742 - DNA, 601 bp, Homo sapiens
  misc_feature: GZ8MTXP02IPRO2.8.4.A04.1.454.CMB.2.raw
  modified_base (254)..(254): a, c, t, g, unknown or other
  misc_feature (254)..(254): n is a, c, g, or t
  modified_base (262)..(262): a, c, t, g, unknown or other
  misc_feature (262)..(262): n is a, c, g, or t
  modified_base (482)..(482): a, c, t, g, unknown or other
  misc_feature (482)..(482): n is a, c, g, or t
tcagctcgcgtgtccacgaccggtgctcgatttagagtagtgatcagggggggaagcctgagaacacttagccttcatgagtgtccccaccatggcctggatgatgcttctcctcggactccttgcttatggatcaggagtggattctgagactgtggtgacccaggagccgtcgttctccgtgtcccctggagagacagtcacactcacttgtggcttgagctctggctcagtctctcgtgttacctcccctnttggaccngcacgaccccaggccaggctccacgcatgctcatgtacagcaaaccaaactattccgactaccttcggtcggggtccccctggtactcgtcctttctccgtcggtcctcctacttcccgttagggaaacctaaacggtcctccgaccctacaaccgtacgtcccgggacccgggggcccagggccaagtatgatagattctactatttactacgtgtacnctactggtcttatttcggattagacttacgtattaaatttggttcgggttcggttacggggaacgggtacggaaccgtaaggtccgtacggtaccgtccgtaaggtccaacgtacccgg

SEQ ID NO: 308743 - DNA, 650 bp, Homo sapiens
  misc_feature: GZ8MTXP02IY1QH.8.4.A04.1.454.CMB.2.raw
  modified_base (236)..(236): a, c, t, g, unknown or other
  misc_feature (236)..(236): n is a, c, g, or t
  modified_base (260)..(260): a, c, t, g, unknown or other
  misc_feature (260)..(260): n is a, c, g, or t
tcagctcgcgtgtccacgaccggtgctcgatttagagtagtgatcaggggggaagcctgagaacacttagccttcatgagtgtccccaccatggcctggatgatgcttctcctcggactccttgcttatggatcaggagtggattctgagactgtggtgacccaggagccgtcgttctccgtgtcccctggagagacagtcacactctactttggtggtcttgacgctctggctcngtctctcgtcgttaccctcccctnttcgtaccagcacgaccccgacggccacggcctccacgcagtcgctcatcgtacacgacaacctaaactcttaccgcttaccgttcggtacgggtcccctagtctcgtcctttctccgttacggtccttacctacgttccgttaacgggaaacctaaacgtcctaccgtacccctaccaacccgtacgtaccgggacccgggggacccgagggaccgaaggtacgtaggtaacgtacgtaaacttccttacttaacgttttaacttaccgtgggttactaccgtacgttacgtacgttagttccgtagtagtattacgtattaagttgtggttcggtacggacggtacgacgtaagccgtacgtaccgtacgtacgtacgacgtacccgg

SEQ ID NO: 308744 - DNA, 551 bp, Homo sapiens
  misc_feature: GZ8MTXP02J1OVQ.8.4.A04.1.454.CMB.2.raw
  modified_base (319)..(319): a, c, t, g, unknown or other
  misc_feature (319)..(319): n is a, c, g, or t
tcagctcgcgtgtccacgaccggtgctcgatttagagtagtgatcagggggggaagcctgagaacacttagccttcatgagtgtccccaccatggcctggatgatgcttctcctcggactccttgcttatggatcaggagtggattctgagactgtggtgacccaggagccgtcgttctccgtgtccctggagagacagtcacactcacttgtggcttgagctctggctcagtctcttcgttcggttaccctccccctcttcggtaccagcacgaccccaggccaggcctccacgcatgctcatgacagacaacaaacnttcgctacgttcgtcggggtccccctgactcgtcttctctcggctccactccgtagggaaacaacgctcgccctcacacgtccggacgggggccaggcagatgatacgaactctactatttacttacgtgtcgactcgttagcttagttgcgtagtattcgtataagttagttggtacggttcggacggacggactaagcgtacgaccgttacgtacggtacgacgtacccg

SEQ ID NO: 308745 - DNA, 598 bp, Homo sapiens
  misc_feature: GZ8MTXP02HFI2L.8.4.A04.1.454.CMB.2.raw
  modified_base (258)..(258): a, c, t, g, unknown or other
  misc_feature (258)..(258): n is a, c, g, or t
  modified_base (475)..(475): a, c, t, g, unknown or other
  misc_feature (475)..(475): n is a, c, g, or t
  modified_base (494)..(494): a, c, t, g, unknown or other
  misc_feature (494)..(494): n is a, c, g, or t
tcagctcgcgtgtccacgaccggtgctcgatttagagtagtgatcagggggggaagcctgagaacacttagccttcatgagtgtccccaccatggcctggatgatgcttctcctcggactccttgcttatggatcaggagtggattctgagactgtggtgacccaggagccgtcgttctccgtgtcccctggagagacagtcacactcacttgtggcttgagctctggctcagtctctcgttcggttacctccccctnttcggtaccagcacgaccccaggccaggcctccacgcatgctacatcgtaacagaccaaacaaaactacgttccgactacgttcgtcggggtacccccctgtactcgtcttcgtcctggtcctcctattccgttagggaaacaacgctccgccctacaccatccggacgggggacccaggaccagtatagatagaaattctactaatttagtactgngactagtcgtatacgttgngtagattcggtaattaaattgtaggtttcggttaccgggacgggaacgggaaaccaacggtcctacggtacccgtaccggtttacgaccgtaacggaaccccgg

SEQ ID NO: 308746 - DNA, 714 bp, Homo sapiens
  misc_feature: GZ8MTXP02JH5ME.8.4.A04.1.454.CMB.2.raw
  modified_base (352)..(352): a, c, t, g, unknown or other
  misc_feature (352)..(352): n is a, c, g, or t
tcagctcgcgtgtccacgaccggtgctcgatttagagtagtgatcagggggaaaaggccctgaggaaaacaaaccccagctgggaagcctgagaacacttagccttcatgagtgtccccaccatggcctggatgatgcttctcctcggactccttgcttatggatcaggagtggattctgagactggtggtcgacccgaggagccgtcgttcctccgtcgtcccctggagagacagtcacactcacttgtggcttgacgtctctggctcagtctctcgtcgttaccctcccctgttcggaccacgcaccgaccccaggcccaggcctccgacgcatcgcctcattcgaacanaccccaactaaaactcttaccgctaccttcggtcggggtccctaggacttccgtcttctcgtaccggtcctacctacgttcccgtaagggaaacctaacggtcctaccgaccctaccaaccgtaccgtaccggggaacccgggggaccccaagggggaccaagggtacgtacgggtaaagttaccgtaaacgttaccccttacgttaaagttttaaccttaacccggtggtaccgtaccttaaccgggtttcgttaccgtttacggtttacggaccgttagtaacgttaagttaacgtttaaggtttacgggttcggggtttaaccggggtaaccgggggtaccgggtaaacgggtaaaccg

SEQ ID NO: 308747 - DNA, 535 bp, Homo sapiens
  misc_feature: GZ8MTXP02GO5SF.3.3.A03.1.454.CMB.2.raw
  modified_base (244)..(244): a, c, t, g, unknown or other
  misc_feature (244)..(244): n is a, c, g, or t
  modified_base (278)..(278): a, c, t, g, unknown or other
  misc_feature (278)..(278): n is a, c, g, or t
  modified_base (304)..(304): a, c, t, g, unknown or other
  misc_feature (304)..(304): n is a, c, g, or t
tcagagacgcactccacgaccggtgctcgatttagagagcgtcacagagaggaaggggctgggagaggagcccagcactagaagtcggcggtgtttccattcggtgatcagcactgaacacagaggactcaccatggagtttgggctgagttgggttttcctcgttgcttcttttaagaggtgtccactgtcagctgcttctagttgaggtcgggggagcgtggcccagcctgggacgtccctnagactctcctgtgcagcgtctggattcagtttcnctacacatggcatgcacgtgggtccnccagtctcgaggcgaaggggctgcaggtgggtgccgtttatcgaagcgagtgggactcgatcgaaacaatatgacagactccggtaggaagggccgtattcatccatctaccagaacgacaaacctaccaaacaaacacactacggactaccgtaaccaaaatacgaacacgcctagagagtacgacgaacgacgacgtatattagtgtcgaccttgtacttactatagta

SEQ ID NO: 308748 - DNA, 647 bp, Homo sapiens
  misc_feature: GZ8MTXP02HNJLS.3.3.A03.1.454.CMB.2.raw
  modified_base (311)..(311): a, c, t, g, unknown or other
  misc_feature (311)..(311): n is a, c, g, or t
tcagagacgcactccacgaccggtgctcgatttagagagcgtcacagagaggaaggggctgggagaggagcccagcactagaagtcggcggtgtttccattcggtgatcagcactgaacacagagactcaccatggagtttgggctgagtttgggttttcctcgttgcttcttttaagaggtgtccactgtcagctgcttctagttgaggtcgggggagcgtggcccagccgtgggacggtccctcgagactctcctgtgcagcgtctggacttcagttcgactacacagtggcatgcacgtcgggtcccnccgagtcctccgaggcgaaggggctgcgtaggtcggggtgtcgtttagtcggaagtcggtagtcgggactcgaagtacgaaactaaattacgtacgacaacgtaccgttacggtacggaacggccgtaattacaactcctaactccgtaccgaagtaacgaaacctaaacctaacccaaaacaaccacgtaacgtacgtaaacctacctaaaccaaagttacgaaacgtacgaccgtagaacggtacggtacggaaacggtaccgaacggtaccgtaaatttacgtttacgttaacgtccgttacctttagtacctttaagtacgttaagttaacg

SEQ ID NO: 308749 - DNA, 543 bp, Homo sapiens
  misc_feature: GZ8MTXP01CPEMC.13.81.H04.1.454.CMB.2.raw
  modified_base (280)..(280): a, c, t, g, unknown or other
  misc_feature (280)..(280): n is a, c, g, or t
  modified_base (333)..(333): a, c, t, g, unknown or other
  misc_feature (333)..(333): n is a, c, g, or t
  modified_base (417)..(417): a, c, t, g, unknown or other
  misc_feature (417)..(417): n is a, c, g, or t
  modified_base (442)..(442): a, c, t, g, unknown or other
  misc_feature (442)..(442): n is a, c, g, or t
tcagtcacgtactacacgaccggtgctcgatttagtagtgtagattcgcggggggtctgggcctaaggaagcagcactggtggtgcctcagccatggcctggaccgttctcctcctcggcctcctctctcactgcacaggctctgtgacctcctatgtgctgactcagccaccctcggtgtcagtggccccaggacagacggccaggatacctgtgggggaaacaacattggaagtaaaagtgtgcactggtaccagcagaagccaggccaggcccctgngctggtcgtctatgttgatagcgaccggcctcagggactccctgagcgattcncgggctccaactctagggaacacggccaactctcgaccatcagtagggtcgaagccggggatgaggcgatatactgtcaggtgngggatagtagtcgtggagcattggnggtagttcgggcggtaagggaccaaagtgacccgtctaaggtcagcccaaggcctcgccccgttcggcaactctcgttcccacccttcctcgttaacgtcg

SEQ ID NO: 308750 - DNA, 537 bp, Homo sapiens
  misc_feature: GZ8MTXP01CLTDX.13.81.H04.1.454.CMB.2.raw
  modified_base (236)..(236): a, c, t, g, unknown or other
  misc_feature (236)..(236): n is a, c, g, or t
  modified_base (362)..(362): a, c, t, g, unknown or other
  misc_feature (362)..(362): n is a, c, g, or t
tcagtcacgtactacacgaccggtgctcgatttagtagtgtagattcgcggggggtctcaggaggcagcgctctcgggacgtctccaccatggcctgggctctgctattcctcaccctcctcactcagggcatagggtcctgggcccagtctgccctgactcagcctgcctccgtgtctgggtctcctggacagtcgatcaccatctcctgcactgggaccagcagtgacgttcgnggtcaagactatgtctcctggtaccaacaacacccaggcaaggcccccaaactcaataatttatgatttcactaatcggccctcaggtgtatctaatcgcttcactcggctcaagtctggacaacncggcctccctgaccatctctgggctcaggcagaggacgaggctgattatactgcggctcggtaggacgtattacgcctaccctttatcgtacttcggggtactgtacgaccgtaaggtccaccgtcttaggtccagcccgaaggcccaacccatcgtcacttctcgttcccgccc

SEQ ID NO: 308751 - DNA, 512 bp, Homo sapiens
  misc_feature: GZ8MTXP01ENRV3.13.81.H04.1.454.CMB.2.raw
  modified_base (358)..(358): a, c, t, g, unknown or other
  misc_feature (358)..(358): n is a, c, g, or t
  modified_base (376)..(376): a, c, t, g, unknown or other
  misc_feature (376)..(376): n is a, c, g, or t
  modified_base (493)..(493): a, c, t, g, unknown or other
  misc_feature (493)..(493): n is a, c, g, or t
  modified_base (496)..(496): a, c, t, g, unknown or other
  misc_feature (496)..(496): n is a, c, g, or t
  modified_base (498)..(498): a, c, t, g, unknown or other
  misc_feature (498)..(498): n is a, c, g, or t
  modified_base (511)..(511): a, c, t, g, unknown or other
  misc_feature (511)..(511): n is a, c, g, or t
tcagtcacgtactacacgaccggtgctcgatttagtagtgtagattcgcgggggtctcaggaggcagcgctctcgggacgtctccaccatggcctgggctctgctattcctcaccctcctcactcagggcatagggtcctgggcccagtctgccctgactcagcctgcctccgtgtctgggtctcctggacagtcgatcaccatctcctgcactgggaccagcagtgacgttcgtggtcaagactatgtctcctggtaccaacaacacccaggcaaggcccccaaatcataatttatgatttcactaatcggccctcaggtgtatctaatcgcttcactcggctcaagtctggcaacncggcctccctgaccatcnctgggctccaggcagaggacgaggctgattatactgcggctcgtggacgtattagctaccctttatgtacttcgggactgtcgaccaaggtcacgtcaggtcagcccagccaacccntcncncttctcgttcccnc

SEQ ID NO: 308752 - DNA, 550 bp, Homo sapiens
  misc_feature: GZ8MTXP01ELJW3.13.81.H04.1.454.CMB.2.raw
  modified_base (296)..(296): a, c, t, g, unknown or other
  misc_feature (296)..(296): n is a, c, g, or t
  modified_base (322)..(322): a, c, t, g, unknown or other
  misc_feature (322)..(322): n is a, c, g, or t
  modified_base (527)..(527): a, c, t, g, unknown or other
  misc_feature (527)..(527): n is a, c, g, or t
tcagtcacgtactacacgaccggtgctcgatttagtagtgtagattcgcggggggtctcaggaggcagcgctctcgggacgtctccaccatggcctgggctctgctattcctcaccctcctcactcagggcatagggtcctgggcccagtctgccctgactcagcctgcctccgtgtctgggtctcctggacagtcgatcaccatctcctgcactgggaccagcagtgacgttcgtggtcaagactatgtctcctggtaccaacaacacccagcaacggccccaaatcataattangtatttcactaatcggccctcgagtntatctaatcgtcttcactcgcctacaagtctggaacaacgccggccctccctagacctatctcgtcgggcctcgaggcgaggaggacgaggtctagattatactgcgcttcggtggacgtattacgacctacctttagtcgttacgttcggtactgtcgaccaaggtccaccgtcgttacggtcacgacccgagccccaaccctntctcacttctccgttcccgtccc

SEQ ID NO: 308753 - DNA, 544 bp, Homo sapiens
  misc_feature: GZ8MTXP01EJBAQ.13.81.H04.1.454.CMB.2.raw
  modified_base (293)..(293): a, c, t, g, unknown or other
  misc_feature (293)..(293): n is a, c, g, or t
  modified_base (317)..(317): a, c, t, g, unknown or other
  misc_feature (317)..(317): n is a, c, g, or t
  modified_base (449)..(449): a, c, t, g, unknown or other
  misc_feature (449)..(449): n is a, c, g, or t
  modified_base (517)..(517): a, c, t, g, unknown or other
  misc_feature (517)..(517): n is a, c, g, or t
tcagtcacgtactacacgaccggtgctcgatttagtagtgtagattcgcgggggggtctcaggaggcagcgctctcgggacgtctccaccatggcctgggctctgctattcctcaccctcctcactcagggcatagggtcctgggcccagtctgccctgactcagcctgcctccgtgtctgggtctcctggacagtcgatcaccatctcctgcactgggaccagcagtgacgttcgtggtcaagctatgtctcctggtaccaacacaccaggcaagccccaaatcataattangatttcactaatcgccctcaggtntatctaatcgcttcactcggctcaagtctggacaacgcggccctccctgacctatctcgtgggctccaggcaggaggacgaggctgatttatacgtgcggctccggtgggacgtattaacgctaaccctttntcgttacttcggggtactggttcgactaaggtcaccgtcttagggtcacggcccaaggcccaaacccnctcgtcacttcctcgttcccctaaccc

SEQ ID NO: 308754 - DNA, 558 bp, Homo sapiens
  misc_feature: GZ8MTXP01EHOTP.13.81.H04.1.454.CMB.2.raw
  modified_base (236)..(236): a, c, t, g, unknown or other
  misc_feature (236)..(236): n is a, c, g, or t
  modified_base (297)..(297): a, c, t, g, unknown or other
  misc_feature (297)..(297): n is a, c, g, or t
  modified_base (356)..(356): a, c, t, g, unknown or other
  misc_feature (356)..(356): n is a, c, g, or t
  modified_base (442)..(442): a, c, t, g, unknown or other
  misc_feature (442)..(442): n is a, c, g, or t
tcagtcacgtactacacgaccggtgctcgatttagtagtgtagattcgcggggggtctcaggaggcagcgctctcgggacgtctccaccatggcctgggctctgctattcctcaccctcctcactcagggcatagggtcctgggcccagtctgccctgactcagcctgcctccgtgtctgggtctcctggacagtcgatcaccatctcctgcactgggaccagcagtgacgttcgnggtcaaagactatgtctcctggtaccaacaacacccaggcaaggccccaaatcataattangatttcactaatcggcctcaggtgtatctaatcgcttcactggctcaagtctggcaacncggcctccctgaccatctctggctcaggcagaggacgaggctgattatactgcgtctcggtggacgtattagcctaacccgttttntcgttcgttcggtactgtacgaaccgaaggttcccacgttccgttaggtccaacgaccccgaaaggaccccaaacccgtcgttcgtacctaccttccttcccgtttcccccaaccc

SEQ ID NO: 308755 - DNA, 552 bp, Homo sapiens
  misc_feature: GZ8MTXP01AGC7V.13.81.H04.1.454.CMB.2.raw
  modified_base (298)..(298): a, c, t, g, unknown or other
  misc_feature (298)..(298): n is a, c, g, or t
  modified_base (322)..(322): a, c, t, g, unknown or other
  misc_feature (322)..(322): n is a, c, g, or t
  modified_base (358)..(358): a, c, t, g, unknown or other
  misc_feature (358)..(358): n is a, c, g, or t
  modified_base (451)..(451): a, c, t, g, unknown or other
  misc_feature (451)..(451): n is a, c, g, or t
  modified_base (525)..(525): a, c, t, g, unknown or other
  misc_feature (525)..(525): n is a, c, g, or t
tcagtcacgtactacacgaccggtgctcgatttagtagtgtagattcgcgggggggtctcaggaggcagcgctctcgggacgtctccaccatggcctgggctctgctattcctcaccctcctcactcagggcatagggtcctgggcccagtctgccctgactcagcctgcctccgtgtctgggtctcctggacagtcgatcaccatctcctgcactgggaccagcagtgacgttcgtggtcaagctatgtctcctggtaccaacaacacccaggcaacggcccccaaatcataattangatttcactaatcggcctcaggtntatctaatcgcttcactcgctcaagtctggacaacncggcctccctgacccatctcgtgggcctcgaggcaggaggacgaggctgattattactgcggtctccgtggacgtattacgcctaccctttangttacgttcgggtactggtcgaccctaaggtccaccggtcttaaggtccaacgccccgaacggcccaaccccgntcgtccacttcttcgttcccctaaccc

SEQ ID NO: 308756 - DNA, 550 bp, Homo sapiens
  misc_feature: GZ8MTXP01CM822.13.81.H04.1.454.CMB.2.raw
  modified_base (236)..(236): a, c, t, g, unknown or other
  misc_feature (236)..(236): n is a, c, g, or t
  modified_base (297)..(297): a, c, t, g, unknown or other
  misc_feature (297)..(297): n is a, c, g, or t
  modified_base (358)..(358): a, c, t, g, unknown or other
  misc_feature (358)..(358): n is a, c, g, or t
  modified_base (442)..(442): a, c, t, g, unknown or other
  misc_feature (442)..(442): n is a, c, g, or t
  modified_base (520)..(520): a, c, t, g, unknown or other
  misc_feature (520)..(520): n is a, c, g, or t
tcagtcacgtactacacgaccggtgctcgatttagtagtgtagattcgcggggggtctcaggaggcagcgctctcgggacgtctccaccatggcctgggctctgctattcctcaccctcctcactcagggcatagggtcctgggcccagtctgccctgactcagcctgcctccgtgtctgggtctcctggacagtcgatcaccatctcctgcactgggaccagcagtgacgttcgnggtcaagctatgtctcctggtaccaacaacacccaggcaaggcccccaaatcataatttangatttcactaatcggccctcaggtgtatctaatcgcttcactcggctcaagtctggcaacncggccctccctgaccatctctgggctcaggcagaggacgagctgattatactgcggctccgtggacgattacgctaccctttancgttacgttcgggactgtcgacctaaagggtccaccggtccttagggtaccacggccccgaaagggccccaaaccccnttcggtccacttcctcgttcccctaacccc

SEQ ID NO: 308757 - DNA, 538 bp, Homo sapiens
  misc_feature: GZ8MTXP01COIIL.13.81.H04.1.454.CMB.2.raw
  modified_base (317)..(317): a, c, t, g, unknown or other
  misc_feature (317)..(317): n is a, c, g, or t
  modified_base (354)..(354): a, c, t, g, unknown or other
  misc_feature (354)..(354): n is a, c, g, or t
tcagtcacgtactacacgaccggtgctcgatttagtagtgtagattcgcgggggggtctcaggaggcagcgctctcgggacgtctccaccatggcctgggctctgctattcctcaccctcctcactcagggcatagggtcctgggcccagtctgccctgactcagcctgcctccgtgtctgggtctctggacagtcgatcaccatctctgcactgggaccagcagtgacgttcgtggtcaagactatgtctctgtaccaacaacacccaggcaacgaccccaaatcataattatgatttcaactaatcgcctcagtntatctaatcgcttcactcgctacaagtctgaacaacnccgcctccctagacccatctcgtgggcctccgaggcagaggacgaggctagattatacgtgcgctcgtggacgtatacgctacctttagcgtacgttcggactgtcgaactaaggtccaccggtcacggtacacgcccgacggccccaacccgactctaccacttcctccgttcccctaacccc

SEQ ID NO: 308758 - DNA, 567 bp, Homo sapiens
  misc_feature: GZ8MTXP01AN6UD.13.81.H04.1.454.CMB.2.raw
  modified_base (360)..(360): a, c, t, g, unknown or other
  misc_feature (360)..(360): n is a, c, g, or t
  modified_base (536)..(536): a, c, t, g, unknown or other
  misc_feature (536)..(536): n is a, c, g, or t
tcagtcacgtactacacgaccggtgctcgatttagtagtgtagattcgcgggggggtctcaggaggcagcgctctcgggacgtctccaccatggcctgggctctgctattcctcaccctcctcactcagggcatagggtcctgggcccagtctgccctgactcagcctgcctccgtgtctgggtctcctggacagtcgatcaccatctcctgcactgggaccagcagtgacgttcgtggtcaagactatgtctctgtaccaacaacaccagcaacggccccaaactcataattatgatttcactaatccgcctcaggtgtatctaatccgcttacacttcggctcaagtctggaacaacncggccctccctgaccatctcgtcgggcctcgagcgaggaaggacgagggctagtattattacgtgtcggcttcggtgggactagttacgacctacctttagtcgttcgttcggtacttgtacgaacgaacggtccaccgtcttacgggtacacgacccgaacggaccccaaccccntaaccgtctaccttctcccgttccctccccg

SEQ ID NO: 308759 - DNA, 530 bp, Homo sapiens
  misc_feature: GZ8MTXP01EEPK0.13.81.H04.1.454.CMB.2.raw
  modified_base (313)..(313): a, c, t, g, unknown or other
  misc_feature (313)..(313): n is a, c, g, or t
  modified_base (318)..(318): a, c, t, g, unknown or other
  misc_feature (318)..(318): n is a, c, g, or t
  modified_base (358)..(358): a, c, t, g, unknown or other
  misc_feature (358)..(358): n is a, c, g, or t
  modified_base (372)..(372): a, c, t, g, unknown or other
  misc_feature (372)..(372): n is a, c, g, or t
  modified_base (505)..(505): a, c, t, g, unknown or other
  misc_feature (505)..(505): n is a, c, g, or t
tcagtcacgtactacacgaccggtgctcgatttagtagtgtagattcgcggggggggtctcaggaggcagcgctctcgggacgtctccaccatggcctgggctctgctattcctcaccctcctcactcagggcatagggtcctgggcccagtctgccctgactcagcctgcctccgtgtctgggtctcctggacagtcgatcaccatctcctgcactgggaccagcagtgacgttcgtggtcaaagactatgtctcctggtaccaacaacaccagcaacgacccaatcataattatgatttcataatcgcctnaggtntatctaatcgcttcactcggctacaagtctaggaacaacncggccctcccgtanaccatctgtcgggctcgaggcagaggacgaggctagattatacgtgcgctccggtggactattacgctaccttatgtcttcgggatgtcgacgtaaggtcacggtcttacggcaagcccgaagccccaaaccntcgtcacttctccgttccctaaccc

SEQ ID NO: 308760 - DNA, 541 bp, Homo sapiens
  misc_feature: GZ8MTXP01AYY6I.13.81.H04.1.454.CMB.2.raw
  modified_base (359)..(359): a, c, t, g, unknown or other
  misc_feature (359)..(359): n is a, c, g, or t
  modified_base (376)..(376): a, c, t, g, unknown or other
  misc_feature (376)..(376): n is a, c, g, or t
  modified_base (411)..(411): a, c, t, g, unknown or other
  misc_feature (411)..(411): n is a, c, g, or t
  modified_base (512)..(512): a, c, t, g, unknown or other
  misc_feature (512)..(512): n is a, c, g, or t
tcagtcacgtactacacgaccggtgctcgatttagtagtgtagattcgcgggggggtctcaggaggcagcgctctcgggacgtctccaccatggcctgggctctgctattcctcaccctcctcactcagggcatagggtcctgggcccagtctgccctgactcagcctgcctccgtgtctgggtctcctggacagtcgatcaccatctcctgcactgggaccagcagtgacgttcgtggtcaagctatgtctcctggtaccaacaacacccaggcaacggccccaaatcataatttatgatttcactaatcggcctcaggtgtatctaatcgcttcactcggctcaagtctggacaacncggcctcctgaccatcnctgggctccaggcagaggacgaggctgattatacngcgctcgtggacgtattacgctacccttatcgtcgttcgggtacctgtcgaccgtaaggtccaccggtcttacgggtcaacgcccgaaggccccaaacccnctcgtcacttcctcgttcccctaaccccg

SEQ ID NO: 308761 - DNA, 537 bp, Homo sapiens
  misc_feature: GZ8MTXP01D78DH.13.81.H04.1.454.CMB.2.raw
  modified_base (295)..(295): a, c, t, g, unknown or other
  misc_feature (295)..(295): n is a, c, g, or t
  modified_base (318)..(318): a, c, t, g, unknown or other
  misc_feature (318)..(318): n is a, c, g, or t
  modified_base (353)..(353): a, c, t, g, unknown or other
  misc_feature (353)..(353): n is a, c, g, or t
  modified_base (413)..(413): a, c, t, g, unknown or other
  misc_feature (413)..(413): n is a, c, g, or t
  modified_base (463)..(463): a, c, t, g, unknown or other
  misc_feature (463)..(463): n is a, c, g, or t
  modified_base (511)..(511): a, c, t, g, unknown or other
  misc_feature (511)..(511): n is a, c, g, or t
tcagtcacgtactacacgaccggtgctcgatttagtagtgtagattcgcgggggggtctcaggaggcagcgctctcgggacgtctccaccatggcctgggctctgctattcctcaccctcctcactcagggcatagggtcctgggcccagtctgccctgactcagcctgcctccgtgtctgggtctcctggacagtcgatcaccatctcctgcactgggaccagcagtgacgttgtggtacaagactatgtctcctggtaccaacaacaccaggcaacgccccaatcataattangatttcactaatcgcctcaggtntatctaatcgctcactcgctcaagtctggacaacnccggcctcccagaccatctcgtcggctccgaggcaggaggacgaggctagattattacgngccgctccggaggtacgtattacgctaccctttagtcgttacttcgggtntgtcgactaaggtcaccgtcgttaggcacgccgacggcccaaaccctntcgtcaccttctccgttccctaaccc

SEQ ID NO: 308762 - DNA, 532 bp, Homo sapiens
  misc_feature: GZ8MTXP01D76VP.13.81.H04.1.454.CMB.2.raw
  modified_base (236)..(236): a, c, t, g, unknown or other
  misc_feature (236)..(236): n is a, c, g, or t
  modified_base (356)..(356): a, c, t, g, unknown or other
  misc_feature (356)..(356): n is a, c, g, or t
  modified_base (408)..(408): a, c, t, g, unknown or other
  misc_feature (408)..(408): n is a, c, g, or t
  modified_base (501)..(501): a, c, t, g, unknown or other
  misc_feature (501)..(501): n is a, c, g, or t
tcagtcacgtactacacgaccggtgctcgatttagtagtgtagattcgcggggggtctcaggaggcagcgctctcgggacgtctccaccatggcctgggctctgctattcctcgccctcctcactcagggcatagggtcctgggcccagtctgccctgactcagcctgcctccgtgtctgggtctcctggacagtcgatcaccatctcctgcactgggaccagcagtgacgttcgnggtcaagctatgtctcctggtaccaacaacacccaggcaaggcccccaaatcataatttatgatttcactaatcggcctcaggtgtatctaatcgcttcactcgctcaagtctggcaacncgctccctgaccatctctgggctccgaggcagagacgaggctgattattacngcgctcgtgacgtattacgctaccttatcgtcgttcggtatgtacgacgtaaggtccacgtccttaggtcacgacccgaacggacccaacccnctcgtcctacgttccttccgttccccgtccc

SEQ ID NO: 308763 - DNA, 533 bp, Homo sapiens
  misc_feature: GZ8MTXP01EZSB5.13.81.H04.1.454.CMB.2.raw
  modified_base (360)..(360): a, c, t, g, unknown or other
  misc_feature (360)..(360): n is a, c, g, or t
  modified_base (368)..(368): a, c, t, g, unknown or other
  misc_feature (368)..(368): n is a, c, g, or t
  modified_base (414)..(414): a, c, t, g, unknown or other
  misc_feature (414)..(414): n is a, c, g, or t
  modified_base (509)..(509): a, c, t, g, unknown or other
  misc_feature (509)..(509): n is a, c, g, or t
tcagtcacgtactacacgaccggtgctcgatttagtagtgtagattcgcgggggggtctcaggaggcagcgctctcgggacgtctccaccatggcctgggctctgctattcctcaccctcctcactcagggcatagggtcctgggcccagtctgccctgactcagcctgcctccgtgtctgggtctcctggacagtcgatcaccatctcctgcactgggaccagcagtgacgttcgtggtcaagactatgtctcctggtaccaacaacaccaggcaacggcccccaaactcataattatgatttcactaatcggcctcagtgtatctaatcgcttcactcggctcaagtctggaacaacncgcctccngaccatctcgtcgggctcgaggcagaggacgaggctgattatacgngcgctccgtggacgtattacgctaccctttagtcgtcttcgggtactgtcgaaccaaggtccaccggtcttaggtcacggccacggcccaacccntcgtcacttctcgttccccgtccc

SEQ ID NO: 308764 - DNA, 592 bp, Homo sapiens
  misc_feature: GZ8MTXP01D7MIQ.13.81.H04.1.454.CMB.2.raw
  modified_base (199)..(199): a, c, t, g, unknown or other
  misc_feature (199)..(199): n is a, c, g, or t
  modified_base (205)..(205): a, c, t, g, unknown or other
  misc_feature (205)..(205): n is a, c, g, or t
  modified_base (220)..(220): a, c, t, g, unknown or other
  misc_feature (220)..(220): n is a, c, g, or t
  modified_base (234)..(234): a, c, t, g, unknown or other
  misc_feature (234)..(234): n is a, c, g, or t
  modified_base (373)..(373): a, c, t, g, unknown or other
  misc_feature (373)..(373): n is a, c, g, or t
  modified_base (569)..(569): a, c, t, g, unknown or other
  misc_feature (569)..(569): n is a, c, g, or t
  modified_base (573)..(573): a, c, t, g, unknown or other
  misc_feature (573)..(573): n is a, c, g, or t
tcagtcacgtactacacgaccggtgctcgatttagtagtgtagattcgcgggggtctcaggaggcagcgctctcgggacgtctccaccatggcctgggctctgctattcctcaccctcctcactcagggcatagggtcctgggcccagtctgccctgactcagcctgcctccgtgtctggtctcctggacagtcgatcnccatcncctgcactcggaccngcagtgacgttcgnggtcaagactatcgtctcctgtaccaacaacaccagaccaacgacccaactactataattatgtattcactaatcgacctcgagtgtatctatcgctcacgtcgctacaagtcgtgaaccaacgccgtcctcctagccncttcgctttcgggcacgacggacgaggacggagtacgggtctagttaacgttagttccgtcggtccgtccgtaccggggtcggtaaacgttcgtacccgtcgttaacccgttagtttcggtacgttacggtacgtacgtacgaacggtaacgtaccgttaccgtaccgttacgacgccaaccgaccgccctaaccnctcnctcttcctcccgttccgtc

SEQ ID NO: 308765 - DNA, 564 bp, Homo sapiens
  misc_feature: GZ8MTXP01AVR3H.13.81.H04.1.454.CMB.2.raw
  modified_base (235)..(235): a, c, t, g, unknown or other
  misc_feature (235)..(235): n is a, c, g, or t
  modified_base (293)..(293): a, c, t, g, unknown or other
  misc_feature (293)..(293): n is a, c, g, or t
  modified_base (317)..(317): a, c, t, g, unknown or other
  misc_feature (317)..(317): n is a, c, g, or t
  modified_base (356)..(356): a, c, t, g, unknown or other
  misc_feature (356)..(356): n is a, c, g, or t
  modified_base (536)..(536): a, c, t, g, unknown or other
  misc_feature (536)..(536): n is a, c, g, or t
tcagtcacgtactacacgaccggtgctcgatttagtagtgtagattcgcggggggtctcaggaggcagcgctctcgggacgtctccaccatggcctgggctctgctattcctcaccctcctcactcagggcatagggtcctgggcccagtctgccctgactcagcctgcctccgtgtctgggtctcctggacagtcatcaccatctcctgcactgggaccagcagtgacgttcgnggtcaagctatgtctcctggtaccaacaacacccagcaaggccccaaatcataattangatttcactaatcggcctcaggtntatctaatcgcttcactcggctacaagtctggacaaacncggccctccctagacctagtctcgtcggggctcccgaggcaggacggacgaggctgatttatactgcggtctccgtgggacattacgcctaccctttagtcgttccgtttcgggacttggtcgaaccgaacgggtcttaccggtcttacgggtacacgccccgaacgccccaaaccccgntcgtccacttccttcgttcccctaaccc

SEQ ID NO: 308766 - DNA, 554 bp, Homo sapiens
  misc_feature: GZ8MTXP01EC8OQ.13.81.H04.1.454.CMB.2.raw
  modified_base (318)..(318): a, c, t, g, unknown or other
  misc_feature (318)..(318): n is a, c, g, or t
  modified_base (323)..(323): a, c, t, g, unknown or other
  misc_feature (323)..(323): n is a, c, g, or t
  modified_base (350)..(350): a, c, t, g, unknown or other
  misc_feature (350)..(350): n is a, c, g, or t
  modified_base (358)..(358): a, c, t, g, unknown or other
  misc_feature (358)..(358): n is a, c, g, or t
  modified_base (364)..(364): a, c, t, g, unknown or other
  misc_feature (364)..(364): n is a, c, g, or t
  modified_base (391)..(391): a, c, t, g, unknown or other
  misc_feature (391)..(391): n is a, c, g, or t
tcagtcacgtactacacgaccggtgctcgatttagtagtgtagattcgcgggggggtctcaggaggcagcgctctcgggacgtctccaccatggcctgggctctgctattcctcaccctcctcactcagggcatagggtcctgggcccagtctgccctgactcagcctgcctccgtgtctgggtctcctggacagtcgatcaccatctcctgcacgtgggaccagctagtgacgttcgtggtacaagactatgtctcctggtaccaaacaacaccagcaacggccccaaatcataattatgattcactaatcggcctnaggtntatctaatcgcttcactgctcaagtcnggacaacncgtccncctgacatctgtggctaccaggcaggnggacgaggctagattattacgtgaccgtctcgtaggtactattacgccttacctttagttcgttcgttgggtactgtcaaccgtaaggtcaccgtcgttacgtcaacgcccgacggttacccaacccgtactcgcctaccttcttaaccgttcccctaacccg

SEQ ID NO: 308767 - DNA, 600 bp, Homo sapiens
  misc_feature: GZ8MTXP01DMNRZ.13.81.H04.1.454.CMB.2.raw
  modified_base (239)..(239): a, c, t, g, unknown or other
  misc_feature (239)..(239): n is a, c, g, or t
  modified_base (306)..(306): a, c, t, g, unknown or other
  misc_feature (306)..(306): n is a, c, g, or t
  modified_base (334)..(334): a, c, t, g, unknown or other
  misc_feature (334)..(334): n is a, c, g, or t
  modified_base (448)..(448): a, c, t, g, unknown or other
  misc_feature (448)..(448): n is a, c, g, or t
tcagtcacgtactacacgaccggtgctcgatttagtagtgtagattcgcggggggggtctcaggaggcagcgctctcgggacgtctccaccatggcctgggctctgctattcctcaccctcctcactcagggcatagggtcctgggcccagtctgccctgactcagcctgcctccgtgtctgggtctccgtggacagtcgatcaccatctcctgcactgggaccagcagtgacgttcgnggtcaagctatgtctcctggtaaccaacaacaccccaggccaacggcccccaaaactcataatttangtactttcaactaatcggccctcaggtntatctaatcgcttcactcggctacaagtctggaacaaccaacggccctccctcgaccatctacgtgggacctcgaggcagacggacgaggctgtattattacgtgcgctccggnggacgtattacggcctaccgtttatcgttcgttcggtacttgcggaacctaacgggtccacccggttccgttaggtacccgagacccccgaaacgggcccccaaaaccccgcttcggtccctaccttccttcccgttaacccctaacccccg

SEQ ID NO: 308768 - DNA, 522 bp, Homo sapiens
  misc_feature: GZ8MTXP01AZGBV.13.81.H04.1.454.CMB.2.raw
  modified_base (298)..(298): a, c, t, g, unknown or other
  misc_feature (298)..(298): n is a, c, g, or t
  modified_base (317)..(317): a, c, t, g, unknown or other
  misc_feature (317)..(317): n is a, c, g, or t
  modified_base (322)..(322): a, c, t, g, unknown or other
  misc_feature (322)..(322): n is a, c, g, or t
  modified_base (360)..(360): a, c, t, g, unknown or other
  misc_feature (360)..(360): n is a, c, g, or t
  modified_base (378)..(378): a, c, t, g, unknown or other
  misc_feature (378)..(378): n is a, c, g, or t
  modified_base (416)..(416): a, c, t, g, unknown or other
  misc_feature (416)..(416): n is a, c, g, or t
  modified_base (426)..(426): a, c, t, g, unknown or other
  misc_feature (426)..(426): n is a, c, g, or t
  modified_base (431)..(431): a, c, t, g, unknown or other
  misc_feature (431)..(431): n is a, c, g, or t
  modified_base (444)..(444): a, c, t, g, unknown or other
  misc_feature (444)..(444): n is a, c, g, or t
  modified_base (455)..(455): a, c, t, g, unknown or other
  misc_feature (455)..(455): n is a, c, g, or t
  modified_base (500)..(500): a, c, t, g, unknown or other
  misc_feature (500)..(500): n is a, c, g, or t
tcagtcacgtactacacgaccggtgctcgatttagtagtgtagattcgcgggggggtctcaggaggcagcgctctcgggacgtctccaccatggcctgggctctgctattcctcaccctcctcactcagggcatagggtcctgggcccagtctgccctgactcagcctgcctccgtgtctgggtctcctggacagtcgatcaccatctcctgcactgggaccagcagtgacgttcgtggtcaagctatgtctcctggtaccaacaacacccaggcaacggccccaaactcataattangatttcactaatcggcctnaggtntatctaatcgcttcactcggctcaagtctggaacaacncggcctcctgacctatcnctgggcctcgaggcagaggacgaggctgattattacgngcgtctcggngactntacgctaccgttntcgtcgtcggntgtacgactaagtccacgtcacgtcacgacccgacgcccaacctntctcacttcctccgttccctcc

SEQ ID NO: 308769 - DNA, 591 bp, Homo sapiens
  misc_feature: GZ8MTXP01CUHY8.13.81.H04.1.454.CMB.2.raw
  modified_base (443)..(443): a, c, t, g, unknown or other
  misc_feature (443)..(443): n is a, c, g, or t
tcagtcacgtactacacgaccggtgctcgatttagtagtgtagattcgcggggggggtctcaggaggcagcgctctcgggacgtctccaccatggcctgggctctgctattcctcaccctcctcactcagggcatagggtcctgggcccagtctgccctgactcagcctgcctccgtgtctgggtctcctggacagtcgatcaccatctcctgcacgtgggaccagcagtgacgttcgtggtacaagactatgtctcctagtaccaacaacaccagacaacgaccccaaatcataattatgtattacactaatccgcctcgagtgtatactaatcgtcttcacgtcggctacaagtctcggaacaaccgccggtccctcccgtacgacctactccgtcgtcgggcctcgaaggcaggacggaacgaggtctagtattatacgnggacgtcctcggtagacgtatacgccttaaccttgtcgttcgtcggtactggtacgaccgtaaggtccttaccggtccgttaggtaccacgaccccgacggacccctaaccacttcgtcctaccgttccttcccgttcccctaacccc

SEQ ID NO: 308770 - DNA, 570 bp, Homo sapiens
  misc_feature: GZ8MTXP01BGZIJ.13.81.H04.1.454.CMB.2.raw
  modified_base (237)..(237): a, c, t, g, unknown or other
  misc_feature (237)..(237): n is a, c, g, or t
  modified_base (297)..(297): a, c, t, g, unknown or other
  misc_feature (297)..(297): n is a, c, g, or t
  modified_base (321)..(321): a, c, t, g, unknown or other
  misc_feature (321)..(321): n is a, c, g, or t
  modified_base (534)..(534): a, c, t, g, unknown or other
  misc_feature (534)..(534): n is a, c, g, or t
tcagtcacgtactacacgaccggtgctcgatttagtagtgtagattcgcgggggggtctcaggaggcagcgctctcgggacgtctccaccatggcctgggctctgctattcctcaccctcctcactcagggcatagggtcctgggcccagtctgccctgactcagcctgcctccgtgtctgggtctcctggacagtcgatcaccatctcctgcactgggaccagcagtgacgttcgnggtcaagactatgtctcctggtaccaacaacaccaggcaacggccccaaatcataattangtatttcataactcggcctcagtntatctatcgctcactcgctcaagtctggacaacgcgcctccctgaccatctctgggctccgaggcagaggacgaggctgtattatacgtgcgtctaccggtggaacgtattacgccttacccgtttatcggttcgttcgggtacttggtacgtaccgtaaggtccttaccggtccttagggtccacggaccccgaacgggcccctaaacccgnttccggtcctacgttccgttccgtttccccgtcccc

SEQ ID NO: 308771 - DNA, 686 bp, Homo sapiens
  misc_feature: GZ8MTXP01DMBOH.13.81.H04.1.454.CMB.2.raw
  modified_base (587)..(587): a, c, t, g, unknown or other
  misc_feature (587)..(587): n is a, c, g, or t
tcagtcacgtactacacgaccggtgctcgatttagtagtgtagattcgcggggggggtctcaggaggcagcgctctcgggacgtctccaccatggcctgggctctgctattcctcaccctcctcactcagggcatagggtcctgggcccagtctgccctgactcagcctgcctccgtgtctgggtctcctggacagtcgatcaccatctcctgcacgtgggaccagcagtgacgttcgtggtacaagactatcgtctcctaggtaaccaacaacacccaggaccaacggacccccaaatcaattaatttatagtacttttacaacttaacgtcccggtccctacgtaggttagttaacttaccttaaacttccgtactttaccgtaacgttccgggtaccttaccgtaaaggttccgttacggggaaacccaaacccgtaacccgggtccccttacccgtacgaaccctacgttccgtcgtcggggcctccgaggacgaggacggacggaggtactagtaatttactacgtcggcgtccttcgggtaggaacgtattacgccttaccgtttagtcgttcgttcggtnttcggtacgaaccgtaacggtccaccgttcgttaggtaccacgacccgaacggaccccaacccgtacgtcgtccacttccgttccgttcccctaacccg

SEQ ID NO: 308772 - DNA, 582 bp, Homo sapiens
  misc_feature: GZ8MTXP01B0QKL.13.81.H04.1.454.CMB.2.raw
tcagtcacgtactacacgaccggtgctcgatttagtagtgtagattcgcgggggggtctgggcctaaggaagcagcactggtggtgcctcagccatggcctggaccgttctcctcctcggcctcctctctcactgcacaggctctgtgacctcctatgtgctgactcagccaccctcggtgtcagtggccccaggacagacggccaggattacctggtagggggaaacaacattaggaaagtaaaagtgtgcactggtaccagcagaagccaggccaggcccctgtgctggtcgtctatgttgatagccgaccggccctcgagggactcccgtgagcgtattcgcgggctccaacctcgtaggggaaccaccggccaactctgaccatcaggtagggtcgaaaggccggggatggacggccgatattacgtgtcgaggtgtgggatagtagtcgtggagctagtggtggtagtcgggcggtaacgggacctaaagtcgaaccggtcgtaaggtcacggcccaggcctccgcccccgttggttccaacgtctccgttccccacccttcctcgttaacgttccg

SEQ ID NO: 308773 - DNA, 643 bp, Homo sapiens
  misc_feature: GZ8MTXP01AE4QL.13.81.H04.1.454.CMB.2.raw
  modified_base (214)..(214): a, c, t, g, unknown or other
  misc_feature (214)..(214): n is a, c, g, or t
  modified_base (364)..(364): a, c, t, g, unknown or other
  misc_feature (364)..(364): n is a, c, g, or t
  modified_base (488)..(488): a, c, t, g, unknown or other
  misc_feature (488)..(488): n is a, c, g, or t
tcagtcacgtactacacgaccggtgctcgatttagtagtgtagattcgcgggggggtctgggcctaaggaagcagcactggtggtgcctcagccatggcctggaccgttctcctcctcggcctcctctctcactgcacaggctctgtgacctcctatgtgctgactcagccacctcggtgtcagtggccccaggacagacggccaggattaccngtaggggaaacaacattggaaagtaaaagtgtgacactggtaccagcagaagccaggccaggcccctgtgctggtcgtctatgttgatagcgaccggcctgagggactcccgtgacgcgattcgcgggctaccaacctcgtagggaaacnccggcccaaactctcgaccatcgaaggtacggggtacgaaacgggcccggggatcggaacgggccgtaacttaacgttacctaggtacgtaagggtggtgggattacggtagtacgtgggaagngtagtggtagtacgtcgggacgggaacggaaccgtaacgtaccggtaccgtcgtaacggccgaccggacccgacggtcccgtcccgttccccgttcggttaccctccttcccgttcccgttcccctacccttccgttaaccgttaacggtaacgg

SEQ ID NO: 308774 - DNA, 861 bp, Homo sapiens
  misc_feature: GZ8MTXP01AM1LC.13.81.H04.1.454.CMB.2.raw
tcagtcacgtactacacgaccggtgctcgatttagtagtgtagattcgcgggggggtctcaggaggcagcgctctcgggacgtctccaccatggcctgggctctgctattcctcaccctcctcactcagggcatagggtcctgggcccagtctgccctgactcagcctgcctccgtgtctgggtctcctggacagtcgatcaccatcctcctgcacgtgggaccagcagtgacgttcggtggtacaagactatcgtctccgtaggtaacccaacaaccacccgaggaccaacggacccccaaactccaattaaacgtttatagtacttttacaactaactccggaccctacgaggttcgtacttcgtaaacttccgtctttacgacgttcggtaccttaccgtaaacggttccgtacggaaccctaaaccgaacccgggtcccttacccccgttaggaaccccctagttcccgtcgtcgggggtacccttaccgaacggggccaaggggaacgggaaccggtaacggggtaccgttaagggttaactttttaacgttaacccgttcgggcccggggttacccttacccgggggttacggggtaaccggttaacgtttaaccggttaccccttaaaccccgttttttaagtccgggttttacccggtttaccgggggtaactttacggggtaaccggaaaccccggttaaacgggttccccgttaacccgggtttacccgttaaacggggttacccaacccggggttaacccccgaaaccgggttaccccccaaaaccccgggtcttaaccggttacccctaccgtttccccgttcccggtttaacccccccggttcccccg

SEQ ID NO: 308775 - DNA, 690 bp, Homo sapiens
  misc_feature: GZ8MTXP01BC34N.13.81.H04.1.454.CMB.2.raw
  modified_base (348)..(348): a, c, t, g, unknown or other
  misc_feature (348)..(348): n is a, c, g, or t
  modified_base (396)..(396): a, c, t, g, unknown or other
  misc_feature (396)..(396): n is a, c, g, or t
tcagtcacgtactacacgaccggtgctcgatttagtagtgtagattcgcgggggggtctcaggaggcagcgctctcgggacgtctccaccatggcctgggctctgctattcctcaccctcctcactcagggcatagggtcctgggcccagtctgccctgactcagcctgcctccgtgtctgggtctcctggacagtcgatcaccatctcctgcactgggaccagcagtgacgttcgtggtacaagacttatgtctcctggtaaccaaacaaccacccgaggaccaaaccggacccccaaatcaattaaatttatagtatttacacttaaactccggccctcgagggtnttatctaactcgcttcactcggacctacgaagtctcggaacctaaccnccggccctccctacgacctatctcgtcgggtcctccgaggacgaggacggaggtacggcttagtaatttactacgtgggaccggtccttccgggtacggggtaacgtaacgttaaccggtcctttaaaccccgttttgtcgggtttacccggttacgggtacgttacggtaccggtaaacccgtaaacggtcccgttacccggttaccgttacggggtacctaaccgggacccgaaaccgggttcccaaacccctcgttaacgcctaccgttccctaaccgttcccctaacccg

SEQ ID NO: 308776 - DNA, 613 bp, Homo sapiens
  misc_feature: GZ8MTXP01D3J9L.13.81.H04.1.454.CMB.2.raw
  modified_base (240)..(240): a, c, t, g, unknown or other
  misc_feature (240)..(240): n is a, c, g, or t
  modified_base (333)..(333): a, c, t, g, unknown or other
  misc_feature (333)..(333): n is a, c, g, or t
  modified_base (373)..(373): a, c, t, g, unknown or other
  misc_feature (373)..(373): n is a, c, g, or t
tcagtcacgtactacacgaccggtgctcgatttagtagtgtagattcgcggggggggtctcaggaggcagcgctctcgggacgtctccaccatggcctgggctctgctattcctcaccctcctcactcagggcatagggtcctgggcccagtctgccctgactcagcctgcctccgtgtctgggtctccgtggacagtcgatcaccatcctcctgcacgtgggaccagcagtgacgttgnggtacaagactatgtctcctaggtaccaacaacacccagacaacgacccccaatcataattatgtatttcaactaactccgccctacgaggtntatctaatcgtcttcatcggctacaagtctggaaccaacnccggcctcctgaccctagtctcgtcggcctacgaggcaggacggacgacggtctagtattattacgtggtcgtccttaccggggtaggtaacgtactttaacgccttaccctttagtcggtttacttcgggggtacttgtacgaaccgtaaacggtccttaccgggtaccttaggtacctaacgcccgaaacggttcccaaaccctctcggtaccaccttcgttcccttcccgtaacccc

SEQ ID NO: 308777 - DNA, 623 bp, Homo sapiens
  misc_feature: GZ8MTXP01CYEP0.13.81.H04.1.454.CMB.2.raw
  modified_base (306)..(306): a, c, t, g, unknown or other
  misc_feature (306)..(306): n is a, c, g, or t
  modified_base (589)..(589): a, c, t, g, unknown or other
  misc_feature (589)..(589): n is a, c, g, or t
tcagtcacgtactacacgaccggtgctcgatttagtagtgtagattcgcggggggggtctcaggaggcagcgctctcgggacgtctccaccatggcctgggctctgctattcctcaccctcctcactcagggcatagggtcctgggcccagtctgccctgactcagcctgcctccgtgtctgggtctccgtggacagtcgatcaccatctcctgcacgtgggaccagcagttgacgttcgtggtacaagtactatcgtctcctaggtaaccaacaacacccaggcaacgaccccaatcataattangtattcactaagtccgcctgaggtattactactatcgtcttcacgtcggcctacgtaagtctcggaaccaaaccgcccggtccctacccgtacgacctactcgtcgtcggggtccctacgacgggaccgagggacggacggacggtcttaggtaactttagttcgtggtcggtccttcggggtagggtacgtagttacgaccttaccgttgtcgttcggtacggtctgaccgacgtaacggtccaccggttcgacgtaccgacgacccgacgacccaaccctntcgtaccctcgttcccttccgttcccctaacccc

SEQ ID NO: 308778 - DNA, 712 bp, Homo sapiens
  misc_feature: GZ8MTXP01AWHJ2.13.81.H04.1.454.CMB.2.raw
tcagtcacgtactacacgaccggtgctcgatttagtagtgtagattcgcggggggggtctcaggaggcagcgctctcgggacgtctccaccatggcctgggctctgctattcctcaccctcctcactcagggcatagggtcctgggcccagtctgccctgactcagcctgcctccgtgtctgggtctcctggacagtcgatcaccatctcctgcactgggaccagcagtgacgttcgtggtacaagactatgtcctcctaggtaaccaaacaaccacccaggaccaaaccggacccccaaaactctaattaaacttttatagtacttttaccaacttaacgtcccggacccctagtaacggttagtaacttacctaaagttccgtacctttacctacgttccggtaccctaccgtaaaggttccgtacgggaaacccaaacccgcccggtccccttaccccgtacgaacccctattcccgttcggtccgggtccctacccggaagggaccgaaaggggaaccgggaacgggtacggtaccttaggtactttacgttacgtggtacggtcctccgggtaggtaacgtattacgtaccttaccgttagttcgtacgttcggacttgaccgacctaaggtccttacgtcgttacggccaacgcccgacggaccccaaccctgtccgacctccgttcctcccgttcccctaacccg

SEQ ID NO: 308779 - DNA, 595 bp, Homo sapiens
  misc_feature: GZ8MTXP01AX3QT.13.81.H04.1.454.CMB.2.raw
  modified_base (305)..(305): a, c, t, g, unknown or other
  misc_feature (305)..(305): n is a, c, g, or t
  modified_base (315)..(315): a, c, t, g, unknown or other
  misc_feature (315)..(315): n is a, c, g, or t
  modified_base (321)..(321): a, c, t, g, unknown or other
  misc_feature (321)..(321): n is a, c, g, or t
  modified_base (326)..(326): a, c, t, g, unknown or other
  misc_feature (326)..(326): n is a, c, g, or t
tcagtcacgtactacacgaccggtgctcgatttagtagtgtagattcgcggggggggtctcaggaggcagcgctctcgggacgtctccaccatggcctgggctctgctattcctcaccctcctcactcagggcatagggtcctgggcccagtctgccctgactcagcctgcctccgtgtctgggtctccgtggacagtcgatcaccatctcctgcacgtgggaccagcagtgacgttcgtaggtcaagctattgtctcctaggtaaccaacaacacccaggacaacggaccccaatcataattangatttcatancgcctnaggtntatctatcgcttcacgtcggctacaagtctggaccaacgtccggcctcccgtacgaccctactcctacgtcgggctacccgaggcgacggaggacgaggtctagtacttactcgtggcggtacctccgggtaggtacgtattacgcttaacctttgcgttcgtcggtactggtacgaaccggtaagtccgttaccgtcgttacggtccaacgttccccgaaggttccccaaaccgtctcgtcctaccgttcctccgttcccctaacccg

SEQ ID NO: 308780 - DNA, 757 bp, Homo sapiens
  misc_feature: GZ8MTXP01EWFS2.13.81.H04.1.454.CMB.2.raw
  modified_base (244)..(244): a, c, t, g, unknown or other
  misc_feature (244)..(244): n is a, c, g, or t
tcagtcacgtactacacgaccggtgctcgatttagtagtgtagattcgcggggggggtctcaggaggcagcgctctcgggacgtctccaccatggcctgggctctgctattcctcaccctcctcactcagggcatagggtcctgggcccagtctgccctgactcagcctgcctccgtgtctgggtctcctggacagtcgatccaccatcctcctgcacgtcgggaccagctagtgacgtttcgnggtacaagactagtcgtctccgtcggtaaccaaacaaccgacccaggaccaacggacccccaaactactaattaaatttatagttaactttacctaacgttaacgtttcggaccctacgtaggttacgttattaccttaatccgttaccttactaccgttacggtcccttaccgtaacgttccgtacggtaaacccaaaccgtcccgggtaccccttcccgtaccgtaccctacttcgtccgttacgggcctaccgaacggcgaagggacggacggtaggtactagtaactttacgtacgtcggcgtaccgtacgggttacggggtaaccttaaggtttaccgaccctttacccgtttagtttccggtaccggtttacgggtaccttcggtaccggaaccggtaacggttcccaccggtttaccgttaccggccgtaaccgttacccgaccggttaacccctaaccccgtagtcccgtactaccgttccgttaacccgtttaacccctccccg

SEQ ID NO: 308781 - DNA, 661 bp, Homo sapiens
  misc_feature: GZ8MTXP01BFQ5G.13.81.H04.1.454.CMB.2.raw
  modified_base (317)..(317): a, c, t, g, unknown or other
  misc_feature (317)..(317): n is a, c, g, or t
  modified_base (487)..(487): a, c, t, g, unknown or other
  misc_feature (487)..(487): n is a, c, g, or t
tcagtcacgtactacacgaccggtgctcgatttagtagtgtagattcgcggggggggtctcaggaggcagcgctctcgggacgtctccaccatggcctgggctctgctattcctcaccctcctcactcagggcatagggtcctgggcccagtctgccctgactcagcctgcctccgtgtctggtctcgtggacagtcgatcaccatcctcctgcacgtgggaccagcagtgtacgttgtgtacaagactatcgtctccgtacgtaacccaaacaaccacccgaaggaccaaccgacccccaaatacaattaatttangtattacaactaactccggcccttagtagtattactcgtaattcgacttcgaacttcggacctacgtaagtcgtacgaaccaaccgccggtccctccgacgacctcttccgtcggtcgggtccacggaggacgaggaggacgaacggtctaaggtacctttaagtaccgnggccgtccgtagggtaacggtacgtattactccgttacctttagcggtttacgttcggggacttagggaccgtaacgtaaccggtaccgaccggtttacgttacggccgtaacgccccgaccaccccgtaacctgtccgtacctaccttccgttcccgttaaccccgtaacccg

SEQ ID NO: 308782 - DNA, 275 bp, Homo sapiens
  misc_feature: GZ8MTXP02I4JNB.13.81.H04.1.454.CMB.2.raw
  modified_base (274)..(275): a, c, t, g, unknown or other
  misc_feature (274)..(275): n is a, c, g, or t
tcagtcacgtactacacgaccggtgctcgatttagtagtgtagattcgcgggtagaagtcactgatcagacacactagtgtggccttgttggcttggagctccaggcagaggacgaggctgattattactgcggctcctggacgattagcaccctttatgtcttcgggactgtgaccaaggtcaccgtcctaggtcagcccaaggccaaccccactgtcactctgttcccacctcctctagtacgtgactgagcgggctggcaaggcgcatagnn

SEQ ID NO: 308783 - DNA, 513 bp, Homo sapiens
  misc_feature: GZ8MTXP02HM060.13.81.H04.1.454.CMB.2.raw
  modified_base (236)..(236): a, c, t, g, unknown or other
  misc_feature (236)..(236): n is a, c, g, or t
  modified_base (321)..(321): a, c, t, g, unknown or other
  misc_feature (321)..(321): n is a, c, g, or t
  modified_base (352)..(352): a, c, t, g, unknown or other
  misc_feature (352)..(352): n is a, c, g, or t
  modified_base (360)..(360): a, c, t, g, unknown or other
  misc_feature (360)..(360): n is a, c, g, or t
  modified_base (368)..(368): a, c, t, g, unknown or other
  misc_feature (368)..(368): n is a, c, g, or t
  modified_base (511)..(511): a, c, t, g, unknown or other
  misc_feature (511)..(511): n is a, c, g, or t
tcagtcacgtactacacgaccggtgctcgatttagtagtgtagattcgcggggggtctcaggaggcagcgctctcgggacgtctccaccatggcctgggctctgctattcctcaccctcctcactcagggcatagggtcctgggcccagtctgccctgactcagcctgcctccgtgtctgggtctcctggacagtcgatcaccatctcctgcactgggaccagcagtgacgttcgnggtcaagactatgtctctggtaccaacaacaccaggcaaggcccccaaactcataatttatgatttcactaatcggcctcaggtntatctaatcgcttcactgctcagtctgcacncgcctccngaccatcnctgggctcaggcagaggacgaggctgattatactgcgctcgtggacgattagctacctttatcgtcttcgggactggtagacctaaggtccaccgtcctaggtcacggcccaaggcccaaacccgctcgcactctcgttcccncc

SEQ ID NO: 308784 - DNA, 276 bp, Homo sapiens
  misc_feature: GZ8MTXP02G3SFI.13.81.H04.1.454.CMB.2.raw
  modified_base (274)..(276): a, c, t, g, unknown or other
  misc_feature (274)..(276): n is a, c, g, or t
tcagtcacgtactacacgaccggtgctcgatttagtagtgtagattcgcgggtagaagtcactgatcagacacactagtgtggccttgttggcttggagctccaggcagaggacgaggctgattattactgcggctcctggacgattagcaccctttatgtcttcgggactgtgaccaaggtcaccgtcctaggtcagcccaaggccaaccccactgtcactctgttcccacctcctctagtacgtgactgagcgggctggcaaggcgcatagnnn

SEQ ID NO: 308785 - DNA, 515 bp, Homo sapiens
  misc_feature: GZ8MTXP02JR08I.13.81.H04.1.454.CMB.2.raw
  modified_base (361)..(361): a, c, t, g, unknown or other
  misc_feature (361)..(361): n is a, c, g, or t
  modified_base (443)..(443): a, c, t, g, unknown or other
  misc_feature (443)..(443): n is a, c, g, or t
  modified_base (513)..(513): a, c, t, g, unknown or other
  misc_feature (513)..(513): n is a, c, g, or t
tcagtcacgtactacacgaccggtgctcgatttagtagtgtagattcgcgggggtctcaggaggcagcgctctcgggacgtctccaccatggcctgggctctgctattcctcaccctcctcactcagggcatagggtcctgggcccagtctgccctgactcagcctgcctccgtgtctgggtctcctggacagtcgatcaccatctcctgcactgggaccagcagtgacgttcgtggtcaagactatgtctcctggtaccaacaacacccaggcaaaggcccccaaaatcataatttatgatttcattaatcggccctcaggtgtatctaaatcgcttcactggctccaagtctggcaacncggcctccctgaccatctctgggctccaggcagaggacgaggctgattatactgcggctcctggacgattagcaccctttangtcttcgggactgtgaccaaggtcacgtctagtcagcccaaggccaacccactcgtcactctgttccccncc

SEQ ID NO: 308786 - DNA, 543 bp, Homo sapiens
  misc_feature: GZ8MTXP02JBQA3.13.81.H04.1.454.CMB.2.raw
  modified_base (238)..(238): a, c, t, g, unknown or other
  misc_feature (238)..(238): n is a, c, g, or t
  modified_base (285)..(285): a, c, t, g, unknown or other
  misc_feature (285)..(285): n is a, c, g, or t
  modified_base (294)..(295): a, c, t, g, unknown or other
  misc_feature (294)..(295): n is a, c, g, or t
  modified_base (312)..(312): a, c, t, g, unknown or other
  misc_feature (312)..(312): n is a, c, g, or t
  modified_base (316)..(316): a, c, t, g, unknown or other
  misc_feature (316)..(316): n is a, c, g, or t
  modified_base (353)..(353): a, c, t, g, unknown or other
  misc_feature (353)..(353): n is a, c, g, or t
  modified_base (446)..(446): a, c, t, g, unknown or other
  misc_feature (446)..(446): n is a, c, g, or t
  modified_base (518)..(518): a, c, t, g, unknown or other
  misc_feature (518)..(518): n is a, c, g, or t
  modified_base (540)..(540): a, c, t, g, unknown or other
  misc_feature (540)..(540): n is a, c, g, or t
tcagtcacgtactacacgaccggtgctcgatttagtagtgtagattcgcgggggggtctcaggaggcagcgctctcgggacgtctccaccatggcctgggctctgctattcctcaccctcctcactcagggcatagggtcctgggcccagtctgccctgactcagcctgcctccgtgtctgggtctcctggacagtcgatcaccatctcctgcactgggaccagcagtgacgtttcgnggtcaagctatgtctctggtaccaacacacccaggcaagccccaaancataattannatttcataatcgccctnagtntatctaatcgctcactggcctacaagtctggacaacncggcctccctgaccatctctgggctccgaggcagacggacgaggctagatttatactggccgtctcgtggacgattacggcctaaccgtttancgttcgttcgggacttgtacgaccctaaaggtccctaaccgtctaaggtcacgaccccaaggcccaaacccnctacgtacactcctcctacccnccg

SEQ ID NO: 308787 - DNA, 527 bp, Homo sapiens
  misc_feature: GZ8MTXP02GH64C.13.81.H04.1.454.CMB.2.raw
  modified_base (237)..(237): a, c, t, g, unknown or other
  misc_feature (237)..(237): n is a, c, g, or t
  modified_base (322)..(322): a, c, t, g, unknown or other
  misc_feature (322)..(322): n is a, c, g, or t
  modified_base (357)..(357): a, c, t, g, unknown or other
  misc_feature (357)..(357): n is a, c, g, or t
  modified_base (502)..(502): a, c, t, g, unknown or other
  misc_feature (502)..(502): n is a, c, g, or t
tcagtcacgtactacacgaccggtgctcgatttagtagtgtagattcgcgggggggtctcaggaggcagcgctctcgggacgtctccaccatggcctgggctctgctattcctcaccctcctcactcagggcatagggtcctgggcccagtctgccctgactcagcctgcctccgtgtctgggtctcctggacagtcgatcaccatctcctgcactgggaccagcagtgacgttcgnggtcaagactatgtctcctggtaccaacaacaccaggcaaggccccaaactcataatttatgatttcactaatcggcctcaggtntatctaatcgcttcactgctccaagtctggcaacncgcctcctgaccatctctgggctcaggcagaggacgaggctagattatactgcgctccgtggactattacgctaccctttatcgtcgttcgggactgtgacctaaggtccaccgtctaggtcacgacccaaggcccaaaccccgntcgaccactctaccgttccccaccc

SEQ ID NO: 308788 - DNA, 523 bp, Homo sapiens
  misc_feature: GZ8MTXP02HNNE9.13.81.H04.1.454.CMB.2.raw
  modified_base (318)..(318): a, c, t, g, unknown or other
  misc_feature (318)..(318): n is a, c, g, or t
  modified_base (323)..(323): a, c, t, g, unknown or other
  misc_feature (323)..(323): n is a, c, g, or t
  modified_base (360)..(360): a, c, t, g, unknown or other
  misc_feature (360)..(360): n is a, c, g, or t
  modified_base (503)..(503): a, c, t, g, unknown or other
  misc_feature (503)..(503): n is a, c, g, or t
  modified_base (521)..(521): a, c, t, g, unknown or other
  misc_feature (521)..(521): n is a, c, g, or t
tcagtcacgtactacacgaccggtgctcgatttagtagtgtagattcgcgggggggtctcaggaggcagcgctctcgggacgtctccaccatggcctgggctctgctattcctcaccctcctcactcagggcatagggtcctgggcccagtctgccctgactcagcctgcctccgtgtctgggtctcctggacagtcgatcaccatctcctgcactgggaccagcagtgacgttcgtggtcaagctatgtctcctggtaccaacaacacccaggcaaggcccccaaatcataatttatgatttcactaatcggccctnaggtntatctaatcgcttcactggctccaagtctggccaacncggcctccctgacccatctctgggctccaggcagaggacgaggctgattatactgcggctccgtggacgtattagctaccctttatcgtacttcgggacttgtcgaccaaggtcacgtctaggtcacgccaagcccaaacccnctcgtcactctcgtcccncc

SEQ ID NO: 308789 - DNA, 547 bp, Homo sapiens
  misc_feature: GZ8MTXP02HT3E6.13.81.H04.1.454.CMB.2.raw
  modified_base (300)..(300): a, c, t, g, unknown or other
  misc_feature (300)..(300): n is a, c, g, or t
  modified_base (325)..(325): a, c, t, g, unknown or other
  misc_feature (325)..(325): n is a, c, g, or t
  modified_base (363)..(363): a, c, t, g, unknown or other
  misc_feature (363)..(363): n is a, c, g, or t
  modified_base (381)..(381): a, c, t, g, unknown or other
  misc_feature (381)..(381): n is a, c, g, or t
  modified_base (427)..(427): a, c, t, g, unknown or other
  misc_feature (427)..(427): n is a, c, g, or t
  modified_base (447)..(447): a, c, t, g, unknown or other
  misc_feature (447)..(447): n is a, c, g, or t
tcagtcacgtactacacgaccggtgctcgatttagtagtgtagattcgcgggggggtctcaggaggcagcgctctcgggacgtctccaccatggcctgggctctgctattcctcaccctcctcactcagggcatagggtcctgggcccagtctgccctgactcagcctgcctccgtgtctgggtctcctggacagtcgatcaccatctcctgcactgggaccagcagtgacgttcgtggtcaagctatgtctcctggtaccaacaacacccaggcaacggcccccaaactcataatttangatttcactaatcggccctcaggtntatctaatcgcttcactcggctccaagtctggacaacnccgcctccctgaccatcnctgggctccgaggcagaggacgaggctgattatactgcggctccgnggacattacgctacctttangttcgtcgggactgtacgacctaggtctaccgtctaaggtccaacgccccgaaaggccccaaaccccgactacgtccaacttcctcggtttccccccgcc

SEQ ID NO: 308790 - DNA, 575 bp, Homo sapiens
  misc_feature: GZ8MTXP02IOA1W.13.81.H04.1.454.CMB.2.raw
  modified_base (320)..(320): a, c, t, g, unknown or other
  misc_feature (320)..(320): n is a, c, g, or t
  modified_base (331)..(331): a, c, t, g, unknown or other
  misc_feature (331)..(331): n is a, c, g, or t
tcagtcacgtactacacgaccggtgctcgatttagtagtgtagattcgcggggggggtctcaggaggcagcgctctcgggacgtctccaccatggcctgggctctgctattcctcaccctcctcactcagggcatagggtcctgggcccagtctgccctgactcagcctgcctccgtgtctgggtctcctggacagtcgatcaccatctcctgcactgggaccagcagtgacgttcgtggtcaagctatgtctcctggtaccaacacaccagcaacgccccaaatcataattatgtattcactaatccggcctcgaggtntatctaatcgnttcactcgcctacaagtctggaccaacgccggcctccctacgacctatctctcgggcctccgaggacaggaggacgaggctgtattacgttactggccggtctccgtaggaccgtagtttacgaccttaccctttagtcgttccgtttcgggacttggtacgaaccgtaggtccacgtcctaggtcacgacccgaacgcccaaacccgcgtacgtaccactttccgtaccgtttccctaccccg

SEQ ID NO: 308791 - DNA, 537 bp, Homo sapiens
  misc_feature: GZ8MTXP02G0DLI.13.81.H04.1.454.CMB.2.raw
  modified_base (362)..(362): a, c, t, g, unknown or other
  misc_feature (362)..(362): n is a, c, g, or t
tcagtcacgtactacacgaccggtgctcgatttagtagtgtagattcgcggggggggtctcaggaggcagcgctctcgggacgtctccaccatggcctgggctctgctattcctcaccctcctcactcagggcatagggtcctgggcccagtctgccctgactcagcctgcctccgtgtctgggtctcctggacagtcgatcaccatctcctgcactgggaccagcagtgacgttcgtggtcaagactatgtctcctggtaccaacaacacccaggcaacggcccccaaactcataatttatgatttcactaatcggcctcaggtgtatctaatcgcttcactcgctccaagtctggcaacnccggcctccctgacccatctctcgggctccaggcaaggaggacgaggctgattatactgcgctccgtggacgtattacgctaccctttatcggttcttcgggactgtacgaaccaaggtccaccgtctaggtcacgccaagcccaacccgctcgtcactctccgttaccctaccc

SEQ ID NO: 308792 - DNA, 678 bp, Homo sapiens
  misc_feature: GZ8MTXP02FX02V.13.81.H04.1.454.CMB.2.raw
tcagtcacgtactacacgaccggtgctcgatttagtagtgtagattcgcggggggggtctcaggaggcagcgctctcgggacgtctccaccatggcctgggctctgctattcctcaccctcctcactcagggcatagggtcctgggcccagtctgccctgactcagcctgcctccgtgtctgggtctcctggacagtcgatcaccatctcctgcactgggaccagcagtgacgttcgtggtcaagctatgtctcctggtaccaacaacaccaggcaacggcccccaaactcataatttatgatttcactaatcggccctcgaggtagtatactaatcgtcttcactcggcctaccgaagtctggacctaacgaccggtccctccgtacgaccctattcctcggtcgggtcctaccgacggcgaacggacgggaacggaggggtccttaggttaactttaacgttaacgtcggtacccggtccttaccggtacggggtaaacgttacgtttaccgggaccctttaaaccccgttttagttcggtttccggtttacgggtacttaggtacgtaaaccgtaacgggtccctaccggttaccggtaacggtaccaccggacccgaaccggaccccaaacccctacgtccgtaactaccttcctcccggttaccccctccccg

SEQ ID NO: 308793 - DNA, 512 bp, Homo sapiens
  misc_feature: GZ8MTXP02HOJ0Y.13.81.H04.1.454.CMB.2.raw
  modified_base (359)..(359): a, c, t, g, unknown or other
  misc_feature (359)..(359): n is a, c, g, or t
  modified_base (427)..(427): a, c, t, g, unknown or other
  misc_feature (427)..(427): n is a, c, g, or t
  modified_base (432)..(432): a, c, t, g, unknown or other
  misc_feature (432)..(432): n is a, c, g, or t
  modified_base (446)..(446): a, c, t, g, unknown or other
  misc_feature (446)..(446): n is a, c, g, or t
  modified_base (458)..(458): a, c, t, g, unknown or other
  misc_feature (458)..(458): n is a, c, g, or t
  modified_base (467)..(467): a, c, t, g, unknown or other
  misc_feature (467)..(467): n is a, c, g, or t
tcagtcacgtactacacgaccggtgctcgatttagtagtgtagattcgcggggggtctcaggaggcagcgctctcgggacgtctccaccatggcctgggctctgctattcctcaccctcctcactcagggcatagggtcctgggcccagtctgccctgactcagcctgcctccgtgtctgggtctcctggacagtcgatcaccatctcctgcactgggaccagcagtgacgttcgtggtcaagctatgtctcctggtaccaacaacaccaggcaaggcccccaaatcataatttatgatttcactaatcggccctcaggtgtatctaatcgcttcactcggctccaagtctggccaacnccgtcctcctgacccattctcgtgggcctccaggcaggaggacgaggctgattattactgcggctcgnggacntacgctaccctttngtctcggatgtnactaaggcncgtctaggcacgccagcccaaccgctcgtcactcctctcccgtcc

SEQ ID NO: 308794 - DNA, 569 bp, Homo sapiens
  misc_feature: GZ8MTXP02HYGGZ.13.81.H04.1.454.CMB.2.raw
  modified_base (236)..(236): a, c, t, g, unknown or other
  misc_feature (236)..(236): n is a, c, g, or t
  modified_base (297)..(297): a, c, t, g, unknown or other
  misc_feature (297)..(297): n is a, c, g, or t
  modified_base (322)..(322): a, c, t, g, unknown or other
  misc_feature (322)..(322): n is a, c, g, or t
  modified_base (359)..(359): a, c, t, g, unknown or other
  misc_feature (359)..(359): n is a, c, g, or t
tcagtcacgtactacacgaccggtgctcgatttagtagtgtagattcgcgggggggtctcaggaggcagcgctctcgggacgtctccaccatggcctgggctctgctattcctcaccctcctcactcagggcatagggtcctgggcccagtctgccctgactcagcctgcctccgtgtctgggtctcctggacagtcatcaccatctcctgcactgggaccagcagtgacgttcgnggtcaagctatgtctcctggtaccaacaacaccaggcaacggccccaaactcataatttangtatttcactaatcggcctcaggtntatctaatcgctcactcgctaccaagtctggacaacncggcctccctgaccctatctctcgggcctccgaggcagaggacgaggctgattattacgtgcggtctccgtggaacgtattacgccttaccctttatcggttcgttcggggtactggtacgaaccctaagggttccaacccggttctaagggtccacgacccgaaacggcccaaacccctctacgtccacttcctcgtttaccccacccc

SEQ ID NO: 308795 - DNA, 580 bp, Homo sapiens
  misc_feature: GZ8MTXP02GU2US.13.81.H04.1.454.CMB.2.raw
  modified_base (296)..(296): a, c, t, g, unknown or other
  misc_feature (296)..(296): n is a, c, g, or t
  modified_base (320)..(320): a, c, t, g, unknown or other
  misc_feature (320)..(320): n is a, c, g, or t
tcagtcacgtactacacgaccggtgctcgatttagtagtgtagattcgcggggggtctcaggaggcagcgctctcgggacgtctccaccatggcctgggctctgctattcctcaccctcctcactcagggcatagggtcctgggcccagtctgccctgactcagcctgcctccgtgtctgggtctcctggacagtcgatcaccatctcctgcactgggaccagcagtgacgttcgtggtcaagactatgtctctggtaccaacaacaccaggcaacggccccaaatcataatttangatttcactaatcggcctcgagtntatctaatcgtcttcactcgcctaccaagtctaggaccaacgccggccctcctacgacctatctcgtcgggcctccgaggcaggacggacgagctgtatttactacgtggcggcttccgtagggaccgttattacggccctaacccgtttgtcggttacgttcgggacttgtacgaaccgtaacggtcctaccgtcctaggtacaccgacccgaacggacccctaacccgcgttacgacctacctctccgtcccctcccc

SEQ ID NO: 308796 - DNA, 541 bp, Homo sapiens
  misc_feature: GZ8MTXP02JH1I3.13.81.H04.1.454.CMB.2.raw
  modified_base (301)..(301): a, c, t, g, unknown or other
  misc_feature (301)..(301): n is a, c, g, or t
  modified_base (326)..(326): a, c, t, g, unknown or other
  misc_feature (326)..(326): n is a, c, g, or t
  modified_base (364)..(364): a, c, t, g, unknown or other
  misc_feature (364)..(364): n is a, c, g, or t
  modified_base (438)..(438): a, c, t, g, unknown or other
  misc_feature (438)..(438): n is a, c, g, or t
  modified_base (518)..(518): a, c, t, g, unknown or other
  misc_feature (518)..(518): n is a, c, g, or t
  modified_base (539)..(539): a, c, t, g, unknown or other
  misc_feature (539)..(539): n is a, c, g, or t
tcagtcacgtactacacgaccggtgctcgatttagtagtgtagattcgcgggggggtctcaggaggcagcgctctcgggacgtctccaccatggcctgggctctgctattcctcaccctcctcactcagggcatagggtcctgggcccagtctgccctgactcagcctgcctccgtgtctgggtctcctggacagtcgatcaccatctcctgcactgggaccagcagtgacgttcgtggtcaagactatgtctcctggtaccaacaacacccaggccaacggcccccaaatcataatttangatttcactaatcggccctcaggtntatctaaatcgcttcactcggctccaagtctggcaacnccggccctccctgaccatctctggggcctccgaggcaggaggacgaggctgattatactgcggctcgtggacgnttacgctaccctttatcgtcgttcgggactgtacgactaaggtcaccgtctaggtcacgcccaacggcccaaaccccgtntcgaccactcctccgtccccncc

SEQ ID NO: 308797 - DNA, 572 bp, Homo sapiens
  misc_feature: GZ8MTXP02JNFF7.13.81.H04.1.454.CMB.2.raw
  modified_base (238)..(238): a, c, t, g, unknown or other
  misc_feature (238)..(238): n is a, c, g, or t
  modified_base (324)..(324): a, c, t, g, unknown or other
  misc_feature (324)..(324): n is a, c, g, or t
  modified_base (363)..(363): a, c, t, g, unknown or other
  misc_feature (363)..(363): n is a, c, g, or t
tcagtcacgtactacacgaccggtgctcgatttagtagtgtagattcgcggggggggtctcaggaggcagcgctctcgggacgtctccaccatggcctgggctctgctattcctcaccctcctcactcagggcatagggtcctgggcccagtctgccctgactcagcctgcctccgtgtctgggtctcctggacagtcgatcaccatctcctgcactgggaccagcagtgacgttcgnggtcaagactatgtctcctggtaccaacaacaccaggcaaggcccccaaatcataatttatgatttcactaatcggccctcaggtntatctaaatcgcttcactcggctccaagtctggacaacncggcctccctcgaccatcctctgggcctccgaggcagaggacgagctagattatacgtgacggctccgtaggacgtattacgccttaccctttagtcgttcttacgggacttggtacgaccgtaaggtccaaccggttccgtaaggtccacgacccgaaacggaccccaaacccgtcgtacgtacaccttccttcgtacccctaccccg

SEQ ID NO: 308798 - DNA, 663 bp, Homo sapiens
  misc_feature: GZ8MTXP02IZA8C.13.81.H04.1.454.CMB.2.raw
  modified_base (286)..(286): a, c, t, g, unknown or other
  misc_feature (286)..(286): n is a, c, g, or t
  modified_base (646)..(646): a, c, t, g, unknown or other
  misc_feature (646)..(646): n is a, c, g, or t
tcagtcacgtactacacgaccggtgctcgatttagtagtgtagattcgcgggggggtctgggcctaaggaagcagcactggtggtgcctcagccatggcctggaccgttctcctcctcggcctcctctctcactgcacaggctctgtgacctcctatgtgctgactcagccaccctcggtgtcagtcggccccaggacagacggccaggattacctggtagggggaaacaacattaggaaagtaaagtgtgcactggtaccagcagaagccaggccaggcccctgngcgtggtcgtctatgttgatacgccgacccggccctcgacggggactccccgtgagtccgtatttccgtccggggcctacccgaaaccttccgtacggggaacccaccgggtcccaaccgttctcgaaccctaagtccgaagggttacgggggtacgaaacgggcccgggggaatcggacggcccgtaaacttagttaacgtgtaccgtaagggttggtaggggtaattagggtacgttcggttaggacgtcgtagttgggttaggtacgttcggggacgggtacgggaaccaaacgtcggaccgttacgtacggcacgcccgaagctccgcccccgtgactaactccgtccgttacccnccctctacgtacgttcg

SEQ ID NO: 308799 - DNA, 541 bp, Homo sapiens
  misc_feature: GZ8MTXP02FRG69.13.81.H04.1.454.CMB.2.raw
  modified_base (237)..(237): a, c, t, g, unknown or other
  misc_feature (237)..(237): n is a, c, g, or t
  modified_base (285)..(285): a, c, t, g, unknown or other
  misc_feature (285)..(285): n is a, c, g, or t
  modified_base (327)..(327): a, c, t, g, unknown or other
  misc_feature (327)..(327): n is a, c, g, or t
  modified_base (351)..(351): a, c, t, g, unknown or other
  misc_feature (351)..(351): n is a, c, g, or t
  modified_base (369)..(369): a, c, t, g, unknown or other
  misc_feature (369)..(369): n is a, c, g, or t
  modified_base (441)..(441): a, c, t, g, unknown or other
  misc_feature (441)..(441): n is a, c, g, or t
tcagtcacgtactacacgaccggtgctcgatttagtagtgtagattcgcggggggggtctcaggaggcagcgctctcgggacgtctccaccatggcctgggctctgctattcctcaccctcctcactcagggcatagggtcctgggcccagtctgccctgactcagcctgcctcgtgtctgggtctcctggacagtcgatcaccatctcctgcactgggaccagcagtgacgttcgnggtcaagactatgtctctggtaccaacaacaccagcaacgccccaaancataattatgatttcactaatcgcctcagtgtatctaatcgnttcatcgctccaagtctggcaacncggcctccctgaccatcntcgggctccaggcagaggacgagctagattgtactgcgtctccgtaggacgtattacgccttaacccgtttntcgtacgtttcggggacctgtcgaaccgtaaggtccaccgtctaggtccacgcccgaagacccaaacccgtctcgtacctactcgtccgtttccccaccc

SEQ ID NO: 308800 - DNA, 538 bp, Homo sapiens
  misc_feature: GZ8MTXP02JQ3GU.13.81.H04.1.454.CMB.2.raw
  modified_base (364)..(364): a, c, t, g, unknown or other
  misc_feature (364)..(364): n is a, c, g, or t
  modified_base (416)..(416): a, c, t, g, unknown or other
  misc_feature (416)..(416): n is a, c, g, or t
  modified_base (460)..(460): a, c, t, g, unknown or other
  misc_feature (460)..(460): n is a, c, g, or t
tcagtcacgtactacacgaccggtgctcgatttagtagtgtagattcgcggggggggtctcaggaggcagcgctctcgggacgtctccaccatggcctgggctctgctattcctcaccctcctcactcagggcatagggtcctgggcccagtctgccctgactcagcctgcctccgtgtctgggtctcctggacagtcgatcaccatctcctgcactgggaccagcagtgacgttcgtggtcaagactatgtctcctggtaccaacaacacccaggcaacggcccccaaactcataatttatgatttcactaatccggccctcaggtgtatctaatcgcttcactggctcaagtctggacaacncggcctccctgaccatctctgggctccaggcagaggacgagctgattatacngcggctccgtggacattacgctacctttatgtcttcgggactgngacctaaggtcaccgtccgtaggtcacgccccaaggaccccaaccccgactcgtccacgtcctacgttcccctacccc

SEQ ID NO: 308801 - DNA, 549 bp, Homo sapiens
  misc_feature: GZ8MTXP02ITFYD.13.81.H04.1.454.CMB.2.raw
  modified_base (296)..(297): a, c, t, g, unknown or other
  misc_feature (296)..(297): n is a, c, g, or t
  modified_base (315)..(315): a, c, t, g, unknown or other
  misc_feature (315)..(315): n is a, c, g, or t
  modified_base (319)..(319): a, c, t, g, unknown or other
  misc_feature (319)..(319): n is a, c, g, or t
  modified_base (323)..(323): a, c, t, g, unknown or other
  misc_feature (323)..(323): n is a, c, g, or t
  modified_base (354)..(354): a, c, t, g, unknown or other
  misc_feature (354)..(354): n is a, c, g, or t
  modified_base (364)..(364): a, c, t, g, unknown or other
  misc_feature (364)..(364): n is a, c, g, or t
  modified_base (384)..(384): a, c, t, g, unknown or other
  misc_feature (384)..(384): n is a, c, g, or t
  modified_base (410)..(410): a, c, t, g, unknown or other
  misc_feature (410)..(410): n is a, c, g, or t
  modified_base (429)..(429): a, c, t, g, unknown or other
  misc_feature (429)..(429): n is a, c, g, or t
tcagtcacgtactacacgaccggtgctcgatttagtagtgtagattcgcggggggggtctcaggaggcagcgctctcgggacgtctccaccatggcctgggctctgctattcctcaccctcctcactcagggcatagggtcctgggcccagtctgccctgactcagcctgcctccgtgtctgggtctcctggacagtcgatcaccatctcctgcactgggaccagcagtgacgttcgtggtcaagactatgtctcctgtaccaacacaccaggcaaggccccaaactcataattannatttcactaatcggcctnggtntatntaatcgcttcactcgctccagtctgacaacncggcctcccngacccatctctgggcctacnggcagaggacgaggctgattatacgngtcggcttccgtgggactnttacgcctaccctttagtcgttcgttcggggacttgtgacctaacggtcctaccgttcgtaaggtcacgacccgaacggacccaaaccctcgtacgtccacttcctcgttacccctaccc

SEQ ID NO: 308802 - DNA, 702 bp, Homo sapiens
  misc_feature: GZ8MTXP02HPPCX.13.81.H04.1.454.CMB.2.raw
  modified_base (301)..(301): a, c, t, g, unknown or other
  misc_feature (301)..(301): n is a, c, g, or t
tcagtcacgtactacacgaccggtgctcgatttagtagtgtagattcgcggggggggtctcaggaggcagcgctctcgggacgtctccaccatggcctgggctctgctattcctcaccctcctcactcagggcatagggtcctgggcccagtctgccctgactcagcctgcctccgtgtctgggtctcctggacagtcgatcaccatctcctgcacgtgggaccagcagtgacgttgtggtacaagactatgtctctaggtaccaacaacaccaggcaacggccccaaatcaataatttangtatttcaactaacgtccggacctacgtaggtgtaatactaaactcgtctttcacgtcgacctacgtaagtctaggaccaacgccgtccctccgtacgacctactcgtcgtcgggcctacccgaggccaaggacgggagtacggctagtaattaacgttacgtcggcggtcctcggtacggtacgtagtttacgaccttaacccgtttagtacggttacgtttccggggaccttggtaacggtaaaccgtaacgggttacccgtaacccggttaccgttaaacggggttacccaaaccgggtaacccccgtaaaaccggggaccccctaaaaacccccgtacgttcccggttacccaaaccggtttcccctttaccgggtttaaacccccccttacccccg

SEQ ID NO: 308803 - DNA, 699 bp, Homo sapiens
  misc_feature: GZ8MTXP02H1G57.13.81.H04.1.454.CMB.2.raw
  modified_base (315)..(315): a, c, t, g, unknown or other
  misc_feature (315)..(315): n is a, c, g, or t
tcagtcacgtactacacgaccggtgctcgatttagtagtgtagattcgcggggggggtctcaggaggcagcgctctcgggacgtctccaccatggcctgggctctgctattcctcaccctcctcactcagggcatagggtcctgggcccagtctgccctgactcagcctgcctccgtgtctgggtctctggacagtcgatcaccatctcctgcacgtgggaccagcagtgacgttcgtggtcaagactatcgtctccgtggtaacccaacaaccacccgaggaccaaaccggacccccaaatcaattaactttanagtatttcaactaacgtccggtccctagaggttgtactactaatccgtcttacacgttccggcctaccgaacgtctacggaccaacgcccggtcccttacccgtacgaccctacttccgtcgttcgggcctacccgaggcaggacggacgaggtctagtaactttacgtacgtcggccggtcttacggtagggaacgtagttacgtacctttacgtttacgtcggtttaccggtacgggtaacttcggtacgtaaacccgttacggtacccgttacccggtaccgttaacgggtccaaccgaacccccgtaaccggaccccctaaaaccccgtcgtaccggttaccctaccgtttccccgttacccgtttcccccggacccccg

SEQ ID NO: 308804 - DNA, 665 bp, Homo sapiens
  misc_feature: GZ8MTXP02IMQM6.13.81.H04.1.454.CMB.2.raw
  modified_base (293)..(293): a, c, t, g, unknown or other
  misc_feature (293)..(293): n is a, c, g, or t
  modified_base (316)..(316): a, c, t, g, unknown or other
  misc_feature (316)..(316): n is a, c, g, or t
tcagtcacgtactacacgaccggtgctcgatttagtagtgtagattcgcggggggggtctcaggaggcagcgctctcgggacgtctccaccatggcctgggctctgctattcctcaacctcctcactcagggcatagggtcctgggcccagtctgccctgactcagcctgcctccgtgtctgggtctcctggacagtcgatcaccatcctcctgcactgggaccagcagtgacgttgtggtacaagctatgtctctgtaccaacaacaccagcaacgccccaatcataattangtattcactatccgcctcgagtntatactaatcgtctcacgtcgcctacctagtctggaccaacgccgtccctcccgtacgaccctatccgtccgtcgggcctccgaggcaggaggtacgaggtctagtaactttacgttacgtcgccggtccttccggtacggtacgtacgttacggtacccttaacccgtttatcggttaccggttcgggtacttcggtaaccgtaaacccggttaaacggtcccgttaaacccggtaccgttaacggggtacccaccggaacccccgtaaaccggaaccccctaaaaccccgtaccgttacgtaccccgtacctttccccgttaaccccgtttcccccctaaacccccg

SEQ ID NO: 308805 - DNA, 564 bp, Homo sapiens
  misc_feature: GZ8MTXP02GL8M6.13.81.H04.1.454.CMB.2.raw
  modified_base (366)..(366): a, c, t, g, unknown or other
  misc_feature (366)..(366): n is a, c, g, or t
tcagtcacgtactacacgaccggtgctcgatttagtagtgtagattcgcggggggggtctcaggaggcagcgctctcgggacgtctccaccatggcctgggctctgctattcctcaccctcctcactcagggcatagggtcctgggcccagtctgccctgactcagcctgcctccgtgtctgggtctcctggacagtcgatcaccatctcctgcactgggaccagcagtgacgttcgtggtcaagctatgtctcctggtaccaacaacacccaggcaacggcccccaaactcataatttatgatttcactaatcggcctcgaggtgtatctaatcgtcttcactcggctccaagtctggaccaacnccggcctccctgaccatctcgtgggcctcgaggcaggacggacgaggctgattatacgtgcggctccgtggactattacgcctacccgtttatcgttcgttcgggatgtacgaccgtaaggtccaccgtcctacggcctacgacccgaacggccccaaacccgtctacgtaccaccgtcctccgttacccctaccccg

SEQ ID NO: 308806 - DNA, 572 bp, Homo sapiens
  misc_feature: GZ8MTXP02HFKIQ.13.81.H04.1.454.CMB.2.raw
  modified_base (295)..(295): a, c, t, g, unknown or other
  misc_feature (295)..(295): n is a, c, g, or t
  modified_base (315)..(315): a, c, t, g, unknown or other
  misc_feature (315)..(315): n is a, c, g, or t
  modified_base (320)..(320): a, c, t, g, unknown or other
  misc_feature (320)..(320): n is a, c, g, or t
  modified_base (423)..(423): a, c, t, g, unknown or other
  misc_feature (423)..(423): n is a, c, g, or t
tcagtcacgtactacacgaccggtgctcgatttagtagtgtagattcgcggggggggtctcaggaggcagcgctctcgggacgtctccaccatggcctgggctctgctattcctcaccctcctcactcagggcatagggtcctgggcccagtctgccctgactcagcctgcctccgtgtctgggtctcctggacagtcgatcaccatctcctgcactgggaccagcagtgacgttcgtggtcaagctatgtctcctgtaccaacacaccaggcaacgccccaaatcaatatttangtatttcactaatcgccctnaggtntatactaatcgtcttcactcggctccaagtctggaccaacgccggccctcctagacctatctcgtcgggcctcgaggcaggaggacgaggctgtatttatacngcggctccgtggacgtattacgacctaccctttagcgttcgttacgggactgtacgaccgtaacggtccaccggttcctaggtaccacgtaccccgaacggtaccccaaaccctacgtcgtacctacctccgttaccgtccccgtcccc

SEQ ID NO: 308807 - DNA, 543 bp, Homo sapiens
  misc_feature: GZ8MTXP02JDAA5.13.81.H04.1.454.CMB.2.raw
  modified_base (195)..(195): a, c, t, g, unknown or other
  misc_feature (195)..(195): n is a, c, g, or t
  modified_base (238)..(238): a, c, t, g, unknown or other
  misc_feature (238)..(238): n is a, c, g, or t
  modified_base (360)..(360): a, c, t, g, unknown or other
  misc_feature (360)..(360): n is a, c, g, or t
tcagtcacgtactacacgaccggtgctcgatttagtagtgtagattcgcggggggggtctcaggaggcagcgctctcgggacgtctccaccatggcctgggctctgctattcctcaccctcctcactcagggcatagggtcctgggcccagtctgccctgactcagcctgcctccgtgtctgggtctcctggacngtcgatcaccatctcctgcactgggaccagcagtgacgttcgnggtcaagactatgtctcctggtaccaacacacccagcaaggcccccaaatcataatttatgatttcactaatcggccctcaggtgtactctaatcgcttcactcggctccaagtctgcaacncggcctcctgaccatctctgggctccgagcaggacgacgtagctgattatactgcggtctcctggacgattagcctacctttatcgtcgttacgggctgtcgacctaaggtccaaccggtccgtaaggtcacgtacccgaacggtaccaaccccgtactcgtaccacttctcgtccccgtccc

SEQ ID NO: 308808 - DNA, 540 bp, Homo sapiens
  misc_feature: GZ8MTXP02GJHLL.13.81.H04.1.454.CMB.2.raw
  modified_base (238)..(238): a, c, t, g, unknown or other
  misc_feature (238)..(238): n is a, c, g, or t
  modified_base (299)..(299): a, c, t, g, unknown or other
  misc_feature (299)..(299): n is a, c, g, or t
  modified_base (317)..(317): a, c, t, g, unknown or other
  misc_feature (317)..(317): n is a, c, g, or t
  modified_base (322)..(322): a, c, t, g, unknown or other
  misc_feature (322)..(322): n is a, c, g, or t
  modified_base (357)..(357): a, c, t, g, unknown or other
  misc_feature (357)..(357): n is a, c, g, or t
  modified_base (374)..(374): a, c, t, g, unknown or other
  misc_feature (374)..(374): n is a, c, g, or t
  modified_base (409)..(409): a, c, t, g, unknown or other
  misc_feature (409)..(409): n is a, c, g, or t
tcagtcacgtactacacgaccggtgctcgatttagtagtgtagattcgcggggggggtctcaggaggcagcgctctcgggacgtctccaccatggcctgggctctgctattcctcaccctcctcactcagggcatagggtcctgggcccagtctgccctgactcagcctgcctccgtgtctgggtctcctggacagtcgatcaccatctcctgcactgggaccagcagtgacgttcgnggtcaagactatgtctcctggtaccaacaacaccaggcaacggccccaaactcataattangatttcactaatcgcctnaggtntatctaatcgcttcactgctaccaagtctgcaacncggcctcctgaccatcnctgggctcgagcagaggacgagctgtattatacgngacggctcgtggacattacgctaccctttagcgtcgtacggctgtacgaccgtaagtcctaccgtcgtaggtcaacgacccgaacggacccaaaccctcgttacgactacgtcctccgttacccctacccc

SEQ ID NO: 308809 - DNA, 558 bp, Homo sapiens
  misc_feature: GZ8MTXP02IAUVX.13.81.H04.1.454.CMB.2.raw
  modified_base (297)..(297): a, c, t, g, unknown or other
  misc_feature (297)..(297): n is a, c, g, or t
  modified_base (322)..(322): a, c, t, g, unknown or other
  misc_feature (322)..(322): n is a, c, g, or t
  modified_base (534)..(534): a, c, t, g, unknown or other
  misc_feature (534)..(534): n is a, c, g, or t
  modified_base (538)..(538): a, c, t, g, unknown or other
  misc_feature (538)..(538): n is a, c, g, or t
tcagtcacgtactacacgaccggtgctcgatttagtagtgtagattcgcgggggggtctcaggaggcagcgctctcgggacgtctccaccatggcctgggctctgctattcctcaccctcctcactcagggcatagggtcctgggcccagtctgccctgactcagcctgcctccgtgtctgggtctcctggacagtcgatcaccatctcctgcactgggaccagcagtgacgttcgtggtacaagctatgtctcctggtaccaacaacacccagcaacgccccaaatcataatttangatttcactaatccggcctcaggtntatctaaatccgcttcactcggctacaagtctggacaacgccgcctccctgaccatctcgtcgggcctcccgaggcaggacggacgacggactggacttaagtctggccggtctccgtaggactagttacgcctaacccttttagcgttcgtcgggaactgtacgaacctaggtcctaaccggtcctaggccacgcccaacggcccaacccnctcncacctcgtcctaccctaccc

SEQ ID NO: 308810 - DNA, 541 bp, Homo sapiens
  misc_feature: GZ8MTXP02I2S30.13.81.H04.1.454.CMB.2.raw
  modified_base (282)..(282): a, c, t, g, unknown or other
  misc_feature (282)..(282): n is a, c, g, or t
  modified_base (317)..(317): a, c, t, g, unknown or other
  misc_feature (317)..(317): n is a, c, g, or t
  modified_base (356)..(356): a, c, t, g, unknown or other
  misc_feature (356)..(356): n is a, c, g, or t
  modified_base (413)..(413): a, c, t, g, unknown or other
  misc_feature (413)..(413): n is a, c, g, or t
  modified_base (512)..(512): a, c, t, g, unknown or other
  misc_feature (512)..(512): n is a, c, g, or t
tcagtcacgtactacacgaccggtgctcgatttagtagtgtagattcgcggggggggtcgtcaggaggcagcgctctcgggacgtctccaccatggcctgggctctgctattcctcaccctcctcactcagggcatagggtcctgggcccagtctgccctgactcagcctgcctccgtgtctgggtctcctggacagtcgatcaccatctcctgcactgggaccagcagtgacgttcgtggtacaagctatgtctctgtacacacaccagcaagccccaacncataattatgatttacactaatccggcctcaggtntatctaatcgtcttcactcggctccaagtctggccaacnccggccctcctcgacctatctcgtcggctccaggcagaggacgagctagattatagngcgctcgtggacgattagcctacccttattcgtcgttacggctagtcgaaccgtacgaccaccgtacgtacgtcacgaccccaacggcccaaaccccgntaccgtcacgtcctccgttacccctaccc

SEQ ID NO: 308811 - DNA, 280 bp, Homo sapiens
  misc_feature: GZ8MTXP02IHY2Q.13.81.H04.1.454.CMB.2.raw
  modified_base (278)..(280): a, c, t, g, unknown or other
  misc_feature (278)..(280): n is a, c, g, or t
tcagtcacgtactacacgaccggtgctcgatttagtagtgtagattcgcgggtagaagtcactgatcagacacactagtgtggccttgttggcttggagctccaggcagaggacgaggctgattattactgcggctcctggacgattagcaccctttatgtcttcgggactgtgaccaaggtcaccgtcctaggtcagcccaaggccaaaccccactgtcactctgttccccaccctcctctagtacgtgactgagcgggctgggcaaggcgcatagnnn

SEQ ID NO: 308812 - DNA, 870 bp, Homo sapiens
  misc_feature: GZ8MTXP02IISG1.13.81.H04.1.454.CMB.2.raw
tcagtcacgtactacacgaccggtgctcgatttagtagtgtagattcgcggggggggtctcaggaggcagcgctctcgggacgtctccaccatggcctgggctctgctattcctcaccctcctcactcagggcatagggtcctgggcccagtctgccctgactcagcctgcctccgtgtctgggtctcctggacagtcgatcaccatctcctgcacgtgggaccagcagtgtacgttcgtggtacaagactatgtctctaggtacaacacaccagcaacgaccccaactcaataattatgtatttacactaactccggaccctagaggttacgtatactaaacttccgtaccttacctacgttccggaccttacccgtaagttccgtacggacccaaacccgtacccggggtaccccttaccccgtccggtaaacccctaaccgtttccgttaccggttaccgggggtacccttacccggaaaggggacccgaaacgggaaacgggggaacccggacggggtaccgtttaaggtaaacgtttttaaacgttaccggtacggacccgggttacccgttcccggttaacggggtaacgttaacgtttaacggtacccccgtttaaaccccgtttttaagttacccggggtttaaccgggtttccggggtaaacgtttacgggtaaccgggtaaaacccccgttaacgggggttaccccttaaacccggggtttacccgttaaacgggggttaacccgaacccgggaaaaccccccggtaaacgggtaacccccccaaaacccccgttacgttacccggttaaacccgtacctttacccccggttacccgtttaacccccccttaaccccccg

SEQ ID NO: 308813 - DNA, 759 bp, Homo sapiens
  misc_feature: GZ8MTXP02G5M8S.13.81.H04.1.454.CMB.2.raw
  modified_base (328)..(328): a, c, t, g, unknown or other
  misc_feature (328)..(328): n is a, c, g, or t
tcagtcacgtactacacgaccggtgctcgatttagtagtgtagattcgcgggggggggtctcaggaggcagcgctctcgggacgtctccaccatggcctgggctctgctattcctcaccctcctcactcagggcatagggtcctgggcccagtctgccctgactcagcctgcctcgtgtctgggtctccgtggacagtcgatccaccatctcctgcacgtgggaccagctaggtgtacgttcgtggtacaagactatcgtcctaccgtaggtaaccaaacaaccacccgaggacccaaccggaccccctaaactactattaaatttanagtaacttttaccaaacttaacgtcccggtaccctaggaacggtttctaacttactaacgttccgtccttactacgtcccgggtactaccgtaacggttcgacggaacctaacccggtcccgggtcccttccccgtaggtacccctcgtttccgtcggttccggggaccttccgaacggcgaaggggacggacggtacgggacttagtaacttacgttacgtcggtccggtcttaccggacggggttacacgtttaccgggtacccttaacccgtttagttacggtttccgtacggtacgttaggtaaccggtaaccgtaaacggtcccgtaaaccggttaccggtacggtacccgacccggaaccccgtaaccgtaccccaaccctacggtctacccgttacctcccgtttacccgtaccccctaacccg

SEQ ID NO: 308814 - DNA, 619 bp, Homo sapiens
  misc_feature: GZ8MTXP02IR3QC.13.81.H04.1.454.CMB.2.raw
  modified_base (292)..(292): a, c, t, g, unknown or other
  misc_feature (292)..(292): n is a, c, g, or t
  modified_base (316)..(316): a, c, t, g, unknown or other
  misc_feature (316)..(316): n is a, c, g, or t
  modified_base (369)..(369): a, c, t, g, unknown or other
  misc_feature (369)..(369): n is a, c, g, or t
  modified_base (388)..(388): a, c, t, g, unknown or other
  misc_feature (388)..(388): n is a, c, g, or t
tcagtcacgtactacacgaccggtgctcgatttagtagtgtagattcgcgggggggggtctcaggaggcagcgctctcgggacgtctccaccatggcctgggctctgctattcctcaccctcctcactcagggcatagggtcctgggcccagtctgccctgactcagcctgcctccgtgtctgggtctctggacagtcgatcaccatctcctgcactgggaccagcagtgacgttgtggtcaagactatgtctccgtaggtaaccaacaacaccgagccaacgcccccaaanctaatattatgtatttacactaanccgtacctgaggttatatctaatcgtctatattcgctacgatcgtagaccacnccggcctacctcgaacctntcgtcgtacggctcgaggcgaagcggacgagtctagtaattacgttacgcgacgtccgttccgaggtactaacgttcgtaaccccgttactttagtcgttcgttacggtcgttacgtacgtaaccgttacgggtaccctaccggttaccgtacgtaccgaccgtaacccgaacggtaccccctaaaccgcgttacctacgacctttaccgttcccgttaacccctaccccg

SEQ ID NO: 308815 - DNA, 729 bp, Homo sapiens
  misc_feature: GZ8MTXP02HTA8L.13.81.H04.1.454.CMB.2.raw
tcagtcacgtactacacgaccggtgctcgatttagtagtgtagattcgcgggggggggtctcaggaggcagcgctctcgggacgtctccaccatggcctgggctctgctattcctcaccctcctcactcagggcatagggtcctgggcccagtctgccctgactcagcctgcctccgtgtctgggtctcgtggacagtcgatcaccatctcctgcacgtgggaccagcagtgtacgttgtggacaagtctatcgtctccgtaggtaaccaacaaaccacccgacggaccgaaaccggtacccccaaaactcctaaattaaactttaatgttaacttttaccaaccttaaacgtccggtcccctagtaggttgtaacttactaacgttcgtcctttactacgtcggacctaccgaacgttcgtaggacctaaacgcccgggtacccttaccctacgaccctaacgttccgtcgtcggggaccctaccggaaggcgaacgggaacggacgtacggacttagtaagtttacgtacgtcggttacgtcctacggtacgggtaacgttacttaccgtacctttaccgtttagttccgttcggttacggtaccgtacggtacgaaccgttaacggtcccgtaccggtacccgtaaggtcccgaacgacccccgtaaacggccccctaaaccctacgtccggtacctacccgtccgttaccctaccccgttacccc

SEQ ID NO: 308816 - DNA, 843 bp, Homo sapiens
  misc_feature: GZ8MTXP02HGZXP.13.81.H04.1.454.CMB.2.raw
tcagtcacgtactacacgaccggtgctcgatttagtagtgtagattcgcggggggggtctcaggaggcagcgctctcgggacgtctccaccatggcctgggctctgctattcctcaccctcctcactcagggcatagggtcctgggcccagtctgccctgactcagcctgcctccgtgtctgggtctcctggacagtcgatcaccatctcctgcactgggaccagcagtgtacgttcgtggtcaagactatgtctccgtggtaaccaaacaaccacccaggaccaaaccggaccccccaaaactcaattaaattttactagtacttttacaacttaacgtccggaccctacgaggttacgtacttacgtaaactccgtcttactacgtcggtacctaccgtaaagtcgtacggacctaaaccgtcccgggtcccttaccccgtagaccctaacgttcgtccgttcgggcccgttacccgaacggggaccctaaggggaaccggaacgggacgggtaccgtaggttaaacttttaacgttaccgtcgggtacccggtccgtttacccgggtaggggtaaacccgttaatttaccggttaaccctttaaccccgtttttattccggggtttaaccggtttccggggtaactttacggggaaaccgtaaaacccggttaacgggtaccccgtaacccgggtttacccggtttaaacgggtacccgtaaacccgggtaacccccggtaaaaccgggtaaccccccgaaaaccccccgttaaaggtttccctaaccccggttaacctttccccggtttaacccccgggtttccccccccgttcccccg

SEQ ID NO: 308817 - DNA, 641 bp, Homo sapiens
  misc_feature: GZ8MTXP02GGK4S.13.81.H04.1.454.CMB.2.raw
  modified_base (228)..(228): a, c, t, g, unknown or other
  misc_feature (228)..(228): n is a, c, g, or t
  modified_base (234)..(234): a, c, t, g, unknown or other
  misc_feature (234)..(234): n is a, c, g, or t
  modified_base (256)..(256): a, c, t, g, unknown or other
  misc_feature (256)..(256): n is a, c, g, or t
  modified_base (302)..(302): a, c, t, g, unknown or other
  misc_feature (302)..(302): n is a, c, g, or t
tcagtcacgtactacacgaccggtgctcgatttagtagtgtagattcgcgggggggggtctcaggaggcagcactctcgggacgtctccaccatggcctgggctctgctcctcctcagcctcctcactcagggcacaggatcctgggctcagtctgccctgactcagcctcgctcagtcggtccgggtctccgtggacagtcagtcaccatcctctgcactggaaccngcagtnatggttggtgttaataactatntctctgtaccaacacaccagacaaacaccccaaatcatgtatttanagtatgtacaagtaacgccggccctaggaccgggtcctgactccccgtcttcctctcgtccctacaggtccgtcgaccaacgacccggtccctaccgagaccctactcgtcgtaccggggtcctaccggaggtacctggtaaggtacgtcgtaacgtcttaaaggttaacctttagttaccgttgtaccgttcgtacttacgaatttgacgacgacggtcaacgtacctactacgttacgtaacgttacgggtccgggtacggggaacccgtaacgaaacgcccgtttaccggaacccgtttacggaccggttaccaaccgggtaccccgtaaaccggg

SEQ ID NO: 308818 - DNA, 780 bp, Homo sapiens
  misc_feature: GZ8MTXP02JH4DI.13.81.H04.1.454.CMB.2.raw
  modified_base (294)..(294): a, c, t, g, unknown or other
  misc_feature (294)..(294): n is a, c, g, or t
tcagtcacgtactacacgaccggtgctcgatttagtagtgtagattcgcggggggggtctcaggaggcagcgctctcgggacgtctccaccatggcctgggctctgctattcctcaccctcctcactcagggcatagggtcctgggcccagtctgccctgactcagcctgcctccgtgtctgggtctcctggacagtcgatcaccatctcctgcacgtgggaccagcagtgtacgttcgtggtacaagactatcgtctcgtgaaccaacaccaccagacaaccgaccccaactnaattattatgtatttcactacgtccggcctgaggtagtatactaatccgtcttaccgtagtcccggaccttaccaagtttccgtacgggtaacccaaaccgtccccggggtcccttcccccgtacgtaaccctacgttccgtccgggtcggtacccgttccgaaacggcgaaagggaccggaaccgtcgggtccttaagttacgttttaaccgtaccgtggtaccccgggttccttaccgggtacggtaaaccgtttaccgtttaccgtaacccgtttaaccccgttttaggttcccggtttacggggtttacccggtaacggtttcggtaacccgttaaccggtaaccggggtttaccccaaacccggggttttccgaaacggttcccgaaacccgggtaccccgaaaccccggtaacccctaaacccccgtcgttacgttacccctaacctttcccggttaaccccgtttcccccgtaaccccg

SEQ ID NO: 308819 - DNA, 560 bp, Homo sapiens
  misc_feature: GZ8MTXP02FV9NV.13.81.H04.1.454.CMB.2.raw
  modified_base (238)..(238): a, c, t, g, unknown or other
  misc_feature (238)..(238): n is a, c, g, or t
  modified_base (322)..(322): a, c, t, g, unknown or other
  misc_feature (322)..(322): n is a, c, g, or t
  modified_base (329)..(329): a, c, t, g, unknown or other
  misc_feature (329)..(329): n is a, c, g, or t
  modified_base (415)..(415): a, c, t, g, unknown or other
  misc_feature (415)..(415): n is a, c, g, or t
  modified_base (472)..(472): a, c, t, g, unknown or other
  misc_feature (472)..(472): n is a, c, g, or t
tcagtcacgtactacacgaccggtgctcgatttagtagtgtagattcgcggggggggtctcaggaggcagcgctctcgggacgtctccaccatggcctgggctctgctattcctcaccctcctcactcagggcatagggtcctgggcccagtctgccctgactcagcctgcctccgtgtctgggtctcctggacagtcgatcaccatctcctgcactgggaccagcagtgacgttcgnggtcaagctatgtctctggtacaacaacaccagcaagccccaaactcataatttatgatttcactaatcggcctcaggtgtatntaaatcncttcactggctccaaagtctggacaaactcggccctcctgacccatctctgggctccaggcagaggacgaggctgaattattactncgggactcctagggaccattacgtcaaccctttagtgtacgtttcggggactttggnaacccgaaaggtccctacgtcccgttaggtcaacgacccgaacgggtacccaaaccccgactctacacttcgtcgttaccctaccccc

SEQ ID NO: 308820 - DNA, 804 bp, Homo sapiens
  misc_feature: GZ8MTXP02JZGWO.13.81.H04.1.454.CMB.2.raw
tcagtcacgtactacacgaccggtgctcgatttagtagtgtagattcgcggggggggggtctcaggaggcagcgctctcgggacgtctccaccatggcctgggctctgctattcctcaccctcctcactcagggcatagggtcctgggcccagtctgccctgactcagcctgcctcgtgtctgggtctcctggacagtcgatccaccatcctcctgccacgtgggaccagctaggtggtacgttcggtggtacaagtactagtcgtctaccgtacgtaacccaacaaccgaccccgaaggaccgaaccggaaccccctaaatctaagtttaacgtttacggggacaaagtacggcccggcctacggacggttctttcgtagtacgttcgtctttcgtccgtcgtacctacccgtaaacgttccgtacggaaccgtaacccgtacccggtaccccttccccgtaacggaaccttaaacttcccgttaccggtcccgggtaaccgttccccggaaccgggggtcccgggaaaggggaccgggtaaacggttcctttaaggttttaacttttttccggtaggttttacgttaacagttaacgtggaaacggtaaagggagggtttataggttaagttacgttggttaacggtttagggaacggtacgggtaacgtaggtacccttaccgggtacgttacgggaaccgaccggtacccccggaaacggtaccccctaacctaccggttacctaaccgtacccgtttccgtaccccgttacccctacccgttacggttaactacccggg

SEQ ID NO: 308821 - DNA, 522 bp, Homo sapiens
  misc_feature: GZ8MTXP01B2776.22.59.F04.1.454.CMB.2.raw
  modified_base (210)..(210): a, c, t, g, unknown or other
  misc_feature (210)..(210): n is a, c, g, or t
  modified_base (308)..(308): a, c, t, g, unknown or other
  misc_feature (308)..(308): n is a, c, g, or t
  modified_base (353)..(353): a, c, t, g, unknown or other
  misc_feature (353)..(353): n is a, c, g, or t
  modified_base (368)..(368): a, c, t, g, unknown or other
  misc_feature (368)..(368): n is a, c, g, or t
tcagacatacgcgtcacgaccggtgctcgatttagtacacacacttagggattgggggaggaactgctcagttaggacccagacggaaccatggaagccccagcgcagcttctcttcctcctgctactctggctcccagtttcagataccactggagaaatagtgatgacgcagtctccagccaccctgtctgtgtctccgaggggaaangccacactctcctgcagggccagtcagagtgttagcagcagcttagcctggtaccagcagaacctggccaggcctcccaggcctcctcatctatggtncatctacggaggccagtggtactcccccagccaggttcagtggcnggtgggtctgggacnggagttcactctcaccatcagcagcctgcagtctgaagtatttgggcttagtttattactgtcagctaactataatacgtcggcctcgtacttaggttttcgccgtaggggaccaggcgttagggaagactaacgaaacgacttggtcggctcg

SEQ ID NO: 308822 - DNA, 517 bp, Homo sapiens
  misc_feature: GZ8MTXP01CRF35.22.59.F04.1.454.CMB.2.raw
  modified_base (210)..(210): a, c, t, g, unknown or other
  misc_feature (210)..(210): n is a, c, g, or t
  modified_base (294)..(294): a, c, t, g, unknown or other
  misc_feature (294)..(294): n is a, c, g, or t
  modified_base (304)..(304): a, c, t, g, unknown or other
  misc_feature (304)..(304): n is a, c, g, or t
  modified_base (312)..(312): a, c, t, g, unknown or other
  misc_feature (312)..(312): n is a, c, g, or t
  modified_base (346)..(346): a, c, t, g, unknown or other
  misc_feature (346)..(346): n is a, c, g, or t
tcagacatacgcgtcacgaccggtgctcgatttagtacacacacttagggattgggggaggaactgctcagttaggacccagacggaaccatggaagccccagcgcagcttctcttcctcctgctactctggctcccagtttcagataccactggagaaatagtgatgacgcagtctccagccaccctgtctgtgtctccgaggggaaangccacactctcctgcagggccagtcagagtgtagcagcagcttagcctggtaccagcagaacctggccaggctccaggctcctnatctatggtncatcacgnggccatggtactcccccagcaggttcaggtggcnggtgggtctggggacagagttcactctcacatcagcagcctgcagtctgaagtatttggcttagtttattactgtcagctaactataataactcggtcctcgtacttagtttcggccgtaacgggtacaagcgttaggaagtataacgaaacgtacgttcgtggcgtaacg

SEQ ID NO: 308823 - DNA, 583 bp, Homo sapiens
  misc_feature: GZ8MTXP01D782G.22.59.F04.1.454.CMB.2.raw
  modified_base (210)..(210): a, c, t, g, unknown or other
  misc_feature (210)..(210): n is a, c, g, or t
  modified_base (309)..(309): a, c, t, g, unknown or other
  misc_feature (309)..(309): n is a, c, g, or t
  modified_base (356)..(356): a, c, t, g, unknown or other
  misc_feature (356)..(356): n is a, c, g, or t
  modified_base (365)..(365): a, c, t, g, unknown or other
  misc_feature (365)..(365): n is a, c, g, or t
tcagacatacgcgtcacgaccggtgctcgatttagtacacacacttagggattgggggaggaactgctcagttaggacccagacggaaccatggaagccccagcgcagcttctcttcctcctgctactctggctcccagtttcagataccactggagaaatagtgatgacgcagtctccagccaccctgtctgtgtctccgaggggaaangccacactctcctgcagggccagtcagagtgtagcagcagcttagcctggtaccagcagaaacctggccaggactcccaggcctcctcatctagtggtncatcgacggagggcccagtggtactcccccagccaggtcaggtggcnggtgggtcnggggacaggagttcactctcacatcagcagcctgcagtctagtaagttatttggacttagtttacttacgtgtcacgttacaaacttaataaacttaaacgtcggtcccttaaccgttacgttaggttttacgggaccgtaacgggggaacccttaaggttccgttagggaaggaacttaaccgaaaacggtaacgttagggtaacggttaacgtcgg

SEQ ID NO: 308824 - DNA, 547 bp, Homo sapiens
  misc_feature: GZ8MTXP01D80KR.22.59.F04.1.454.CMB.2.raw
  modified_base (209)..(209): a, c, t, g, unknown or other
  misc_feature (209)..(209): n is a, c, g, or t
  modified_base (308)..(308): a, c, t, g, unknown or other
  misc_feature (308)..(308): n is a, c, g, or t
tcagacatacgcgtcacgaccggtgctcgatttagtacacacacttagggattgggggaggaactgctcagttaggacccagacggaaccatggaagccccagcgcagcttctcttcctcctgctactctggctcccagtttcagataccactggagaaatagtgatgacgcagtctccagccaccctgtctgtgtctccaggggaaanagccacactctcctgcagggccagtcagagtgttagcagcagcttagcctggtaccagcagaaacctggccaggcctcccaggctcctcatctatggtncatctacgagggccagtggtactccccccagccaggttcaggtggctggtgggtctggggacaggagttcactctcaccatcagcagcctgcagtctagtaagtatttgggcttagtttattactgtcagtctaacttaataataactcggtcccttaaccgttacgttaggttttcggccgtacggggacaacggcgttagggaagtacgtaacgaaacgtacttggtcggttcgtcg

SEQ ID NO: 308825 - DNA, 561 bp, Homo sapiens
  misc_feature: GZ8MTXP01CD90L.22.59.F04.1.454.CMB.2.raw
  modified_base (210)..(210): a, c, t, g, unknown or other
  misc_feature (210)..(210): n is a, c, g, or t
  modified_base (310)..(310): a, c, t, g, unknown or other
  misc_feature (310)..(310): n is a, c, g, or t
  modified_base (417)..(417): a, c, t, g, unknown or other
  misc_feature (417)..(417): n is a, c, g, or t
tcagacatacgcgtcacgaccggtgctcgatttagtacacacacttagggattgggggaggaactgctcagttaggacccagacggaaccatggaagccccagcgcagcttctcttcctcctgctactctggctcccagtttcagataccactggagaaatagtgatgacgcagtctccagccaccctgtctgtgtctccgaggggaaanagccacactctcctgcagggccagtcagagtgttagcagcagcttagcctggaccagcagaaccgtggccaggcctcccgaggcctcctcatctatggtncatcgtacggacggccagtggtactccccccagccaggttcaggtggctggtgggtctggggacaggtcgttcacctctcacatcagcagcctgcagtctagaagtnttttggcttagtttattacgtgtcagtactaactataaactaactcggtccttaaccggttacttaggtttcggaccggtaacggggtacccttaaggcgttagggaagtacgtaacgaaacgtaacgttggtaacggctaacg

SEQ ID NO: 308826 - DNA, 561 bp, Homo sapiens
  misc_feature: GZ8MTXP01EHWPE.22.59.F04.1.454.CMB.2.raw
  modified_base (209)..(209): a, c, t, g, unknown or other
  misc_feature (209)..(209): n is a, c, g, or t
  modified_base (307)..(307): a, c, t, g, unknown or other
  misc_feature (307)..(307): n is a, c, g, or t
  modified_base (350)..(350): a, c, t, g, unknown or other
  misc_feature (350)..(350): n is a, c, g, or t
tcagacatacgcgtcacgaccggtgctcgatttagtacacacacttagggattgggggaggaactgctcagttaggacccagacggaaccatggaagccccagcgcagcttctcttcctcctgctactctggctcccagtttcagataccactggagaaatagtgatgacgcagtctccagccaccctgtctgtgtctccaggggaaanagccacactctcctgcagggccagtcagagtgttagcagcagcttagcctggtaccagcagaaacctggccaggctcccaggctcctcatctatggtncatctacgaggccactggtactcccccagccaggttcagtgcnggtgggtctgggacagtagttcactctcaccatcagcagcctagcagtctagaagtatttggctagtttattactgttaccagactaactataaataaactcggcccttaaccggttaacttaggtttttcggaccgaaagggggtacccaaaggccgttagggaacggtaattaaccgaaaacgggaaccttaggtcgggttaacctcgg

SEQ ID NO: 308827 - DNA, 579 bp, Homo sapiens
  misc_feature: GZ8MTXP01EOOG5.22.59.F04.1.454.CMB.2.raw
  modified_base (211)..(211): a, c, t, g, unknown or other
  misc_feature (211)..(211): n is a, c, g, or t
  modified_base (312)..(312): a, c, t, g, unknown or other
  misc_feature (312)..(312): n is a, c, g, or t
  modified_base (359)..(359): a, c, t, g, unknown or other
  misc_feature (359)..(359): n is a, c, g, or t
  modified_base (419)..(419): a, c, t, g, unknown or other
  misc_feature (419)..(419): n is a, c, g, or t
tcagacatacgcgtcacgaccggtgctcgatttagtacacacacttagggattgggggaggaactgctcagttaggacccagacggaaccatggaagccccagcgcagcttctcttcctcctgctactctggctcccagtttcagataccactggagaaatagtgatgacgcagtctccagccaccctgtctgtgtctccgaaggggaaanagccacactctcctgcagggccagtcagagtgtagcagcagcttagcctggtaccagcagaaacctggccaggcctcccgaggcctcctcatctagtggtncatcgtacggaggccacgtggtactcccccgagcaggttcaggtgcnggtgggtctgggacaggtacgtcactctcacatcagcacgcctgctagtctagtaagttnttttggacttagtttattactgtaccagtactaactataaagttaacgtcggtccctaacgttacgttaggtttcgggaccgtaacgggggtaaccaagggttccgttaagggaacgtaacgttaaccgaaaacggtaacggttggtcggttcgtaaccg

SEQ ID NO: 308828 - DNA, 527 bp, Homo sapiens
  misc_feature: GZ8MTXP01EW716.22.59.F04.1.454.CMB.2.raw
  modified_base (208)..(208): a, c, t, g, unknown or other
  misc_feature (208)..(208): n is a, c, g, or t
  modified_base (354)..(354): a, c, t, g, unknown or other
  misc_feature (354)..(354): n is a, c, g, or t
tcagacatacgcgtcacgaccggtgctcgatttagtacacacacttagggattgggggaggaactgctcagttaggacccagacggaaccatggaagccccagcgcagcttctcttcctcctgctactctggctcccagtttcagataccactggagaaatagtgatgacgcagtctccagccaccctgtctgtgtctccaggggaangccacactctcctgcagggccagtcagagtgtagcagcagcttagcctggtaccagcagaacctggccaggcctcccgaggcctcctcattctagtggtgcatctacggaggccacgtggtactcccccgagcaggttcaggtgcnggtgggtctgggacaggtacgttcactctcaccatcagctacgcctgcagtctagtaagtattttggcttagttttattactgtcagtctaactataataactggtcctaacgttacttagtttcggccgaggggtacaaggcttaggaagataacgaagtacttgtcgctcg

SEQ ID NO: 308829 - DNA, 561 bp, Homo sapiens
  misc_feature: GZ8MTXP01EORK2.22.59.F04.1.454.CMB.2.raw
  modified_base (210)..(210): a, c, t, g, unknown or other
  misc_feature (210)..(210): n is a, c, g, or t
  modified_base (291)..(291): a, c, t, g, unknown or other
  misc_feature (291)..(291): n is a, c, g, or t
  modified_base (302)..(302): a, c, t, g, unknown or other
  misc_feature (302)..(302): n is a, c, g, or t
  modified_base (347)..(347): a, c, t, g, unknown or other
  misc_feature (347)..(347): n is a, c, g, or t
tcagacatacgcgtcacgaccggtgctcgatttagtacacacacttagggattgggggaggaactgctcagttaggacccagacggaaccatggaagccccagcgcagcttctcttcctcctgctactctggctcccagtttcagataccactggagaaatagtgatgacgcagtctccagccaccctgtctgtgtctccgaggggaaangccacactctcctgcagggccagtcagagtgtagcagcagcttagcctggtaccagcagaacctgccaggctccagctccncatctatggtncatctacggaggccagtggtactcccccagccaggttcaggtgcnggtgggtctggggacaggagttcactctcaccatcagcacgcctgcagtctagaagtatttgggacttagtttattactgtcagtactaactaataaataacgtcggtaccttccgttaacgttaggttttaccggaccgtaacgggggtaacccaaggttccgttagggaacgtagttaaccgaaaacggtacgttaggtcgggcttaaccgg

SEQ ID NO: 308830 - DNA, 592 bp, Homo sapiens
  misc_feature: GZ8MTXP01C1X3M.22.59.F04.1.454.CMB.2.raw
  modified_base (208)..(208): a, c, t, g, unknown or other
  misc_feature (208)..(208): n is a, c, g, or t
  modified_base (214)..(214): a, c, t, g, unknown or other
  misc_feature (214)..(214): n is a, c, g, or t
  modified_base (308)..(308): a, c, t, g, unknown or other
  misc_feature (308)..(308): n is a, c, g, or t
  modified_base (412)..(412): a, c, t, g, unknown or other
  misc_feature (412)..(412): n is a, c, g, or t
tcagacatacgcgtcacgaccggtgctcgatttagtacacacacttagggattgggggaggaactgctcagttaggaccagacggaaccatggaagccccagcgcagcttctcttcctcctgctactctggctcccagtttcagataccactggagaaatagtgatgacgcagtctccagccacctgtctgtgtctcgaaggggaaanagccanactctcctgcagggccagtcagagtgtagcagcagcttagcctggtaccagcaagaaacctggccaggcctccgagcctcctcatctagtggtnctagttcgacggacggccaacgtggtactcccccgaggctaggttcaggtcgggactgggttcgggtcgtagggggaacagggtacgtttcactctaccaccancacgcacggcctgcagtactagtaagttatttggtactttaaggtttattacgtgtactacgtactaacttaataaactacgtcggtacctaacggttaacgttaggtttacggccggtaacggggaccgttaaggcgttaggaaggactaacgaaacgtacgttaggttcgcgtaaccg

SEQ ID NO: 308831 - DNA, 631 bp, Homo sapiens
  misc_feature: GZ8MTXP01ERZCJ.22.59.F04.1.454.CMB.2.raw
  modified_base (210)..(210): a, c, t, g, unknown or other
  misc_feature (210)..(210): n is a, c, g, or t
tcagacatacgcgtcacgaccggtgctcgatttagtacacacacttagggattgggggaggaactgctcagttaggacccagacggaaccatggaagccccagcgcagcttctcttcctcctgctactctggctcccagtttcagataccactggagaaatagtgatgacgcagtctccagccaccctgtctgtgtctccgaggggaaangccacactctcctgcagggccagtcagagtgttagcagcagtctacgccgtaggtaccagacgaacgaaccgtcggaccgacggtccctcccgaggtccctcctacattctagtggtgactacgttcgtaacgggacggtccctacgtacggttacctcccccgacggtacgtaggttcgtaagggtcgggcgtaaggggttcgggtacggcggggtaactagggtacgtcctacttcctacaaccatcgagaccacgtcctgacctagttcgtagtaaagttcgtttggatttaagtttaactcgtgtaccatactaaatataacgtactccggtctaaccgttagttacggttcggacggtacgggtaacacgggttcgttagggaatacgtaaccgaaacggtgttgtcgcgtaaccg

SEQ ID NO: 308832 - DNA, 541 bp, Homo sapiens
  misc_feature: GZ8MTXP01EDB68.22.59.F04.1.454.CMB.2.raw
  modified_base (262)..(262): a, c, t, g, unknown or other
  misc_feature (262)..(262): n is a, c, g, or t
  modified_base (270)..(270): a, c, t, g, unknown or other
  misc_feature (270)..(270): n is a, c, g, or t
  modified_base (277)..(277): a, c, t, g, unknown or other
  misc_feature (277)..(277): n is a, c, g, or t
  modified_base (286)..(286): a, c, t, g, unknown or other
  misc_feature (286)..(286): n is a, c, g, or t
  modified_base (296)..(296): a, c, t, g, unknown or other
  misc_feature (296)..(296): n is a, c, g, or t
  modified_base (305)..(305): a, c, t, g, unknown or other
  misc_feature (305)..(305): n is a, c, g, or t
  modified_base (335)..(336): a, c, t, g, unknown or other
  misc_feature (335)..(336): n is a, c, g, or t
  modified_base (392)..(392): a, c, t, g, unknown or other
  misc_feature (392)..(392): n is a, c, g, or t
tcagacatacgcgtcacgaccggtgctcgatttagtacacacacttagggattgggggaggaactgctcagttaggacccagacggaaccatggaagccccagcgcagcttctcttcctcctgctactctggctcccagtttcagataccactggagaaatagtgatgacgcagtctccagccaccctgtctgtgtctccaggggaaagagccacactctcctgcagggccagtcagagtgttagcagcagctagcctgacngcagaacngccagcnccagctccncatctatgtncatctacgnggccactggtactccccagcaggtcagtgnngtgggtctgggacaggtcgttcactctcacatcagcacgcctgcagtctagaagtntttggcttagtttatactgtcagactaactaataactaacgtcggtccttaaccgttaacttaggttttcgggaccgtaacgggggtaacccaaggccgttagggaagtaacgttaaccgaaaacgtaacgttgtaacggttcgtaacg

SEQ ID NO: 308833 - DNA, 521 bp, Homo sapiens
  misc_feature: GZ8MTXP01DMY2R.22.59.F04.1.454.CMB.2.raw
  modified_base (210)..(210): a, c, t, g, unknown or other
  misc_feature (210)..(210): n is a, c, g, or t
  modified_base (297)..(297): a, c, t, g, unknown or other
  misc_feature (297)..(297): n is a, c, g, or t
  modified_base (307)..(307): a, c, t, g, unknown or other
  misc_feature (307)..(307): n is a, c, g, or t
tcagacatacgcgtcacgaccggtgctcgatttagtacacacacttagggattgggggaggaactgctcagttaggacccagacggaaccatggaagccccagcgcagcttctcttcctcctgctactctggctcccagtttcagataccactggagaaatagtgatgacgcagtctccagccaccctgtctgtgtctccgaggggaaanagccacactctcctgcagggccagtcagagtgttagcagcagcttagcctggtaccagcagaaacctggccaggctccaggctcctnatctatggtncatcacgagggccagtggtactcccccagccaggttcaggtgggctggtgggtctggggactagagttcactctcaccatcagcagcctgcagtctgtaagtattttgggacttagtttaattacttgtcagcaacttataataactgcctaacgtacttgtttcggccgtagggacaagcgttaggaagataacaaagacttggtgcgtaacg

SEQ ID NO: 308834 - DNA, 635 bp, Homo sapiens
  misc_feature: GZ8MTXP01AXZJE.22.59.F04.1.454.CMB.2.raw
  modified_base (210)..(210): a, c, t, g, unknown or other
  misc_feature (210)..(210): n is a, c, g, or t
  modified_base (310)..(310): a, c, t, g, unknown or other
  misc_feature (310)..(310): n is a, c, g, or t
  modified_base (320)..(320): a, c, t, g, unknown or other
  misc_feature (320)..(320): n is a, c, g, or t
  modified_base (335)..(335): a, c, t, g, unknown or other
  misc_feature (335)..(335): n is a, c, g, or t
tcagacatacgcgtcacgaccggtgctcgatttagtacacacacttagggattgggggaggaactgctcagttaggacccagacggaaccatggaagcccagcgcagcttctcttcctcctgctactctggctcccagtttcagataccactggagaaatagtgatgacgcagtctccagccaccctgtctgtgtctccgaaggggaaanacgccacactctcctgcagggccagtcagagtgttagcagcagcttagcctggaccagcaagaacctggccaggtcctccaggctcctcagtctatggtncatcaacggnggcccagtggtaccnccccgagcgtaggttcgaggtcggacgtggtgggtcggtagggacgagtacgtactactacctacacactacgacgacgacgccgtcgacgtacgtacgtagtaagttagtttacggttacgttagtttactttacgttacgtacgtacgtactaacttaaactaaactaacgttacggtccgttaaccgttaacggttacggtttacggttaccgggtaacggggtaaccggaacggttacggttacggtaacggtaacgtaacgtaaacggtaacggttacggtcggttaacgtaacg

SEQ ID NO: 308835 - DNA, 541 bp, Homo sapiens
  misc_feature: GZ8MTXP01DM34B.22.59.F04.1.454.CMB.2.raw
  modified_base (210)..(210): a, c, t, g, unknown or other
  misc_feature (210)..(210): n is a, c, g, or t
  modified_base (215)..(215): a, c, t, g, unknown or other
  misc_feature (215)..(215): n is a, c, g, or t
  modified_base (296)..(296): a, c, t, g, unknown or other
  misc_feature (296)..(296): n is a, c, g, or t
  modified_base (352)..(352): a, c, t, g, unknown or other
  misc_feature (352)..(352): n is a, c, g, or t
  modified_base (512)..(512): a, c, t, g, unknown or other
  misc_feature (512)..(512): n is a, c, g, or t
  modified_base (536)..(536): a, c, t, g, unknown or other
  misc_feature (536)..(536): n is a, c, g, or t
tcagacatacgcgtcacgaccggtgctcgatttagtacacacacttagggattgggggaggaactgctcagttaggacccagacggaaccatggaagccccagcgcagcttctcttcctcctgctactctggctcccagtttcagataccactggagaaatagtgatgacgcagtctccagccaccctgtctgtgtctccgaggggaaangccanactctcctgcagggcctgtcagagtgttagcagcagcttagcctggaccagcagaaacctggccaggcctccaggctcctnatctatggtgcatctacggaggccagtggtactcccccgagccaggttcaggtgcnggtgggtctggggacaggtagttcactctcaccatcagcacgcctgccagtctagtaagtagttttggggtactttaggtttattacgtgtctagctaactaataaattaactcggtccttcgtacttgtttcggacgtaaggggacaggcgttaggaanagtaacgaaacgacgttagtcggntaacg

SEQ ID NO: 308836 - DNA, 557 bp, Homo sapiens
  misc_feature: GZ8MTXP01EK4LA.22.59.F04.1.454.CMB.2.raw
  modified_base (208)..(208): a, c, t, g, unknown or other
  misc_feature (208)..(208): n is a, c, g, or t
tcagacatacgcgtcacgaccggtgctcgatttagtacacacacttagggattgggggaggaactgctcagttaggacccagacggaaccatggaagccccagcgcagcttctcttcctcctgctactctggctcccagtttcagataccactggagaaatagtgatgacgcagtctccagccacctgtctgtgtctccgaggggaanagccacactctcctgcagggccagtcagagtgtagcagcagcttagcctggtaccagcagaaacctggaccaggcctccgaggcctcctcattctatggtgcatcgtacggaggcccagtcggtactccccccgagtccagggttcaggtgggactgggtgggtctggggacaggtacgttcactctcaccagtcagcacgcctgcagtctagtaagtattttgggacttaggtttattacgtgtcagtcacttataactacgtcggtcctcgtacttaggtttcggacgtacgggggaccaaggcgttaggaagtacgtaacgaaacggtacttggtaacggctaacg

SEQ ID NO: 308837 - DNA, 534 bp, Homo sapiens
  misc_feature: GZ8MTXP01CICFK.22.59.F04.1.454.CMB.2.raw
  modified_base (310)..(310): a, c, t, g, unknown or other
  misc_feature (310)..(310): n is a, c, g, or t
  modified_base (355)..(355): a, c, t, g, unknown or other
  misc_feature (355)..(355): n is a, c, g, or t
  modified_base (364)..(364): a, c, t, g, unknown or other
  misc_feature (364)..(364): n is a, c, g, or t
  modified_base (412)..(412): a, c, t, g, unknown or other
  misc_feature (412)..(412): n is a, c, g, or t
tcagacatacgcgtcacgaccggtgctcgatttagtacacacacttagggattgggggaggaactgctcagttaggacccagacggaaccatggaagccccagcgcagcttctcttcctcctgctactctggctcccagtttcagataccactggagaaatagtgatgacgcagtctccagccaccctgtctgtgtctccgaggggaaagagccacactctcctgcagggccagtcagagtgttagcagcagcttagcctggtaccagcagaaacctggccaggcctcccaggcctcctcatctatggtncatctacggaggccatggtactccccccagccaggttcagtggcnggtgggtcnggggacaggagttcactctcaccatcagcagcctgcagtctagaagtnttttggcttagtttattactgtcagactactaataataacgtcggtcctccgtacgttggtttcggccgtacggggtacccaaggcttaggaagtactaacgaaacgtacgttgtggcgtcg

SEQ ID NO: 308838 - DNA, 543 bp, Homo sapiens
  misc_feature: GZ8MTXP01C2FO3.22.59.F04.1.454.CMB.2.raw
  modified_base (208)..(208): a, c, t, g, unknown or other
  misc_feature (208)..(208): n is a, c, g, or t
  modified_base (213)..(213): a, c, t, g, unknown or other
  misc_feature (213)..(213): n is a, c, g, or t
  modified_base (293)..(293): a, c, t, g, unknown or other
  misc_feature (293)..(293): n is a, c, g, or t
  modified_base (303)..(303): a, c, t, g, unknown or other
  misc_feature (303)..(303): n is a, c, g, or t
  modified_base (349)..(349): a, c, t, g, unknown or other
  misc_feature (349)..(349): n is a, c, g, or t
tcagacatacgcgtcacgaccggtgctcgatttagtacacacacttagggattgggggaggaactgctcagttaggacccagacggaaccatggaagccccagcgcagcttctcttcctcctgctactctggctcccagtttcagataccactggagaaatagtgatgacgcagtctccagccaccctgtctgtgtctcaggggaaangccanactctctgcagggccagtcagagtgtagcagcagcttagcctggtaccagcagaaacctggccaggctccaggcctcctnatctatggtncattcacgagggccatggtactcccccagcctaggttcagtcggcnggtgggtctggggacaggacgttcactctcaccatcagcagcctgcagtctgaagtattttggctagtttattactgtcagctaactataataactcggtcctaaccgttacttaggttttcggccgtaacgggggaccaaaggttccgttagggaagtacgtaacgaaaacgtaacgttggttaacggcgtcg

SEQ ID NO: 308839 - DNA, 614 bp, Homo sapiens
  misc_feature: GZ8MTXP01AVLPG.22.59.F04.1.454.CMB.2.raw
  modified_base (210)..(210): a, c, t, g, unknown or other
  misc_feature (210)..(210): n is a, c, g, or t
  modified_base (306)..(306): a, c, t, g, unknown or other
  misc_feature (306)..(306): n is a, c, g, or t
tcagacatacgcgtcacgaccggtgctcgatttagtacacacacttagggattgggggaggaactgctcagttaggacccagacggaaccatggaagccccagcgcagcttctcttcctcctgctactctggctcccagtttcagataccactggagaaatagtgatgacgcagtctccagccaccctgtctgtgtctccgaggggaaanagccaacactctcctgcagggccagtcagagtgtagcagcagcttagctggtaccagcagaacctggccaggctccaggctcctcatctatcggtncatcgtacggacggccagtcgtactcccccgagcgtaggtcaggtcggactggtcgggtcgtaggggactaggtacgttacacttcctaccacctagtcgacgacgacgccgtcgtacgtacgtacgtacgtaagttagtttacggttacgttaagtttaacgttacgttacgtacgtacgtactaactaactaaactaacgtacgtaccgttaaccgttaacgttacggtttacggttaccggtaacgggtaaccgaacgttcgttacggtaagtacgtaacgaaacgtaacgttacggtcgcgtcg

SEQ ID NO: 308840 - DNA, 598 bp, Homo sapiens
  misc_feature: GZ8MTXP01D3785.22.59.F04.1.454.CMB.2.raw
  modified_base (211)..(211): a, c, t, g, unknown or other
  misc_feature (211)..(211): n is a, c, g, or t
  modified_base (403)..(403): a, c, t, g, unknown or other
  misc_feature (403)..(403): n is a, c, g, or t
tcagacatacgcgtcacgaccggtgctcgatttagtacacacacttagggattgggggaggaactgctcagttaggacccagacggaaccatggaagccccagcgcagcttctcttcctcctgctactctggctcccagtttcagataccactggagaaatagtgatgacgcagtctccagccaccctgtctgtgtctccgaggggaaagngccacactctcctgcagggccagtcagagtgtagcagcagcttagcctggtacagcaagaaacctggacccaggcctcccgaggcctcctcatctatggtgctagtctacggacggccagtggtactcccccgagccgtaggttcaggtcgctgggtcgggtacgtggggactaggacgttcactctcaccntcagcacgctgctagtctagtaagttctttggggacttaaggtttacttacgtgtacctagtactaacttaattaaacttaacgtcggttccctaacgttaacgttaggtttcgggacccgtaaagggggtacccaagggttccgttagggaacgtaacttaaccgaaaacgtccgttaggtcgggttaactccg

SEQ ID NO: 308841 - DNA, 610 bp, Homo sapiens
  misc_feature: GZ8MTXP01DJ592.22.59.F04.1.454.CMB.2.raw
  modified_base (209)..(209): a, c, t, g, unknown or other
  misc_feature (209)..(209): n is a, c, g, or t
tcagacatacgcgtcacgaccggtgctcgatttagtacacacacttagggattgggggaggaactgctcagttaggacccagacggaaccatggaagccccagcgcagcttctcttcctcctgctactctggctcccagtttcagataccactggagaaatagtgatgacgcagtctccagccaccctgtctgtgtctcgaggggaagngccacactctctgcaggccagtcagagtgtagcagcagcttagcctggtaccagcagaacctggccaggcctccgaggcctcctcatctatggtgctatcgtacggacggccacgtggtacctcccccgaggcctaggttccaggtcggacgtgggtgggtcgaggggactaggtcgttcactcctcacatcgagcagcctgacgtagtcgtagtaagttattttacgggtactttaagttttacttacgttgtacacgtactaacttaataaacttacgtcggtcccttaaccgttaacgttacgggttttacgggaccggtaaacgggggaaccttaacggttcgttacgggtaagtaaacgtaaccgtaaaacggtacgttagggtcgttcgtaaccg

SEQ ID NO: 308842 - DNA, 638 bp, Homo sapiens
  misc_feature: GZ8MTXP01BT8HD.22.59.F04.1.454.CMB.2.raw
  modified_base (213)..(213): a, c, t, g, unknown or other
  misc_feature (213)..(213): n is a, c, g, or t
  modified_base (317)..(317): a, c, t, g, unknown or other
  misc_feature (317)..(317): n is a, c, g, or t
tcagacatacgcgtcacgaccggtgctcgatttagtacacacacttagggattggggggaggaactgctcagttaggacccagacggaaccatggaagccccagcgcagcttctcttcctcctgctactctggctcccagtttcagataccactggaagaaatagtgatgacgcagtctccagccaccctgtctgtgtctccgaaggggaaangccacactctcctgcgagggccagtcagtagtgttagcagcagcttagcctggtaccagcaagaacctggccaggcctcccgaggcctcctcattctagtggtnactactcgtacgggacgggccctaagttcggtaacctccccccgaggtccgtagggttccagggttcgggacgtggggttggggtacgtagggggaactagggtacgttcactctacacactcagcacgcctgcgagtcgtagtaagttgtttaggtacttagtttacttacgtacgtacgtagtactaactaataacttaacgtcggtcccgttaacgttaacgttacgggtttaccgggaccgggtaacggggtaacgaacggttcggttaagggtaacgtaacgtaacgtaaacggtacgttacggtcggcgtaaccg

SEQ ID NO: 308843 - DNA, 534 bp, Homo sapiens
  misc_feature: GZ8MTXP01BB2L0.22.59.F04.1.454.CMB.2.raw
  modified_base (208)..(208): a, c, t, g, unknown or other
  misc_feature (208)..(208): n is a, c, g, or t
  modified_base (305)..(305): a, c, t, g, unknown or other
  misc_feature (305)..(305): n is a, c, g, or t
  modified_base (352)..(352): a, c, t, g, unknown or other
  misc_feature (352)..(352): n is a, c, g, or t
tcagacatacgcgtcacgaccggtgctcgatttagtacacacacttagggattgggggaggaactgctcagttaggacccagacggaaccatggaagccccagcgcagcttctcttcctcctgctactctggctcccagtttcagataccactggagaaatagtgatgacgcagtctccagccaccctgtctgtgtctccaggggaangccacactctcctgcagggccagtcagagtgtagcagcagcttagcctggtaccagcagaacctggccaggcctcccaggcctcctcatctatggtncatctacggaggccacgtggtactccccccagccaggttcaggtgcnggtgggtctggggactaggagttccactctcacatcagcagcctgcagtctagaagttcgtttggacttagtttattacgtgtcctagtactactataactaacgtcggtcccttaacgtattaggtttcggaccgaggggaccagcgttaggtaagactcgaaacgtattggtcgctaacg

SEQ ID NO: 308844 - DNA, 583 bp, Homo sapiens
  misc_feature: GZ8MTXP01ECEZX.22.59.F04.1.454.CMB.2.raw
  modified_base (209)..(209): a, c, t, g, unknown or other
  misc_feature (209)..(209): n is a, c, g, or t
  modified_base (263)..(263): a, c, t, g, unknown or other
  misc_feature (263)..(263): n is a, c, g, or t
  modified_base (435)..(435): a, c, t, g, unknown or other
  misc_feature (435)..(435): n is a, c, g, or t
tcagacatacgcgtcacgaccggtgctcgatttagtacacacacttagggattgggggaggaactgctcagttaggacccagacggaaccatggaagccccagcgcagcttctcttcctcctgctactctggctcccagtttcagataccactggagaaatagtgatgacgcagtctccagccaccctgtctgtgtctcgaggggaaangccacactctctgcagggccagtcagagtgtagcagcagcttagcctggtaccngcagaacctggaccaggcctccgaggcctcctcatctagtggtgctatcgtacggagggcccaacgttggtactcccccccgaggtcctagggttccaggtcggctgggtgggtctaggggactaggtacgttcactctcacatcagcacgcctgctagtcgtagtaagttntttgggacttaagtttattactgtcagtactacttaattaactaacgtcggtaccttaaccggttacttagggttttcggaccggtacgggggtaaccaggttcgttagggaaggtactaacgtaaacggacgttagtcggaacgtcg

SEQ ID NO: 308845 - DNA, 594 bp, Homo sapiens
  misc_feature: GZ8MTXP01BQGW2.22.59.F04.1.454.CMB.2.raw
  modified_base (362)..(362): a, c, t, g, unknown or other
  misc_feature (362)..(362): n is a, c, g, or t
  modified_base (449)..(449): a, c, t, g, unknown or other
  misc_feature (449)..(449): n is a, c, g, or t
tcagacatacgcgtcacgaccggtgctcgatttagtacacacacttagggattgggggaggaactgctcagttaggacccagacggaaccatggaagccccagcgcagcttctcttcctcctgctactctggctcccagtttcagataccactggagaaatagtgatgacgcagtctccagccaccctgtctgtgtctccgaggggaaagagccacactctcctgcagggccagtcagagtgttagcagcagcttagcctggtaccagcaagaaacctggccaggactcccgaggcctcctcatctatggtgcatcgtacgagggccacgtggtactcccccgagcctaggttcaggtggcnggtgggtcgtggggacagtagtcactctctaccatcagcagccctgcgtagtctagaagttacttttggacttagtttacttacgtntcgatctaaacttaataattaccgtcggtcccttaaccggttaacgttcggttttacgggaccgtaacgggggtaacccttaaaggccggttagggtaacgtacgtaaaccgtaaacggtaaccgttaggtcgggttaactcccg

SEQ ID NO: 308846 - DNA, 709 bp, Homo sapiens
  misc_feature: GZ8MTXP01EURNW.22.59.F04.1.454.CMB.2.raw
  modified_base (211)..(211): a, c, t, g, unknown or other
  misc_feature (211)..(211): n is a, c, g, or t
  modified_base (326)..(326): a, c, t, g, unknown or other
  misc_feature (326)..(326): n is a, c, g, or t
tcagacatacgcgtcacgaccggtgctcgatttagtacacacacttagggattgggggaggaactgctcagttaggacccagacggaaccatggaagccccagcgcagcttctcttcctcctgctactctggctcccagtttcagataccactggagaaatagtgatgacgcagtctccagccaccctgtctgtgtctccgaaggggaaangccacactctcctgcagggccagtcagagtgttagcagcagtctagcctggtaccagcagaaccgtggccaggcctcccgaggcctcctcattctagtggtgcactcgtaacggngggccctacgttggtactccccccgagtccgaggttcaggtcggctaagggttgggtccgtagggactaggtacgttcactctcacatcacgcacgcctgacgtacgttcgtaggtaaacgttagtttttacggggacgtttaacggtttttaactttacggttacggttaacctacggtaaccttaaacgtttaaacttaaaacgttaaaccggttccgggttaccccgttaacccggtttaaccggtttaacggggtttttaccggggaacccgggttaaacggggggaaaccccggttaagggttccgggttaagggtaacgggttaaataaacccggtaaaaacgggtacggttacgggttaacggttccgtaacccgg

SEQ ID NO: 308847 - DNA, 625 bp, Homo sapiens
  misc_feature: GZ8MTXP01A7UQY.22.59.F04.1.454.CMB.2.raw
  modified_base (211)..(211): a, c, t, g, unknown or other
  misc_feature (211)..(211): n is a, c, g, or t
  modified_base (309)..(309): a, c, t, g, unknown or other
  misc_feature (309)..(309): n is a, c, g, or t
tcagacatacgcgtcacgaccggtgctcgatttagtacacacacttagggattgggggaggaactgctcagttaggacccagacggaaccatggaagccccagcgcagcttctcttcctcctgctactctggctcccagtttcagataccactggagaaatagtgatgacgcagtctccagccaccctgtctgtgtctccgaggggaaagngccacactctcctgcagggccagtcagagtgtagcagcagcttagcctggtaccagcaagaacctggaccaggcctccaggcctcctcatctatggtncatcgtacggacggccacgtcggtactccccccgagacctaggttcaggtcgggcgtgggtcggggtacgtaggggactagggtacgttccacgtcctacgacctatccgaagtcgacgcctgccgtagttctagtaacgttagttttcggggactttaaggttttataccgtaggtacctagtactaactaattaaacgtacgtcggtacccttaacggttaacgttacgggtttcggacccggtaagggtaacccttagggccgttaggggaatactaacggtaaacgtacggttacggtccggttcgtaaccg

SEQ ID NO: 308848 - DNA, 597 bp, Homo sapiens
  misc_feature: GZ8MTXP01B2X92.22.59.F04.1.454.CMB.2.raw
  modified_base (210)..(210): a, c, t, g, unknown or other
  misc_feature (210)..(210): n is a, c, g, or t
tcagacatacgcgtcacgaccggtgctcgatttagtacacacacttagggattgggggaggaactgctcagttaggacccagacggaaccatggaagccccagcgcagcttctcttcctcctgctactctggctcccagtttcagataccactggagaaatagtgatgacgcagtctccagccaccctgtctgtgtctccgaggggaaanagccacactctcctgcagggccagtcagagtgttagcagcagcttagcctggtaccagcagaaacctggccaggcctccgaggcctcctcatctagtggtgctatcgtacggaggcccagtggtactccccccgaggtcctagggttccaggtgggctgggtggggtctggggacaggtacgttcactctcaccatcagcagcctgccagtctagtaagtattttggcttagtttattacgtgtactagtactaacttaataaacttacgtacggtcccttaaccgttaacgttacggttttcgggaccggtaacgggggaccttaaaggttccgttagggtaacgtacgttaacgaaaacggtacgttacggtcggttcgtaaccg

SEQ ID NO: 308849 - DNA, 629 bp, Homo sapiens
  misc_feature: GZ8MTXP01ESUHL.22.59.F04.1.454.CMB.2.raw
  modified_base (209)..(209): a, c, t, g, unknown or other
  misc_feature (209)..(209): n is a, c, g, or t
tcagacatacgcgtcacgaccggtgctcgatttagtacacacacttagggattgggggaggaactgctcagttaggacccagacggaaccatggaagccccagcgcagcttctcttcctcctgctactctggctcccagtttcagataccactggagaaatagtgatgacgcagtctccagccaccctgtctgtgtctccgaggggaangccacactctcctgcagggccagtcagtagtgttagcagcagcttagcctggtaccagcagaaacctggccaggcctcccgaggctcctcatctagtggtgcactcgtacggacgggccacgtcggtactccccccgaggccgtaggttcaggtcggcgtaagggttcggggtctgggggactagggacgtttcaacttcgtcacatcgagctacgccctgcctaggtctagtaagttacgtttggactttaaggttttacttacgttgtacgagtactaaacttaataaacgttaacgtcggtacccttaaccgttagttacgggttttacgggacccgtaagggggtaacccttaaggttccgttaagggaacgtaactaaccggtaaaacgtacgttaggtaacggttccgtaaccg

SEQ ID NO: 308850 - DNA, 646 bp, Homo sapiens
  misc_feature: GZ8MTXP01D1Z60.22.59.F04.1.454.CMB.2.raw
  modified_base (208)..(208): a, c, t, g, unknown or other
  misc_feature (208)..(208): n is a, c, g, or t
tcagacatacgcgtcacgaccggtgctcgatttagtacacacacttagggattgggggaggaactgctcagttaggacccagacggaaccatggaagccccagcgcagcttctcttcctcctgctactctggctcccagtttcagataccactggagaaatagtgatgacgcagtctccagccaccctgtctgtgtctccaggggaangccacactctcctgcaggccagtcagagtgttagcagcagcttagcctggtaccagacagaacctggccaggcctcccaggcctcctcatctatggtgctatcgtacggacgggtcccacgtcggtactcccccccgaaggtcccgtaaggggtttcccaggttcggggaccgtaagggtttcgggggtccgtagggggacctagggtacggtttccaacttcctccacctatccgagcgacgcctagcagtctagtaagttagttttcgggtactttagtttactttacgtgtctacgtactaacttaattaaacttaacgtcggtcccttccggttacgttacggttttacgggaccgtaacgggggtaacccaacggttcgttacgggaagtaacgtaacgtaaaccgggtaacgttgggtcggttcgttaaccg

SEQ ID NO: 308851 - DNA, 645 bp, Homo sapiens
  misc_feature: GZ8MTXP01BXRUK.22.59.F04.1.454.CMB.2.raw
  modified_base (316)..(316): a, c, t, g, unknown or other
  misc_feature (316)..(316): n is a, c, g, or t
tcagacatacgcgtcacgaccggtgctcgatttagtacacacacttagggattgggggaggaactgctcagttaggacccagacggaaccatggaagccccagcgcagcttctcttcctcctgctactctggctcccagtttcagataccactggagaaatagtgatgacgcagtctccagccaccctgtctgtgtctccgaggggaaagagccacactctcctgcagggccagtcagagtgttagcagcagtcttacgccgtggtaccagacaagaaccgtggccaggcctccgaggcctcctcatctagtggtncatcgtacggacggccagtcggtactcccccgagtccgtaggttcaggtcggcgtaaggtggggtctaggggacagggtacgtcactcctaccacctagtcacgtcgacgtccgtgccgtaagtctaaggtaagttagttttcgggacgtttaagtttactacgttacgttacaagtactaaacttaattaaactaacgttccgggtcccttaaccggtaacgttagggtttccggaccgggtaacgggggtaacccttaggggttcgttaggggtaacgtaacgtaaccgtaaaaccgggtagttacggggtcggttaaccgtaacgg

SEQ ID NO: 308852 - DNA, 621 bp, Homo sapiens
  misc_feature: GZ8MTXP01BKFHE.22.59.F04.1.454.CMB.2.raw
  modified_base (209)..(209): a, c, t, g, unknown or other
  misc_feature (209)..(209): n is a, c, g, or t
  modified_base (437)..(437): a, c, t, g, unknown or other
  misc_feature (437)..(437): n is a, c, g, or t
  modified_base (462)..(462): a, c, t, g, unknown or other
  misc_feature (462)..(462): n is a, c, g, or t
tcagacatacgcgtcacgaccggtgctcgatttagtacacacacttagggattgggggaggaactgctcagttaggacccagacggaaccatggaagccccagcgcagcttctcttcctcctgctactctggctcccagtttcagataccactggagaaatagtgatgacgcagtctccagccaccctgtctgtgtctccgaggggaangccacactctcctgcagggccagtcagtagtgtagcagcagtcttagcctggtaccagcaagaacctggaccaggcctcccaggcctcctcattctagtcggtcgactactcgtaacggacgggccctaacgtggtaacctccccccgaggtccgtagggttcgaggtacgggcctaagggttcggggtacgtggggaaccaggtacgttcaacctctacacctatcngcacgcctgactgtactgtaagttntttagggctttaagtttacttagtgtcagtactaataactaaacttacgtcggtcccttaacggttacgtttaggtttccgggaccggtaaacgggggtaccccaaaggttcgttaacgggaatactaacggaaaaccgtagttggtcgttaacgtccg

SEQ ID NO: 308853 - DNA, 589 bp, Homo sapiens
  misc_feature: GZ8MTXP01EMSPX.22.59.F04.1.454.CMB.2.raw
  modified_base (210)..(210): a, c, t, g, unknown or other
  misc_feature (210)..(210): n is a, c, g, or t
  modified_base (348)..(348): a, c, t, g, unknown or other
  misc_feature (348)..(348): n is a, c, g, or t
  modified_base (547)..(547): a, c, t, g, unknown or other
  misc_feature (547)..(547): n is a, c, g, or t
tcagacatacgcgtcacgaccggtgctcgatttagtacacacacttagggattgggggaggaactgctcagttaggacccagacggaaccatggaagccccagcgcagcttctcttcctcctgctactctggctcccagtttcagataccactggagaaatagtgatgacgcagtctccagccaccctgtctgtgtctccgaggggaaangccacactctcctgcagggccagtcagagtgtagcagcagcttagcctggtacagcagaactggccaggctccaggctcctcatctatggtgcatcgtacggaggccactggtactcccccgagcaggtcaggtggcnggtgggtcgtgggacagtagtcactctcacatcagacacgcctgacctagttcgtagtaaagttactttttgggacgtttaagttttaacttacgttaggtcctaagtctaaacttaattaaataaccgttcggtcccttaacgttaccgttaggtttcgggacccgtaagggggaccttaaggttcgttacgggtaanaacgttaacgaaaaccggtagttcggttaacgggctaaccgg

SEQ ID NO: 308854 - DNA, 627 bp, Homo sapiens
  misc_feature: GZ8MTXP01AQ9RG.22.59.F04.1.454.CMB.2.raw
  modified_base (210)..(210): a, c, t, g, unknown or other
  misc_feature (210)..(210): n is a, c, g, or t
tcagacatacgcgtcacgaccggtgctcgatttagtacacacacttagggattgggggaggaactgctcagttaggacccagacggaaccatggaagccccagcgcagcttctcttcctcctgctactctggctcccagtttcagataccactggagaaatagtgatgacgcagtctccagccaccctgtctgtgtctccgaggggaaangccacactctcctgcaggccagtcagagtgtagcagcagtctagcctggtaccagcagaacctggaccaggcctccgaggtcctcctcatctagtggtgctatcgtacggacgggcctagtggtactcccccgaggtccgtaggttcaggtcggacgtaagggttggggtaccgtaggggactaggtacgttcacgtcctcaccatcgacgcacgcctggctacgtacgtagtaagttacgttttcggtacgtttaaggttttacttacgttcgttacgacgtacttaaacttaagtaacgtaaccgttcggacccttaaccggtaacgttacggtttacgggaccggtaacggggtaaccttaggttccgttagggaagtacgtaacgaaacggtacgttacggtcgaacgtaacg

SEQ ID NO: 308855 - DNA, 695 bp, Homo sapiens
  misc_feature: GZ8MTXP01DH32J.22.59.F04.1.454.CMB.2.raw
  modified_base (211)..(211): a, c, t, g, unknown or other
  misc_feature (211)..(211): n is a, c, g, or t
  modified_base (323)..(323): a, c, t, g, unknown or other
  misc_feature (323)..(323): n is a, c, g, or t
tcagacatacgcgtcacgaccggtgctcgatttagtacacacacttagggattggggggaggaactgctcagttaggacccagacggaaccatggaagccccagcgcagcttctcttcctcctgctactctggctcccagtttcagataccactggagaaatagtgatgacgcagtctccagccaccctgtctgtgtctcgaaggggaaancgccacactcctcctgcgaggccagtcaggagttgtagcagcagtcttagcctggtaccagacaacgaaacctcggaccacggcctccgaggcctcctcagttctagtggtncattcgacggacggacctacgtggtacctccccccgaggtccgtaggggtttcaggttgggaccgtaaggggtcggggtacgtacggggaacctagggtacgtttaccaccgttcctacaccctagtacaacgcgacgtccttggactacgttcgtaagtaaagtttcgttttacggggtacttttaaggttttaacttacgttacgttaccctaagtaaccttaaacttaaacttaaacgttaaccgtccggttaacccgttaaccgtttaacggttcggtttaccgggaccggtaaacgggggtaaccttagggttcgttagggaacgtaaacgtaaccggtaaaacgtcgttcggtaacgggctaaccg

SEQ ID NO: 308856 - DNA, 581 bp, Homo sapiens
  misc_feature: GZ8MTXP01CM4LZ.22.59.F04.1.454.CMB.2.raw
  modified_base (208)..(208): a, c, t, g, unknown or other
  misc_feature (208)..(208): n is a, c, g, or t
  modified_base (213)..(213): a, c, t, g, unknown or other
  misc_feature (213)..(213): n is a, c, g, or t
  modified_base (241)..(241): a, c, t, g, unknown or other
  misc_feature (241)..(241): n is a, c, g, or t
  modified_base (291)..(291): a, c, t, g, unknown or other
  misc_feature (291)..(291): n is a, c, g, or t
  modified_base (301)..(301): a, c, t, g, unknown or other
  misc_feature (301)..(301): n is a, c, g, or t
  modified_base (312)..(312): a, c, t, g, unknown or other
  misc_feature (312)..(312): n is a, c, g, or t
  modified_base (324)..(324): a, c, t, g, unknown or other
  misc_feature (324)..(324): n is a, c, g, or t
tcagacatacgcgtcacgaccggtgctcgatttagtacacacacttagggattgggggaggaactgctcagttaggacccagacggaaccatggaagccccagcgcagcttctcttcctcctgctactctggctcccagtttcagataccactggagaaatagtgatgacgcagtctccagccaccctgtctgtgtctcgaggggaangccanactctctgcagggccagtcagagtgtancagcagcttagcctggtaccagcaagaacctggccaggctccagctcctnatctatggtnctatcgacggnggccagtgtacnccccgagtcgtaggttcaggtcggctgggtcgggtcgtaggggactaggtacttcactctacacactcacgcacgtctgactagtacgtagtaagttagtttcggtacgttaagtttacttacgtacgtacgtacgtactaactaataactacgtacgtaccgttaacgttacgttacggtttacggacggtaacgggtacgttaacgttcgttacggaagtaacgtaacgtaaacgtacgttaggtcggttcgtcg

SEQ ID NO: 308857 - DNA, 648 bp, Homo sapiens
  misc_feature: GZ8MTXP01A7P36.22.59.F04.1.454.CMB.2.raw
  modified_base (302)..(302): a, c, t, g, unknown or other
  misc_feature (302)..(302): n is a, c, g, or t
  modified_base (646)..(646): a, c, t, g, unknown or other
  misc_feature (646)..(646): n is a, c, g, or t
tcagacatacgcgtcacgaccggtgctcgatttagtacacacacttagggattgggggaggaactgctcagttaggacccagacggaaccatggaagccccagcgcagcttctcttcctcctgctactctggctcccagtttcagataccactggagaaatagtgatgacgcagtctccagccaccctgtctgtgtctcgaaggggaaagagccacactctcctgcagggccagtcagagtgtagcagcagcttagcctggaccagcagaaacctggaccaggcctacccgaggcctccctnatctagtggtgcatcgtaacggacgggcctaacgtggtactcccccccgaagtccgtaaggggtttccagggttcgggcgtaagggttcgggggttccgtaggggggtaaacctagggtaacgtttcctaaaccttcccttaccgaacccaactcgaacggcctacggccccttaggccgtaagttccgtaaggtaacggttattttgggacttaggttttacttacgtgtacagctaactaataataaccgtcggtacccttcggtaacttagggtttcgggcccgtaaggggacccttaaaggccttaggaagactaacgaaacgtacgttgtaacggttcncg

SEQ ID NO: 308858 - DNA, 568 bp, Homo sapiens
  misc_feature: GZ8MTXP01CJLR6.22.59.F04.1.454.CMB.2.raw
  modified_base (210)..(210): a, c, t, g, unknown or other
  misc_feature (210)..(210): n is a, c, g, or t
tcagacatacgcgtcacgaccggtgctcgatttagtacacacacttagggattgggggaggaactgctcagttaggacccagacggaaccatggaagccccagcgcagcttctcttcctcctgctactctggctcccagtttcagataccactggagaaatagtgatgacgcagtctccagccaccctgtctgtgtctccgaggggaaangccacactctcctgcagggccagtcagagtgtagcagcagcttagcctggtacagcagaaacctggaccaggcctcccgaggcctcctcatctatgtgcatctacgaggccacgtgtactcccccagcgtaggtcagtggctggtgggtctagggacagtacgttcactctcacatcagcagcctgctagtcgtagaagttatttgggcttaagtttattacgttgtacacgtactaacttaataataacgtcggtcccttaacgttaacgttacggttttcggccgtaaacgggggtaccttaacggcgttacgggtaagacgtaacgaaacgtaccgttaggtcgggcttaacggg

SEQ ID NO: 308859 - DNA, 629 bp, Homo sapiens
  misc_feature: GZ8MTXP01BB0XA.22.59.F04.1.454.CMB.2.raw
  modified_base (209)..(209): a, c, t, g, unknown or other
  misc_feature (209)..(209): n is a, c, g, or t
  modified_base (456)..(456): a, c, t, g, unknown or other
  misc_feature (456)..(456): n is a, c, g, or t
tcagacatacgcgtcacgaccggtgctcgatttagtacacacacttagggattgggggaggaactgctcagttaggacccagacggaaccatggaagccccagcgcagcttctcttcctcctgctactctggctcccagtttcagataccactggagaaatagtgatgacgcagtctccagccaccctgtctgtgtctccaggggaaangccacactctcctgcagggccagtcagagtgttagcagcagcttagcctggtaccagcaagaacctggccaggcctccgaggcctcctcattctagtggtgctagtccgtacggacggcccacgtggtactccccccgagtccgtaggttcgagtcgggctgggtggggtccgtaggggacctaggtacgtttcaaccttctaccgacctacgtcagccgagccctagcgagttctaggtaaagttnttttcgggacttaaggttttacttacgttgttacgacgtactaactaacttaaacttaaccgtcggtccccttaacggtaacttacgggtttacgggaccgtaacggggacccttaaggttcgttagggaacgtaacgtaaccgtaaaacggtacgttaggtcggcgtaaccg

SEQ ID NO: 308860 - DNA, 598 bp, Homo sapiens
  misc_feature: GZ8MTXP01DKQ5C.22.59.F04.1.454.CMB.2.raw
  modified_base (211)..(211): a, c, t, g, unknown or other
  misc_feature (211)..(211): n is a, c, g, or t
  modified_base (295)..(295): a, c, t, g, unknown or other
  misc_feature (295)..(295): n is a, c, g, or t
  modified_base (304)..(304): a, c, t, g, unknown or other
  misc_feature (304)..(304): n is a, c, g, or t
  modified_base (351)..(351): a, c, t, g, unknown or other
  misc_feature (351)..(351): n is a, c, g, or t
tcagacatacgcgtcacgaccggtgctcgatttagtacacacacttagggattgggggaggaactgctcagttaggacccagacggaaccatggaagccccagcgcagcttctcttcctcctgctactctggctcccagtttcagataccactggagaaatagtgatgacgcagtctccagccaccctgtctgtgtctccgaggggaaagngccacactctcctgcagggccagtcagagtgtagcagcagcttagcctggaccagcagaacctggccaggcctccaggctcctnatctatgtncatctacggaggccagtggtactcccccgagcctaggtcaggtggcnggtgggtctggggacaggtgttcactctcaccatcagcacgcctgcgtagtcgtagtaagttatttgggtcttaagtttacttacgtgtacagtactaactaattaaacgtaacgtcgtcccgttaaccggttaacgttacgggttttacgggacccggtaacgggggtaacccgttaacggttcggttagggtaacgtaaacgtaaccgtaaaacggtaccgttaggtaacgggttccgtaaccgg

SEQ ID NO: 308861 - DNA, 837 bp, Homo sapiens
  misc_feature: GZ8MTXP01C2N8J.22.59.F04.1.454.CMB.2.raw
  modified_base (211)..(211): a, c, t, g, unknown or other
  misc_feature (211)..(211): n is a, c, g, or t
tcagacatacgcgtcacgaccggtgctcgatttagtacacacacttagggattgggggaggaactgctcagttaggacccagacggaaccatggaagccccagcgcagcttctcttcctcctgctactctggctcccagtttcagataccactggagaaatagtgatgacgcagtctccagccaccctgtctgtgtctccgaaggggaaancgccacactctctgcagggccagtcagtagtgtagcagcagtcttagccgtaggtaccagacaacgaaaccgtggacctacggcccctaccgacggtccctaccgtcaacgttccttagtcgggtcacctacgtttaccgaaccggggcggtaccccgtaacgttcgggtaccctaccccccgaacggttccgtaaggggtttacccgaaggggttcgggtaaccgtcgggggtttacgggggttccgggttaaacgggggaaacccgttaaggggtaaccgttttcccgaaacccttccgttacccaacccggttactaccgaccggaccgaacgtaccgttcggaaccgttacggttaaccgttaaggttaaacgtttacgttttagggtaaccgtttttaaacggttttaatttaacgttacggttaaccgtaacgtaaccttaaaacctttaaagttaaaccttaacccgttacggttaaccccgtttaacggttaaccgtttacggggttttaacccgggaacccgggtaaacggggtaccgttaaaacggttccggttaagggtaaaccgtaacgttaaccgtaaaacggtacggttacggtaaccggttcgttaacccg

SEQ ID NO: 308862 - DNA, 623 bp, Homo sapiens
  misc_feature: GZ8MTXP01AU5J0.22.59.F04.1.454.CMB.2.raw
  modified_base (210)..(210): a, c, t, g, unknown or other
  misc_feature (210)..(210): n is a, c, g, or t
tcagacatacgcgtcacgaccggtgctcgatttagtacacacacttagggattgggggaggaactgctcagttaggacccagacggaaccatggaagccccagcgcagcttctcttcctcctgctactctggctcccagtttcagataccactggagaaatagtgatgacgcagtctccagccaccctgtctgtgtctccgaggggaaancgccacactctcctgcagggccagtcagagtgttagcagcagcttagcctaggtaccaggcaagaaacctggacccaggcctcccgaggcctccctacatctagtggtcgctatcgtacggaggtccctacgtggtactccccccgagtccgtaggttcaggtggccgtggtcggggtccgtaggggaccaggttacgttacaccgttctacaccatcgaagcacgccctgcctaagttcaggtaaagtagttttggggacttaagtttataccgtgtccagtactaacttaaataacgttaacgtccggtacctaacggttaacgttcgggttttacggaccggtaaggggaacccttaggttcgttagggaagtacgtaacgaaaaccgtgttcggtaacggttctaacgg

SEQ ID NO: 308863 - DNA, 676 bp, Homo sapiens
  misc_feature: GZ8MTXP01B574V.22.59.F04.1.454.CMB.2.raw
  modified_base (210)..(210): a, c, t, g, unknown or other
  misc_feature (210)..(210): n is a, c, g, or t
  modified_base (315)..(315): a, c, t, g, unknown or other
  misc_feature (315)..(315): n is a, c, g, or t
tcagacatacgcgtcacgaccggtgctcgatttagtacacacacttagggattgggggaggaactgctcagttaggacccagacggaaccatggaagccccagcgcagcttctcttcctcctgctactctggctcccagtttcagataccactggagaaatagtgatgacgcagtctccagccaccctgtctgtgtctccgaggggaaangccacactctctgcagggccagtcagtgtgtagcagcagcttagcctggtaccagacaagaaaccgtggaccaggcctcccgaggcctcctcattctagtggtcnctatccgtacggacggcctacgttcggtactccccccgaggtccgtaaggtttccgaggtcgggcgtaagggttggggtaccgtggggacagggtacgttcaccgttctacgaccatcacgcacgtcctgacgtacgtacgtagtaagttcgttttacggacgtttaggttttacttacgttacgtacgtaacgtaccttaaacttaacttaaacgttaccgttaccggtcccgtttaacccggttacggtttacgggttttaccgggacccgggtaaacgggggtaacccttaagggttccgttagggtaacgtaacgtaaccggtaaaacggtacgttcgggtaacggttccgtaacgg

SEQ ID NO: 308864 - DNA, 602 bp, Homo sapiens
  misc_feature: GZ8MTXP01EMYQB.22.59.F04.1.454.CMB.2.raw
  modified_base (209)..(209): a, c, t, g, unknown or other
  misc_feature (209)..(209): n is a, c, g, or t
  modified_base (406)..(406): a, c, t, g, unknown or other
  misc_feature (406)..(406): n is a, c, g, or t
tcagacatacgcgtcacgaccggtgctcgatttagtacacacacttagggattgggggaggaactgctcagttaggacccagacggaaccatggaagccccagcgcagcttctcttcctcctgctactctggctcccagtttcagataccactggagaaatagtgatgacgcagtctccagccaccctgtctgtgtctccgaggggaanagccacactctcctgcagggccagtcagagtgtagcagcagctagcctggtaccagcagaaacctggaccaggcctcccgaggtcctcctcatctagtggtgactatctacggcgggacctagtggtactcccccgagccgtaggttccaggtcggctgggtgggtcgtgggactaggtacgttcactctcacctancagcacgcctggccagtcgtagtaagttacgttttgggactttaaggttttacttaccgtagtactacgtactaaaccttaataacttaaaccgttcgggtacccttaaccgttacgttaggttttaccggaccggtaggggtaacccaaggttcgttaggaagtactaacgaaaccgtagttggtcgcgtaaccg

SEQ ID NO: 308865 - DNA, 645 bp, Homo sapiens
  misc_feature: GZ8MTXP01DPILS.22.59.F04.1.454.CMB.2.raw
  modified_base (210)..(210): a, c, t, g, unknown or other
  misc_feature (210)..(210): n is a, c, g, or t
  modified_base (215)..(215): a, c, t, g, unknown or other
  misc_feature (215)..(215): n is a, c, g, or t
  modified_base (312)..(312): a, c, t, g, unknown or other
  misc_feature (312)..(312): n is a, c, g, or t
tcagacatacgcgtcacgaccggtgctcgatttagtacacacacttagggattgggggaggaactgctcagttaggacccagacggaaccatggaagccccagcgcagcttctcttcctcctgctactctggctcccagtttcagataccactggagaaatagtgatgacgcagtctccagccaccctgtctgtgtctccgaggggaaangccanactctcctgcgagggccagtcagagtgttagcagcagtcttagcctaggtaccagacagaaacctggccaggcctccgaggcctcctcatctagtgngcatcgtacgacggcctagtgtactcccccgaggtcctaggtcgaggtcgggcgtggtgggtcgtacgggactagtacgttcacgtctacaccagtcagacacgcctgcctagtacgtaggtaaagttgttttacggggtactttaaggtttttaactttaccgttagttaccgtaggtaactaaacttaaacttaaaccgtaaacgttccggttacccgttaaccggttaacgtttacgggttttacggacccgggtaaacggggtacccgttaaaacggttcggttaaggtaagaacgttaacgaaacgtacgttggtaacgttctaaccg

SEQ ID NO: 308866 - DNA, 627 bp, Homo sapiens
  misc_feature: GZ8MTXP01AQED1.22.59.F04.1.454.CMB.2.raw
  modified_base (210)..(210): a, c, t, g, unknown or other
  misc_feature (210)..(210): n is a, c, g, or t
  modified_base (300)..(300): a, c, t, g, unknown or other
  misc_feature (300)..(300): n is a, c, g, or t
  modified_base (312)..(312): a, c, t, g, unknown or other
  misc_feature (312)..(312): n is a, c, g, or t
  modified_base (433)..(433): a, c, t, g, unknown or other
  misc_feature (433)..(433): n is a, c, g, or t
tcagacatacgcgtcacgaccggtgctcgatttagtacacacacttagggattgggggaggaactgctcagttaggacccagacggaaccatggaagccccagcgcagcttctcttcctcctgctactctggctcccagtttcagataccactggagaaatagtgatgacgcagtctccagccaccctgtctgtgtctccgaggggaaangccacactctcctgcagggccagtcagagtgtagcagcagtcttagcctggtaccagcaagaacctggccaggcctcccgaggcctcctnatctagtggtcnctagtccgtaacggacgggtaccctacgtcggtacctccccccgaggtccgtaggttaccaggttcgggactaagggtggggtacctagggggactaggtacgttcaactcctacacctancacgcacgccctgaccgtaggttctaaggtaacgttagttttacggggtacttaggtttacttacgtgtactagtactaacttaataaactacgtccggtccttaaccgttaacgttaggtttacggaccggtagggtaacccagttcgttaggaacgtacgtaacgaaacggtacgttacggtcggctaaccg

SEQ ID NO: 308867 - DNA, 675 bp, Homo sapiens
  misc_feature: GZ8MTXP01CNBH3.22.59.F04.1.454.CMB.2.raw
  modified_base (210)..(210): a, c, t, g, unknown or other
  misc_feature (210)..(210): n is a, c, g, or t
  modified_base (244)..(244): a, c, t, g, unknown or other
  misc_feature (244)..(244): n is a, c, g, or t
  modified_base (310)..(310): a, c, t, g, unknown or other
  misc_feature (310)..(310): n is a, c, g, or t
  modified_base (361)..(361): a, c, t, g, unknown or other
  misc_feature (361)..(361): n is a, c, g, or t
  modified_base (377)..(377): a, c, t, g, unknown or other
  misc_feature (377)..(377): n is a, c, g, or t
  modified_base (391)..(391): a, c, t, g, unknown or other
  misc_feature (391)..(391): n is a, c, g, or t
tcagacatacgcgtcacgaccggtgctcgatttagtacacacacttagggattgggggaggaactgctcagttaggacccagacggaaccatggaagccccagcgcagcttctcttcctcctgctactctggctcccagtttcagataccactggagaaatagtgatgacgcagtctccagccaccctgtctgtgtctccgaggggaaangccacactctctgcagggccagtcagagtgtagnagcagcttagcctggtaccagcaacgaaacctggaccaggcctccgagcctcctacatctatggtncatcgtacggaggcccagtcggactccccccagcgtaggttcaggtggcgnggtgggtcgtgggacngtacgttcacttcncacatcagcgacgcctgccagtacgtagtagttagttttcggggtactttaaggttttacttaacgttcggttacctacgtaccgttaaacttaacgttaaaacgttaccggttaccgggtaccccgtttaaccggttaaaccgtttacggggtttttaccggggacccggttaaacggggggtaacccgttaacgggttccgggttaacggggtaaccggtaaacggttaaacccgaaaaacggggttaccgttacgggtcgggttaacccgtttaacccggg

SEQ ID NO: 308868 - DNA, 567 bp, Homo sapiens
  misc_feature: GZ8MTXP01EVQ47.22.59.F04.1.454.CMB.2.raw
  modified_base (195)..(195): a, c, t, g, unknown or other
  misc_feature (195)..(195): n is a, c, g, or t
  modified_base (209)..(209): a, c, t, g, unknown or other
  misc_feature (209)..(209): n is a, c, g, or t
  modified_base (296)..(296): a, c, t, g, unknown or other
  misc_feature (296)..(296): n is a, c, g, or t
  modified_base (307)..(307): a, c, t, g, unknown or other
  misc_feature (307)..(307): n is a, c, g, or t
  modified_base (364)..(364): a, c, t, g, unknown or other
  misc_feature (364)..(364): n is a, c, g, or t
  modified_base (402)..(402): a, c, t, g, unknown or other
  misc_feature (402)..(402): n is a, c, g, or t
  modified_base (561)..(561): a, c, t, g, unknown or other
  misc_feature (561)..(561): n is a, c, g, or t
tcagacatacgcgtcacgaccggtgctcgatttagtacacacacttagggattgggggaggaactgctcagttaggacccagacggaaccatggaagccccagcgcagcttctcttcctcctgctactctggctcccagtttcagataccactggagaaatagtgatgacgcagtctccagccaccctgtctgtntctccgaggggaangccacactctcctgcaggccagtcagagtgttagcagcagcttagcctggtaccagcaagaacctggccaggcctcccaggctcctnatctagtggtncatcgtacggaggtcccagttcggtactccccccgaggccgtaaggttcaggtggcngggttcggggtcaggggactaggtagttcactctcacntcagcacgctgctagtctagtagttatttcggactttaggtttattacgtgttacgatactaacgtataaacgtactcggtccttaaccgttagttcggtttcggaccgtaggggtaaccaggttcgttagggaatagtaacgaaagtcgttgtaacgngtaacg

SEQ ID NO: 308869 - DNA, 761 bp, Homo sapiens
  misc_feature: GZ8MTXP01BVG0A.22.59.F04.1.454.CMB.2.raw
  modified_base (210)..(210): a, c, t, g, unknown or other
  misc_feature (210)..(210): n is a, c, g, or t
tcagacatacgcgtcacgaccggtgctcgatttagtacacacacttagggattgggggaggaactgctcagttaggacccagacggaaccatggaagccccagcgcagcttctcttcctcctgctactctggctcccagtttcagataccactggagaaatagtgatgacgcagtctccagccaccctgtctgtgtctccgaggggaaangccacactctcctgcagggccagtcagtagtgttagcagcagtctagccgtggtaccagacaagaaccgtggaccacggcctacccgaggtccctacccgtcaacttccgtaagttcggggtacaccgtacgtttaccggtaacgggaccggggtacccctaacggttcgggttaaccttacccccccgaggtaccgtaagggtttccgaaggttcgggacgtggggttcggggtaccgtagggggactaggtacgtttccacgtcgtaccacctacgtacgacgtcgacgcctacgacgtagtactaggtaagtttacgtttacgggtacgtttaagttttaacgttacgttacgttaccgtacggtacttaaacttaacttaaaccgttaccggttacggtaccccgtttaaccgttaaccggttacgggttttaccgggaacccggtaacgggggtaaaccgttaaacggttccgggttaaagggtaacggtaacgttaaccggtaaaaccggtaggttacgggttaaccgggttaaccttaaccggg

SEQ ID NO: 308870 - DNA, 727 bp, Homo sapiens
  misc_feature: GZ8MTXP01DQT8U.22.59.F04.1.454.CMB.2.raw
  modified_base (210)..(210): a, c, t, g, unknown or other
  misc_feature (210)..(210): n is a, c, g, or t
tcagacatacgcgtcacgaccggtgctcgatttagtacacacacttagggattggggggaggaactgctcagttaggacccagacggaaccatggaagccccagcgcagcttctcttcctcctgctactctggctcccagtttcagataccactggagaaatagtgatgacgcagtctccagccaccctgtctgtgtctcgaggggaaangccacactctctgcagggccagtcagagtgtagcagcagcttagcctggtaccagacagaaacctggaccaggcctcccgaggcctcctcatctagtggtgctagtcgtacggacgggcctacgtggtacctcccccgaggtccgtaggttccaggttcgggactggggtcgggtacgtacggggactagggtacgtttcacgttccgtacaacctacgtaccgaacgtccgaacggtccccttaaggcctaacggttaccgttaagggttaaaggtttacgtttttacgggggtaaccttttaaggttttttaactttaccgttacggttaacctaacggttaccttaaaccgtttaaattaaaacgttaaccgttaccgggttacccctttaaccggttaacggtttacgggttttaccggacccggggtaacggggtaaccccgttaagggttccggttaagggtaacgtaaacgttaaccgaaaaccggtagttcggtaacggttccgtaacg

SEQ ID NO: 308871 - DNA, 661 bp, Homo sapiens
  misc_feature: GZ8MTXP01CVWU3.22.59.F04.1.454.CMB.2.raw
  modified_base (251)..(251): a, c, t, g, unknown or other
  misc_feature (251)..(251): n is a, c, g, or t
  modified_base (285)..(285): a, c, t, g, unknown or other
  misc_feature (285)..(285): n is a, c, g, or t
  modified_base (301)..(301): a, c, t, g, unknown or other
  misc_feature (301)..(301): n is a, c, g, or t
tcagacatacgcgtcacgaccggtgctcgatttagtacacacacttagggattgggggaggaactgctcagttaggacccagacggaaccatggaagccccagcgcagcttctcttcctcctgctactctggctcccagtttcagataccactggagaaatagtgatgacgcagtctccagccaccctgtctgtgtctccgaaggggaaagagccacactctcctgcagggccagtcagagtgtagcagcngcttagcctgtacagcagaacctgccagcctccngctctcatctatggtncatcgtacggaggcccaacgtggtacctcccccgagccgaggtttccaggtcgggacgtaagggtgggtccgtaggggaactggtaacgttcacgtactaccactactcacgcacgcctgactagtcgtagtaaagttattttacgggtacgtttaaggttttactttaacgttacgttacctaacggtactaaaccttaaacgttaaaccttaaaccggttccggtaccccgtttaacccggttaaccgtttacgggtttttaccggacccgggttaaacggggaacccgttaacggttccgttaacgggtaagtaacgtaacgtaaaaccggtacgttacggtcgttaacgtaacccg

SEQ ID NO: 308872 - DNA, 687 bp, Homo sapiens
  misc_feature: GZ8MTXP01BFJXE.22.59.F04.1.454.CMB.2.raw
  modified_base (209)..(209): a, c, t, g, unknown or other
  misc_feature (209)..(209): n is a, c, g, or t
  modified_base (310)..(310): a, c, t, g, unknown or other
  misc_feature (310)..(310): n is a, c, g, or t
tcagacatacgcgtcacgaccggtgctcgatttagtacacacacttagggattgggggaggaactgctcagttaggacccagacggaaccatggaagccccagcgcagcttctcttcctcctgctactctggctcccagtttcagataccactggagaaatagtgatgacgcagtctccagccaccctgtctgtgtctccgaggggaangccacactctcctgcagggccagtcagagtgttagcagcagcttagcctaggaccagacagaacctggccaggcctcccgaggcctcctcatctagtggtnctatcgtacggaggcctagtcggtactccccgaggccgtaggtcaggtcgggacgtcggtgggtacgtggggacaggtacgttcaccgttctcctaccatccgacggcaacggtcccttaggcctaagtccgtaagtaaacgtttgttttacgggtacgtttaaggtttttaattaccgttcgtaccgtagttacctaaactttaaacgtaaactttaaacccgttcgggacccccgtttaaccggttaacgtttaacgggggttttcccgggaaaccgggaaaccggggtaacccttaaagggttcggttaaacggggcggtaaaactaacccggtaaaacggtacggttacgggttaaccggttcccggttaacg

SEQ ID NO: 308873 - DNA, 838 bp, Homo sapiens
  misc_feature: GZ8MTXP01C8XN3.22.59.F04.1.454.CMB.2.raw
  modified_base (212)..(212): a, c, t, g, unknown or other
  misc_feature (212)..(212): n is a, c, g, or t
tcagacatacgcgtcacgaccggtgctcgatttagtacacacacttagggattgggggaggaactgctcagttaggacccagacggaaccatggaagccccagcgcagcttctcttcctcctgctactctggctcccagtttcagataccactggagaaatagtgatgacgcagtctccagcccaccctgtctgtgtctccgaaggggaaangccacactctcctgcgagggccagtcaggtagtgtagcagcagtcttagcctaggtaccagacaagtaaccgtggacccaggccctacccgacggtccctcctcattcgtagtggtacgctaacgttccgtaaccgggacgggtccctaacggtcggtacctaccccccccggacggtacccgttagggtttcccgaaggttcgggacgtaacgggggttcgggggtaccgttacgggggaacctaacggggttaccgtttaccgacccgtttaccctacccgtaaaccctacgttacccggaaacggtcccgaacgggttacccctggtaccgttaacgggttacctaaacgggttaaagttttaccgtttttacggggttaccgttttaaaggttttttaacctttaaccgtttacggttacctaaacggtacctttaaaacgttaaaatttaaaccgttaaaccgttccgggttaaccccgtttaaccggttaacggttttacgggttttacccgggaaccgggtaaaccgggggtaacccttaaagggccggttaaagggaagttaaaccggtaaaccgtaaaacggttaccgggttaggttaaccgggttccgttaaccgg

SEQ ID NO: 308874 - DNA, 746 bp, Homo sapiens
  misc_feature: GZ8MTXP01DLMXJ.22.59.F04.1.454.CMB.2.raw
  modified_base (308)..(308): a, c, t, g, unknown or other
  misc_feature (308)..(308): n is a, c, g, or t
tcagacatacgcgtcacgaccggtgctcgatttagtacacacacttagggattggggggaggaactgctcagttaggacccagacggaaccatggaagccccagcgcagcttctcttcctcctgctactctggctcccagtttcagataccactggagaaatagtgatgacgcagtctccagccaccctgtctgtgtctccgaggggaagagccacactctctgcaggccagtcagagtgtagcagcagtctagcctggtaccagacaagaaacctggccaggcctccaggcctcctcatctagtggnctatcgtacggacgggcctacgtggtacctcccccccgaggtccgtagggttccaagggtcgggacgtaagggggttcgggggtaccggttaggggggaactaggggtacgttttccaacccttcccgtacctaacccgtaacgttaccgaacgtaccgaacggtcccgttacggaccgtacggttaccgtaaggtaaaggttacgtttttagggtaccgtttaaaggtttttaactttaaccgttacggttactaacggtaccttaaaccgttaaattaaaacgttaacccggttaccgggtccccgttaacccggtttaacggtttacgggttttaccgggaacccgggtaaacgggggtaacccgttaaacgggttcgttagggtaacgtaaacgtaaccgtaaaaccggtacggttacgggtcggccgtaaccg

SEQ ID NO: 308875 - DNA, 648 bp, Homo sapiens
  misc_feature: GZ8MTXP01DPDG4.22.59.F04.1.454.CMB.2.raw
  modified_base (207)..(207): a, c, t, g, unknown or other
  misc_feature (207)..(207): n is a, c, g, or t
  modified_base (213)..(213): a, c, t, g, unknown or other
  misc_feature (213)..(213): n is a, c, g, or t
  modified_base (312)..(312): a, c, t, g, unknown or other
  misc_feature (312)..(312): n is a, c, g, or t
  modified_base (326)..(326): a, c, t, g, unknown or other
  misc_feature (326)..(326): n is a, c, g, or t
  modified_base (353)..(353): a, c, t, g, unknown or other
  misc_feature (353)..(353): n is a, c, g, or t
  modified_base (416)..(416): a, c, t, g, unknown or other
  misc_feature (416)..(416): n is a, c, g, or t
  modified_base (422)..(422): a, c, t, g, unknown or other
  misc_feature (422)..(422): n is a, c, g, or t
tcagacatacgcgtcacgaccggtgctcgatttagtacacacacttagggattggggggaggaactgctcagttaggacccagacggaaccatggaagccccagcgcagcttctcttcctcctgctactctggctccagtttcagataccatggagaaatgtgatgacgcagtctccagccacctgtctgtgtctcgaaggggaaangccaanactctcctgcgagggccagtcagtgtgttagcagcagtcttagcctaggtacccagactaagaaaccgtgggaccaaggcctacccgaggcctaccgtnaatctagtcggtanctattcgacggaggtccagtcggtacncccccgaagcgtagttcagtcgggcctggtgggactagggacaggtacgttcactctacacancagacncgtcctgacagtactagtaagttagtttacggagttaagtttaactttacggtacgttaccgagtaccgtaaacgttaaattaacgtaaaccgttcggtacccggttaaccgtttaacggttacgggtttttacccgggaccggtaaaccggggtaccgaacgggttcgttaaccggggtaaagtaacgtaaccgtaaacggtacggttacggtcggttcgtaacg

SEQ ID NO: 308876 - DNA, 841 bp, Homo sapiens
  misc_feature: GZ8MTXP01BVP6P.22.59.F04.1.454.CMB.2.raw
  modified_base (210)..(210): a, c, t, g, unknown or other
  misc_feature (210)..(210): n is a, c, g, or t
tcagacatacgcgtcacgaccggtgctcgatttagtacacacacttagggattgggggaggaactgctcagttaggacccagacggaaccatggaagccccagcgcagcttctcttcctcctgctactctggctcccagtttcagataccactggagaaatagtgatgacgcagtctccagccaccctgtctgtgtctccgaggggaaangccacactctcctgcagggccagtcagagtgttagcagcagcttagcctggtaccagcacgaaacctggccagggcctacccaggcctcctcaatctagtggtgctatccgtacggacgggccctacgttcggtaaaccttcccccccgaacggtccgtaaggggttttaccgaaacgggttccggggacccgttaaggggggttcgggggttttacccgggaccggggggtaaaccctaaggggttacgggttttacccacccggtttaccgttacccgaacccgttaaccttaccgtaacggtacccgaaacggtcccccgtttagggaccccgttagggttaccgttaacggttaaacggttaacgttttttaggggggtaacccttttaaaggggtttttttaaaccgtttaacccctttaggggtttaacccaaacggttaccgttaaaccgtttaaaccttaaaacgtttaaaccggttaccgggttaccccgtttaacccggttaaccgtttacggggttttttacccgggaccggtaaacgggggttaaccccgaaggttaccggttagggaacgtacgtaaccgtaaaacggtaccgttaggtaacgggttaacgttaaccg

SEQ ID NO: 308877 - DNA, 661 bp, Homo sapiens
  misc_feature: GZ8MTXP01DK97F.22.59.F04.1.454.CMB.2.raw
  modified_base (207)..(207): a, c, t, g, unknown or other
  misc_feature (207)..(207): n is a, c, g, or t
  modified_base (212)..(212): a, c, t, g, unknown or other
  misc_feature (212)..(212): n is a, c, g, or t
tcagacatacgcgtcacgaccggtgctcgatttagtacacacacttagggattgggggaggaactgctcagttaggacccagacggaaccatggaagccccagcgcagcttctcttcctcctgctactctggctcccagtttcagataccactggagaaatagtgatgacgcagtctccagccacctgtctgtgtctcgaggggaangccanactctctgcagggccagtcagagtgtagcagcagtcttagcctaggtaccagcaagaaccgtggaccaggccctccgaggcctccgtcatcgtagtggtcgactacgtcgtaacggacgggccctagttcggtacctacccccccgaggtaccgtagggttccagggtcgggactaaggggtggggttacgtagggggaacagggtacgttccactctaccaccgtactacgacgacgacgtccgtacgtactacgttacgtaaggtaagttacgtttacggtacgtttaaggtttacttacgtcgtacgtacgtactaacttaaacttaaacgtaccgtcgtcccgttaaccgttaacgttacggtttacggaccggtaacgggtaccgttaacggttcgttaggtaagtaacgtaacgtaaacggtacgttcggtcgttcgtaaccg

SEQ ID NO: 308878 - DNA, 520 bp, Homo sapiens
  misc_feature: GZ8MTXP02IZAB1.22.59.F04.1.454.CMB.2.raw
  modified_base (307)..(307): a, c, t, g, unknown or other
  misc_feature (307)..(307): n is a, c, g, or t
  modified_base (351)..(351): a, c, t, g, unknown or other
  misc_feature (351)..(351): n is a, c, g, or t
tcagacatacgcgtcacgaccggtgctcgatttagtacacacacttagggattgggggaggaactgctcagttaggacccagacggaaccatggaagccccagcgcagcttctcttcctcctgctactctggctcccagtttcagataccactggagaaatagtgatgacgcagtctccagccaccctgtctgtgtctccaggggaaagagccacactctcctgcagggccagtcagagtgttagcagcagcttagcctggtaccagcagaacctggccaggctcccaggcctcctcatctatggtncatctacgagggccagtggtatcccccagccaggttcagtggcnggtgggtctggggacagagttcactctcaccatcagcagcctgcagtctagaagtatttgcttagtttattactgtcagtctactataataacgtggtacctacgtactagtttcggacgtacggggaccaagtcgtaggaagacgtacaaacgaactgtacggctacg

SEQ ID NO: 308879 - DNA, 537 bp, Homo sapiens
  misc_feature: GZ8MTXP02GSTSH.22.59.F04.1.454.CMB.2.raw
  modified_base (209)..(209): a, c, t, g, unknown or other
  misc_feature (209)..(209): n is a, c, g, or t
  modified_base (354)..(354): a, c, t, g, unknown or other
  misc_feature (354)..(354): n is a, c, g, or t
  modified_base (411)..(411): a, c, t, g, unknown or other
  misc_feature (411)..(411): n is a, c, g, or t
tcagacatacgcgtcacgaccggtgctcgatttagtacacacacttagggattgggggaggaactgctcagttaggacccagacggaaccatggaagccccagcgcagcttctcttcctcctgctactctggctcccagtttcagataccactggagaaatagtgatgacgcagtctccagccaccctgtctgtgtctccaggggaaangccacactctcctgcagggccagtcagagtgtagcagcagcttagcctggtaccagcagaaacctggccaggcctcccgaggcctcctcatctatggtgcatctacgagggccagtggtatcccccgagcctaggttcagtggcnggtgggtctggggacagagttcactctcaccatcagcacgcctgcagtctagaagtntttagcttagtttattacgttgtactagactactaattaaataacgtcggtcctacgtactaggtttcggaccgtaggggaccaagtcgtaggaacgtacgtacgaaacgtacgtgtacggactcg

SEQ ID NO: 308880 - DNA, 516 bp, Homo sapiens
  misc_feature: GZ8MTXP02JZZXG.22.59.F04.1.454.CMB.2.raw
  modified_base (209)..(209): a, c, t, g, unknown or other
  misc_feature (209)..(209): n is a, c, g, or t
  modified_base (352)..(352): a, c, t, g, unknown or other
  misc_feature (352)..(352): n is a, c, g, or t
  modified_base (382)..(382): a, c, t, g, unknown or other
  misc_feature (382)..(382): n is a, c, g, or t
  modified_base (405)..(405): a, c, t, g, unknown or other
  misc_feature (405)..(405): n is a, c, g, or t
tcagacatacgcgtcacgaccggtgctcgatttagtacacacacttagggattgggggaggaactgctcagttaggacccagacggaaccatggaagccccagcgcagcttctcttcctcctgctactctggctcccagtttcagataccactggagaaatagtgatgacgcagtctccagccaccctgtctgtgtctccaggggaaanagccacactctcctgcagggccagtcagagtgttagcagcagcttagctggtaccagcagaacctggccaggctcccaggcctcctcatctatggtgcatctacgagggccacgtggtactcccccagccaggttcagtggcngtgggtctggggacagagttcactctcacntcagcagcctgcagtctagagtntttgctagtttattactgtcagtcactataataacgtgacctccgtactagtttcggaccgtacggggaccaagcgtaggaagacgtacgaaacgtacgtgtacggactcg

SEQ ID NO: 308881 - DNA, 512 bp, Homo sapiens
  misc_feature: GZ8MTXP02ITTL8.22.59.F04.1.454.CMB.2.raw
  modified_base (433)..(433): a, c, t, g, unknown or other
  misc_feature (433)..(433): n is a, c, g, or t
tcagacatacgcgtcacgaccggtgctcgatttagtacacacacttagggattgggggaggaactgctcagttaggacccagacggaaccatggaagccccagcgcagcttctcttcctcctgctactctggctcccagtttcagataccactggagaaatagtgatgacgcagtctccagccaccctgtctgtgtctccaggtgaaagagccacactctcctgcagggccagtcagagtgttagcagcagcttagcctggtaccagcagaactggccaggctccagctcctcatctatggtgcatctacgaggccatgtactccagccaggttcagtgcagtggtctggacagtagttcactctcaccatcagcagctgcagtcagaactatttggactagtttactactgtcagtcaactaatactaaacnggtaccctcgtatacgtttcggaccgtacggggacctaagcgtaagggaacacgtaacgaaacgtacgtcggtacgtcg

SEQ ID NO: 308882 - DNA, 528 bp, Homo sapiens
  misc_feature: GZ8MTXP02GMZ15.22.59.F04.1.454.CMB.2.raw
  modified_base (350)..(350): a, c, t, g, unknown or other
  misc_feature (350)..(350): n is a, c, g, or t
  modified_base (407)..(407): a, c, t, g, unknown or other
  misc_feature (407)..(407): n is a, c, g, or t
tcagacatacgcgtcacgaccggtgctcgatttagtacacacacttagggattgggggaggaactgctcagttaggacccagacggaaccatggaagccccagcgcagcttctcttcctcctgctactctggctcccagtttcagataccactggagaaatagtgatgacgcagtctccagccaccctgtctgtgtctccaggggaaagagccacactctcctgcagggccagtcagagtgttagcagcagcttagcctggtaccagcagaaacctggccaggctcccaggctcctcatctatggtgcatctacgagggccatggtatcccccagccaggttcagtggcnggtgggtctggggacagagtttcactctcaccatcagcagcctgcagtctagaagtntttgcttagtttattactgtacagactaactaataaataactcggacctaccgtactaggtttcggaccgtacggggaccaaggcgtaggaagacgtacgaaaacgactacgtggactacg

SEQ ID NO: 308883 - DNA, 502 bp, Homo sapiens
  misc_feature: GZ8MTXP02I7HMN.22.59.F04.1.454.CMB.2.raw
  modified_base (352)..(352): a, c, t, g, unknown or other
  misc_feature (352)..(352): n is a, c, g, or t
tcagacatacgcgtcacgaccggtgctcgatttagtacacacacttagggattgggggaggaactgctcagttaggacccagacggaaccatggaagccccagcgcagcttctcttcctcctgctactctggctcccagtttcagataccactggagaaatagtgatgacgcagtctccagccaccctgtctgtgtctccaggggaaagagccacactctcctgcagggccagtcagagtgttagcagcagcttagcctggtaccagcagaacctggccaggctcccaggctcctcatctatggtgcatctacgagggccacgtggtactcccccagccaggttcagtggcnggtgggctgggacaggagtttcactctcaccatcagcagccctgcagtctgaaagattttgctagtttattactgtcagcatataataactgcctcgtactagtttgccaggggaccaagctaggaagatacaaaacggatagtaggctg

SEQ ID NO: 308884 - DNA, 562 bp, Homo sapiens
  misc_feature: GZ8MTXP02JL4TN.22.59.F04.1.454.CMB.2.raw
  modified_base (211)..(211): a, c, t, g, unknown or other
  misc_feature (211)..(211): n is a, c, g, or t
  modified_base (309)..(309): a, c, t, g, unknown or other
  misc_feature (309)..(309): n is a, c, g, or t
  modified_base (318)..(318): a, c, t, g, unknown or other
  misc_feature (318)..(318): n is a, c, g, or t
tcagacatacgcgtcacgaccggtgctcgatttagtacacacacttagggattgggggaggaactgctcagttaggacccagacggaaccatggaagccccagcgcagcttctcttcctcctgctactctggctcccagtttcagataccactggagaaatagtgatgacgcagtctccagccaccctgtctgtgtctccgaggggaaagngccacactctcctgcagggccagtcagagtgttagcagcagcttagcctggtaccagcagaacctggccaggcctcccaggcctcctcatctatggtncatctacgnggccagtggtactcccccagcctaggttcaggtggctggtgggtctggggacaggtacgttcactctcaccatcagcacgcctgcgtagtcgtagtaagttagttttgacttagtttattacgttgtactagtactactaataataacgtcgtaccttaccgtacgttacgtttcggaccgtacggggacctaacggtacgtaggaacgtacgtaacgaaaacgtacgtaggtacggtactacg

SEQ ID NO: 308885 - DNA, 519 bp, Homo sapiens
  misc_feature: GZ8MTXP02JGVZ5.22.59.F04.1.454.CMB.2.raw
  modified_base (209)..(209): a, c, t, g, unknown or other
  misc_feature (209)..(209): n is a, c, g, or t
  modified_base (300)..(300): a, c, t, g, unknown or other
  misc_feature (300)..(300): n is a, c, g, or t
  modified_base (304)..(304): a, c, t, g, unknown or other
  misc_feature (304)..(304): n is a, c, g, or t
  modified_base (350)..(350): a, c, t, g, unknown or other
  misc_feature (350)..(350): n is a, c, g, or t
  modified_base (368)..(368): a, c, t, g, unknown or other
  misc_feature (368)..(368): n is a, c, g, or t
  modified_base (405)..(405): a, c, t, g, unknown or other
  misc_feature (405)..(405): n is a, c, g, or t
tcagacatacgcgtcacgaccggtgctcgatttagtacacacacttagggattgggggaggaactgctcagttaggacccagacggaaccatggaagccccagcgcagcttctcttcctcctgctactctggctcccagtttcagataccactggagaaatagtgatgacgcagtctccagccaccctgtctgtgtctccaggggaaangccacactctcctgcagggccagtcagagtgtagcagcagcttagcctggtaccagcagaacctggccaggctcccaggctcctcatctanggtncatctacgagggccagtggtactcccccagcccaggttcagtggcngtggggtctggggacagngttcactctcaccatcagcagcctgcagtctgaagtntttgctagtttattactgtcagtcactataatactggtacctacgtactaggtttcggaccgacggggtaccaaggcgtaggaagactacgaaacgtacgtagtacggcgtacg

SEQ ID NO: 308886 - DNA, 561 bp, Homo sapiens
  misc_feature: GZ8MTXP02HLKTL.22.59.F04.1.454.CMB.2.raw
  modified_base (209)..(209): a, c, t, g, unknown or other
  misc_feature (209)..(209): n is a, c, g, or t
  modified_base (361)..(361): a, c, t, g, unknown or other
  misc_feature (361)..(361): n is a, c, g, or t
  modified_base (420)..(420): a, c, t, g, unknown or other
  misc_feature (420)..(420): n is a, c, g, or t
tcagacatacgcgtcacgaccggtgctcgatttagtacacacacttagggattgggggaggaactgctcagttaggacccagacggaaccatggaagccccagcgcagcttctcttcctcctgctactctggctcccagtttcagataccactggagaaatagtgatgacgcagtctccagccaccctgtctgtgtctccaggggaaanagccacactctcctgcagggccagtcagagtgttagcagcagcttagcctggtaccagcagaaacctggccaggctcccgaggcctcctcatctatggtgctatcgtacgagggcccagtggtactccccccgagcctaggttcaggtggcnggtgggtctggggacagtacgttcactctccaccatcagcagcctgcagtctagaagtntttgcttagtttatactgtacagacctataataaactaacgtcggtacccttccgtaacgttacggtttcggaccggtaacgggggtacccaaaggtccgtagggaacgtactaacgaaaacgtacgtggtacggactacg

SEQ ID NO: 308887 - DNA, 548 bp, Homo sapiens
  misc_feature: GZ8MTXP02JM467.22.59.F04.1.454.CMB.2.raw
  modified_base (210)..(210): a, c, t, g, unknown or other
  misc_feature (210)..(210): n is a, c, g, or t
  modified_base (309)..(309): a, c, t, g, unknown or other
  misc_feature (309)..(309): n is a, c, g, or t
  modified_base (333)..(333): a, c, t, g, unknown or other
  misc_feature (333)..(333): n is a, c, g, or t
  modified_base (354)..(354): a, c, t, g, unknown or other
  misc_feature (354)..(354): n is a, c, g, or t
tcagacatacgcgtcacgaccggtgctcgatttagtacacacacttagggattgggggaggaactgctcagttaggacccagacggaaccatggaagccccagcgcagcttctcttcctcctgctactctggctcccagtttcagataccactggagaaatagtgatgacgcagtctccagccaccctgtctgtgtctccgaggggaaanagccacactctcctgcagggccagtcagagtgttagcagcagcttagcctggtaccagcagaacctggccaggctcccgaggcctcctcatctatggtncatctacggaggccacgtggtacnccccgagccaggttcagtgcnggtgggtctgggacagagttcactctcacatcagcacgcctgctagtctagaagtatttgactagttttattacgtgtacagtactaacttaataactaacgtcgtacccttaccgtacgtacggtttcggaccgaacggggtacctaaggtcgtagggaagtaacgtacgaaaacgtacgtgtacggactacg

SEQ ID NO: 308888 - DNA, 520 bp, Homo sapiens
  misc_feature: GZ8MTXP02JIZMU.22.59.F04.1.454.CMB.2.raw
  modified_base (209)..(209): a, c, t, g, unknown or other
  misc_feature (209)..(209): n is a, c, g, or t
  modified_base (305)..(305): a, c, t, g, unknown or other
  misc_feature (305)..(305): n is a, c, g, or t
  modified_base (326)..(326): a, c, t, g, unknown or other
  misc_feature (326)..(326): n is a, c, g, or t
  modified_base (350)..(350): a, c, t, g, unknown or other
  misc_feature (350)..(350): n is a, c, g, or t
tcagacatacgcgtcacgaccggtgctcgatttagtacacacacttagggattgggggaggaactgctcagttaggacccagacggaaccatggaagccccagcgcagcttctcttcctcctgctactctggctcccagtttcagataccactggagaaatagtgatgacgcagtctccagccaccctgtctgtgtctccaggggaaangccacactctcctgcagggccagtcagagtgttagcagcagcttagcctggtaccagcagaaacctggccaggctcccaggctctcatctatggtncatcacgagggccagtggtancccccgagccaggttcaggtggcnggtgggtctggggaccagagtttcactctcaccatcagcagccctgcagtctgaagtattttgacttagtttattacgtgtcagctactataataactggcccttacgtataggtttcggctacggggaccaagccgtaggaagatacgaaacgactaggtacggctcgg

SEQ ID NO: 308889 - DNA, 634 bp, Homo sapiens
  misc_feature: GZ8MTXP02IYR7V.22.59.F04.1.454.CMB.2.raw
  modified_base (210)..(210): a, c, t, g, unknown or other
  misc_feature (210)..(210): n is a, c, g, or t
tcagacatacgcgtcacgaccggtgctcgatttagtacacacacttagggattgggggaggaactgctcagttaggacccagacggaaccatggaagccccagcgcagcttctcttcctcctgctactctggctcccagtttcagataccactggagaaatagtgatgacgcagtctccagccaccctgtctgtgtctccgaggggaaangccacactctcctgcagggccagtcagagtgttagcagcagcttagcctggtaccagcagaaacctggccaggcctccccgaggcctcctcatctagtggtgcatcgtacggacgggccagtggtactcccccgagccctagggttccaggtcgggctggggttcgggtcgtggggaccaggtacgttcaccttctaccacctactcacgcacgtccctggacctaggtcgtaggtaaagttgtttttcgacgtttaagttttactttacgttgtactacggtaccttaattaaacttaacgttaacgtcggtaccctttacggtacgtttacgggtttacggaccggtaacgggggtaacctaacgggtcgtagggaacgtacgtaacgtaaaaaccggtcgttacggtcggtacgttaccgg

SEQ ID NO: 308890 - DNA, 543 bp, Homo sapiens
  misc_feature: GZ8MTXP02ICOG4.22.59.F04.1.454.CMB.2.raw
  modified_base (353)..(353): a, c, t, g, unknown or other
  misc_feature (353)..(353): n is a, c, g, or t
tcagacatacgcgtcacgaccggtgctcgatttagtacacacacttagggattgggggaggaactgctcagttaggacccagacggaaccatggaagccccagcgcagcttctcttcctcctgctactctggctcccagtttcagataccactggagaaatagtgatgacgcagtctccagccaccctgtctgtgtctccaggggaaagagccacactctcctgcagggccagtcagagtgttagcagcagcttagcctggtaccagcagaaacctggccaggctcccaggctcctcatctatggtgcatctacgagggccacgtggtactcccccagccaggttcagtggcnggtgggtctggggacaggagtttcactctcaccatcagcagcctgcagtctagaagtattttgcttagtttattactgtacagtctactaattaataactcggtaccttaccgtactaggtttcgaccgtacggggtaccaaggtccgtagggaagtacgtaacgaaaacggtactaggtcggtactcgg

SEQ ID NO: 308891 - DNA, 537 bp, Homo sapiens
  misc_feature: GZ8MTXP02J0ANG.22.59.F04.1.454.CMB.2.raw
  modified_base (209)..(209): a, c, t, g, unknown or other
  misc_feature (209)..(209): n is a, c, g, or t
  modified_base (352)..(352): a, c, t, g, unknown or other
  misc_feature (352)..(352): n is a, c, g, or t
tcagacatacgcgtcacgaccggtgctcgatttagtacacacacttagggattgggggaggaactgctcagttaggacccagacggaaccatggaagccccagcgcagcttctcttcctcctgctactctggctcccagtttcagataccactggagaaatagtgatgacgcagtctccagccaccctgtctgtgtctccaggggaaangccacactctcctgcagggccagtcagagtgtagcagcagcttagcctggtaccagcagaaacctggccaggctccaggctcctcatctatggtgcatctacggagggccagtggtactcccccgagcctaggttcagtggcnggtgggtctgggacagagttcactctcaccatcagcagcctgcagtctgaagtatttgcttagtttatacgttgtcagtctaactataaataacgtggtcccttaccgtactacggtttcggaccgtacgggggtaccaagtccgtaggaagtaacgtacgaaaacgtaacgtggtacggactcg

SEQ ID NO: 308892 - DNA, 587 bp, Homo sapiens
  misc_feature: GZ8MTXP02HTK0Z.22.59.F04.1.454.CMB.2.raw
  modified_base (210)..(210): a, c, t, g, unknown or other
  misc_feature (210)..(210): n is a, c, g, or t
  modified_base (365)..(365): a, c, t, g, unknown or other
  misc_feature (365)..(365): n is a, c, g, or t
tcagacatacgcgtcacgaccggtgctcgatttagtacacacacttagggattgggggaggaactgctcagttaggacccagacggaaccatggaagccccagcgcagcttctcttcctcctgctactctggctcccagtttcagataccactggagaaatagtgatgacgcagtctccagccaccctgtctgtgtctccgaggggaaanagccacactctcctgcagggccagtcagagtgttagcagcagcttagcctggaccagcagaaacctggccaggctcccaggcctcctcatctatggtgcatctacggacgggccacgtggtactccccccgagccctagggttccaggtcggacngggtggggtcgtgggggacctaggtacgtttccactctacaccatcagccagccctgcagtctagaagtattttgacttagtttattactgtacagtactaacttaataataacgtcggtacccttaccgttacttaggttttacggaccgtaacgggggtaaccctaaaggtccgtaggggaacgtagtaaccgaaaacgtaacgttggtacggtctacgg

SEQ ID NO: 308893 - DNA, 532 bp, Homo sapiens
  misc_feature: GZ8MTXP02H715R.22.59.F04.1.454.CMB.2.raw
  modified_base (209)..(209): a, c, t, g, unknown or other
  misc_feature (209)..(209): n is a, c, g, or t
  modified_base (296)..(296): a, c, t, g, unknown or other
  misc_feature (296)..(296): n is a, c, g, or t
  modified_base (306)..(306): a, c, t, g, unknown or other
  misc_feature (306)..(306): n is a, c, g, or t
  modified_base (413)..(413): a, c, t, g, unknown or other
  misc_feature (413)..(413): n is a, c, g, or t
tcagacatacgcgtcacgaccggtgctcgatttagtacacacacttagggattgggggaggaactgctcagttaggacccagacggaaccatggaagccccagcgcagcttctcttcctcctgctactctggctcccagtttcagataccactggagaaatagtgatgacgcagtctccagccaccctgtctgtgtctccaggggaaanagccacactctcctgcagggccagtcagagtgttagcagcagcttagcctggaccagcagaacctggccaggctcccaggcctcctnatctatggtncatctacgagggccagtggtactcccccgagccaggttcagtggcaggttggggtctggggacagtacgttcactctacaccatcagcagcctgcagtctagaagtnttttgcttagtttatactgtcagtcaatataaatacgtgaccttcgtacgttggtttacgaccgtacggggaccaggtctaggaacgtactaacgaaacgaacgtggtacggtactacg

SEQ ID NO: 308894 - DNA, 562 bp, Homo sapiens
  misc_feature: GZ8MTXP02JFFD3.22.59.F04.1.454.CMB.2.raw
  modified_base (210)..(210): a, c, t, g, unknown or other
  misc_feature (210)..(210): n is a, c, g, or t
  modified_base (312)..(312): a, c, t, g, unknown or other
  misc_feature (312)..(312): n is a, c, g, or t
  modified_base (426)..(426): a, c, t, g, unknown or other
  misc_feature (426)..(426): n is a, c, g, or t
tcagacatacgcgtcacgaccggtgctcgatttagtacacacacttagggattgggggaggaactgctcagttaggacccagacggaaccatggaagccccagcgcagcttctcttcctcctgctactctggctcccagtttcagataccactggagaaatagtgatgacgcagtctccagccaccctgtctgtgtctccgaggggaaangccacactctcctgcagggccagtcagagtgttagcagcagcttagcctggtaccagcagaaacctggaccaggcctcccgggctccgtcatcctagtggtncatcgtacggcgggcctacgtggtactcccaacgccgtaggttcaggtggacaggtggggtctaggggacagagttcactctacaccatcagcagcctgactagtctagaagtntttggactagtttatactgtacagactaacttataactacgtcgtacctccgtataggtttcggacgacggggaacctaggccgttagggaaacctaagtaaccgaaaacgtacgtagggtacgtccgtacgaccc

SEQ ID NO: 308895 - DNA, 575 bp, Homo sapiens
  misc_feature: GZ8MTXP02JO0I4.22.59.F04.1.454.CMB.2.raw
  modified_base (209)..(209): a, c, t, g, unknown or other
  misc_feature (209)..(209): n is a, c, g, or t
  modified_base (237)..(237): a, c, t, g, unknown or other
  misc_feature (237)..(237): n is a, c, g, or t
  modified_base (309)..(309): a, c, t, g, unknown or other
  misc_feature (309)..(309): n is a, c, g, or t
  modified_base (321)..(321): a, c, t, g, unknown or other
  misc_feature (321)..(321): n is a, c, g, or t
  modified_base (360)..(360): a, c, t, g, unknown or other
  misc_feature (360)..(360): n is a, c, g, or t
tcagacatacgcgtcacgaccggtgctcgatttagtacacacacttagggattgggggaggaactgctcagttaggacccagacggaaccatggaagccccagcgcagcttctcttcctcctgctactctggctcccagtttcagataccactggagaaatagtgatgacgcagtctccagccaccctgtctgtgtctccaggggaaangccacactctcctgcagggccagtcagngtgttagcagcagctagcctggtaccagcagaaacctggccaggcctcccgaggcctcctcatctagtggtnctatcgtacggngggccagtggtactcccccgagcctaggttcaggtggcngggttgggtcgtaggggacagtgtttccactctcactatcagcacgcctgcgagtcgtagtaacgtagttttgacttagtttattaccgtagtactacgtactacttaactaaacgttaacgtcgtacccgttacgttacgttacggtttacggaccgtaacggggacctaacggtcgtaggaagtacgtacgaaacggactggtacggctacgg

SEQ ID NO: 308896 - DNA, 557 bp, Homo sapiens
  misc_feature: GZ8MTXP02IZKMJ.22.59.F04.1.454.CMB.2.raw
  modified_base (209)..(209): a, c, t, g, unknown or other
  misc_feature (209)..(209): n is a, c, g, or t
  modified_base (298)..(298): a, c, t, g, unknown or other
  misc_feature (298)..(298): n is a, c, g, or t
  modified_base (308)..(308): a, c, t, g, unknown or other
  misc_feature (308)..(308): n is a, c, g, or t
  modified_base (362)..(362): a, c, t, g, unknown or other
  misc_feature (362)..(362): n is a, c, g, or t
  modified_base (379)..(379): a, c, t, g, unknown or other
  misc_feature (379)..(379): n is a, c, g, or t
tcagacatacgcgtcacgaccggtgctcgatttagtacacacacttagggattgggggaggaactgctcagttaggacccagacggaaccatggaagccccagcgcagcttctcttcctcctgctactctggctcccagtttcagataccactggagaaatagtgatgacgcagtctccagccaccctgtctgtgtctccaggggaaangccacactctcctgcagggccagtcagagtgttagcagcagcttagcctggtaccagcagaaacctggccaggcctcccaggcctcctnatctatggtncatctacgagggccacgtggtactccccccgagtccctaggttccaggtcggcngggtgggtctggggacnggagtttcactctcaccatcagcacgcctgctagtctagtaagtattttgcttagttttacttacttgtacagtactactaataataacgtcggtcccttacgttacgtaggttttcggaccgtacggggtacaacggcgtaggaagacgtacgaaacgtacgtggtacggtactacg

SEQ ID NO: 308897 - DNA, 569 bp, Homo sapiens
  misc_feature: GZ8MTXP02F09QO.22.59.F04.1.454.CMB.2.raw
  modified_base (207)..(207): a, c, t, g, unknown or other
  misc_feature (207)..(207): n is a, c, g, or t
  modified_base (286)..(286): a, c, t, g, unknown or other
  misc_feature (286)..(286): n is a, c, g, or t
  modified_base (296)..(296): a, c, t, g, unknown or other
  misc_feature (296)..(296): n is a, c, g, or t
  modified_base (306)..(306): a, c, t, g, unknown or other
  misc_feature (306)..(306): n is a, c, g, or t
  modified_base (365)..(365): a, c, t, g, unknown or other
  misc_feature (365)..(365): n is a, c, g, or t
tcagacatacgcgtcacgaccggtgctcgatttagtacacacacttagggattggggaggaactgctcagttaggacccagacggaaccatggaagccccagcgcagcttctcttcctcctgctactctggctcccagtttcagataccactggagaaatagtgatgacgcagtctccagccacctgtctgtgtctccgaggggaangccacactctcctgcagggccagtcagagtgtagcagcagcttagctggaccagcagaacctggccaggctccagctcnatctatggtncatcgacggnggccatggtactccccccagccgtaggttcaggtcggactgggtcggggtctggggacnggtacgttcactctcaccatcagcacgcctgctagtctagtaagttatttgacttagtttacttacgtgtacacgtactaacttaattaactaacgtcggtacccttacggttacgtttaggtttcgggaccggtaacggggaccgtaaacggccgttaagggaacgtacgtaaccgtaaacggtaaccgttggtcggactacg

SEQ ID NO: 308898 - DNA, 564 bp, Homo sapiens
  misc_feature: GZ8MTXP02GR7DD.22.59.F04.1.454.CMB.2.raw
  modified_base (209)..(209): a, c, t, g, unknown or other
  misc_feature (209)..(209): n is a, c, g, or t
  modified_base (349)..(349): a, c, t, g, unknown or other
  misc_feature (349)..(349): n is a, c, g, or t
tcagacatacgcgtcacgaccggtgctcgatttagtacacacacttagggattgggggaggaactgctcagttaggacccagacggaaccatggaagccccagcgcagcttctcttcctcctgctactctggctcccagtttcagataccactggagaaatagtgatgacgcagtctccagccaccctgtctgtgtctccaggggaaanagccacactctcctgcagggccagtcagagtgttagcagcagcttagcctggtaccagcagaacctggccaggctcccaggcctctcatctatggtgcatctacgagggccactggtactccccagccaggttcagtgcnggtgggtctgggacagacgttcactctcaccatcgagcacgcctgcagtctagaagtatttgacttagtttattacttgtacgagtactactaattaaattacgtcgtcccttaccgtaccgttagttttacggaccgtaacggggacccgtaaggtaccgttagggaacgtaacgtaaccgtaaaacggtaacgtacggtacggtacgtaccgg

SEQ ID NO: 308899 - DNA, 509 bp, Homo sapiens
  misc_feature: GZ8MTXP02F34JV.22.59.F04.1.454.CMB.2.raw
  modified_base (209)..(209): a, c, t, g, unknown or other
  misc_feature (209)..(209): n is a, c, g, or t
  modified_base (351)..(351): a, c, t, g, unknown or other
  misc_feature (351)..(351): n is a, c, g, or t
tcagacatacgcgtcacgaccggtgctcgatttagtacacacacttagggattgggggaggaactgctcagttaggacccagacggaaccatggaagccccagcgcagcttctcttcctcctgctactctggctcccagtttcagataccactggagaaatagtgatgacgcagtctccagccaccctgtctgtgtctccaggggaaangccacactctcctgcagggccagtcagagtgtagcagcagcttagcctggtaccagcagaaacctggccaggctcccaggctcctcatctatggtgcatctacggaggccacgtggtactcccccagccaggttcagtggcnggtgggtctggggacagagttcactctcaccatcagcagcctagctagctgaaagtatttgctagtttattactgtacagctactaataataactgacctacgtactagtttcgacctaggggaccaagctagaagactacaaaacgactgtagctag

SEQ ID NO: 308900 - DNA, 587 bp, Homo sapiens
  misc_feature: GZ8MTXP02H3BY4.22.59.F04.1.454.CMB.2.raw
  modified_base (208)..(208): a, c, t, g, unknown or other
  misc_feature (208)..(208): n is a, c, g, or t
  modified_base (294)..(294): a, c, t, g, unknown or other
  misc_feature (294)..(294): n is a, c, g, or t
  modified_base (305)..(305): a, c, t, g, unknown or other
  misc_feature (305)..(305): n is a, c, g, or t
tcagacatacgcgtcacgaccggtgctcgatttagtacacacacttagggattgggggaggaactgctcagttaggacccagacggaaccatggaagccccagcgcagcttctcttcctcctgctactctggctcccagtttcagataccactggagaaatagtgatgacgcagtctccagccacctgtctgtgtctccaggggaaanagccacactctcctgcagggccagtcagagtgttagcagcagctagcctggaccagcagaacctggccaggctcccgagcctcctnatctatggtcncatctaacggacgggacctacgtggtactccccccgagcccgtagggttccagggtcggctggggttggggtctgggggaactagtacgttccactctacacactcagcagcctgcagtctagagttatttgcttagtttactacgtgtacagtactactaataaactaacgtcgtacccttacgtaacgttacggtttcggacccggtaacgggtaacccgtaaggtccgttaagggaacgtaacgtaaccgaaaacggtacgttacggtacggtacacgg

SEQ ID NO: 308901 - DNA, 614 bp, Homo sapiens
  misc_feature: GZ8MTXP02IIXOZ.22.59.F04.1.454.CMB.2.raw
  modified_base (311)..(311): a, c, t, g, unknown or other
  misc_feature (311)..(311): n is a, c, g, or t
tcagacatacgcgtcacgaccggtgctcgatttagtacacacacttagggattgggggaggaactgctcagttaggacccagacggaaccatggaagccccagcgcagcttctcttcctcctgctactctggctcccagtttcagataccactggagaaatagtgatgacgcagtctccagccaccctgtctgtgtctccgaggggaaagagccacactctcctgcagggccagtcagagtgttagcagcagcttagcctggtaccagcagaaacctggccaggcctcccgaggcctcctcatctatggtncatctacggagggccacgtggtactcccccgagcccaggttcaggtggctgggtcgggtcgtggggactaggtagtttccactctccaccactcagcacgcctcgcgagtcgtagaagttatttgtacttagtttaactttacgttagtacgtagtactaacttaacttaaacgttaaacgtcggtacccgttacccgttacgttacggtttttacggacccggtaacgggggtaacccgtaacgtaccgttagggaacgtaacgttaaccgaaaacgaacgttacggtacggtacgtaccgg

SEQ ID NO: 308902 - DNA, 545 bp, Homo sapiens
  misc_feature: GZ8MTXP02GUUY3.22.59.F04.1.454.CMB.2.raw
  modified_base (210)..(210): a, c, t, g, unknown or other
  misc_feature (210)..(210): n is a, c, g, or t
  modified_base (265)..(265): a, c, t, g, unknown or other
  misc_feature (265)..(265): n is a, c, g, or t
  modified_base (308)..(308): a, c, t, g, unknown or other
  misc_feature (308)..(308): n is a, c, g, or t
  modified_base (330)..(330): a, c, t, g, unknown or other
  misc_feature (330)..(330): n is a, c, g, or t
tcagacatacgcgtcacgaccggtgctcgatttagtacacacacttagggattgggggaggaactgctcagttaggacccagacggaaccatggaagccccagcgcagcttctcttcctcctgctactctggctcccagtttcagataccactggagaaatagtgatgacgcagtctccagccaccctgtctgtgtctccgaggggaaangccacactctcctgcagggccagtcagagtgttagcagcagctagcctggtaccngcagaacctggccaggcctcccgaggcctcctcatctatggtncatcacggaggccagtggtacncccccgagcctaggttcaggtcggctgggtgggtctggggactaggtagttccactctcaccatcagcagcctagcgagtctagtaagtatttagacttagtttattactgtactagtactactaataataacgtcgtccctacgtacttaggtttcggacgtacgggaccacgcgtaggaagtacgtaacgaaacgacgtacggtcgtactacg

SEQ ID NO: 308903 - DNA, 554 bp, Homo sapiens
  misc_feature: GZ8MTXP02I3CHA.22.59.F04.1.454.CMB.2.raw
  modified_base (209)..(209): a, c, t, g, unknown or other
  misc_feature (209)..(209): n is a, c, g, or t
  modified_base (352)..(352): a, c, t, g, unknown or other
  misc_feature (352)..(352): n is a, c, g, or t
  modified_base (384)..(384): a, c, t, g, unknown or other
  misc_feature (384)..(384): n is a, c, g, or t
tcagacatacgcgtcacgaccggtgctcgatttagtacacacacttagggattgggggaggaactgctcagttaggacccagacggaaccatggaagccccagcgcagcttctcttcctcctgctactctggctcccagtttcagataccactggagaaatagtgatgacgcagtctccagccaccctgtctgtgtctccaggggaaangccacactctcctgcagggccagtcagagtgttagcagcagcttagcctggtaccagcagaacctggccaggctcccaggcctcctcatctatggtgcatctacgagggcctacgtggtactcccccagccaggttcagtgcnggtgggtctgggacagtagttcactctcaccntcagcacgcctgcagtctagtaagttatttgactttagtttacttacttgtactagtactacttaaattaactaacgtcggtacctaccgttacgttacgtttacggaccgtaacgggtacctaacggtcgtaggaagtacgtaacgaaacgtacgtacggtacgctacg

SEQ ID NO: 308904 - DNA, 528 bp, Homo sapiens
  misc_feature: GZ8MTXP02G58CY.22.59.F04.1.454.CMB.2.raw
  modified_base (208)..(208): a, c, t, g, unknown or other
  misc_feature (208)..(208): n is a, c, g, or t
  modified_base (306)..(306): a, c, t, g, unknown or other
  misc_feature (306)..(306): n is a, c, g, or t
  modified_base (316)..(316): a, c, t, g, unknown or other
  misc_feature (316)..(316): n is a, c, g, or t
  modified_base (351)..(351): a, c, t, g, unknown or other
  misc_feature (351)..(351): n is a, c, g, or t
  modified_base (360)..(360): a, c, t, g, unknown or other
  misc_feature (360)..(360): n is a, c, g, or t
  modified_base (380)..(380): a, c, t, g, unknown or other
  misc_feature (380)..(380): n is a, c, g, or t
  modified_base (385)..(385): a, c, t, g, unknown or other
  misc_feature (385)..(385): n is a, c, g, or t
  modified_base (402)..(402): a, c, t, g, unknown or other
  misc_feature (402)..(402): n is a, c, g, or t
  modified_base (428)..(428): a, c, t, g, unknown or other
  misc_feature (428)..(428): n is a, c, g, or t
tcagacatacgcgtcacgaccggtgctcgatttagtacacacacttagggattgggggaggaactgctcagttaggacccagacggaaccatggaagccccagcgcagcttctcttcctcctgctactctggctcccagtttcagataccactggagaaatagtgatgacgcagtctccagccaccctgtctgtgtctccaggggaangccacactctcctgcagggccagtcagagtgttagcagcagcttagcctggtaccagcagaacctggccaggctccccaggcctcctcatctatggtncatctacggngggccagtggtactcccccagccagttcagtggcnggtgggtcnggggacaggacgttcactcncaccntcagcagcctgcagtcngatattttgcgttagtttattacgtntacagactactataatactacgtacgtacgtacgttagttacgtacgtacggtacgacgtacgtagaacgacgtaacgaacgaacgtacgtacgacgtcg

SEQ ID NO: 308905 - DNA, 551 bp, Homo sapiens
  misc_feature: GZ8MTXP02JMS75.22.59.F04.1.454.CMB.2.raw
  modified_base (210)..(210): a, c, t, g, unknown or other
  misc_feature (210)..(210): n is a, c, g, or t
  modified_base (309)..(309): a, c, t, g, unknown or other
  misc_feature (309)..(309): n is a, c, g, or t
tcagacatacgcgtcacgaccggtgctcgatttagtacacacacttagggattgggggaggaacttctcagttaggacccagacggaaccatggaagccccagcgcagcttctcttcctcctgctactctggctcccagtttcagataccactggagaaatagtgatgacgcagtctccagccaccctgtctgtgtctccgaggggaaangccacactctcctgcagggccagtcagagtgtagcagcagcttagcctggtaccagcaagaacctggccaggcctccgaggcctcctcatctagtggtnctatccgtacggacgggccaagttggtactccccgagccctagggttcaggtggactagggtggggtctggggacaggtacgttccacttctacacctatcagcacgcctgctagtctagtaagttatttgacttagtttattactgtacagctaactataactacgtcgtcctacgtactacggtttcggaccgagggaccagtcgtaggataacgacgaaacgtacgtgtcggcacgtac

SEQ ID NO: 308906 - DNA, 595 bp, Homo sapiens
  misc_feature: GZ8MTXP02HADRC.22.59.F04.1.454.CMB.2.raw
  modified_base (210)..(210): a, c, t, g, unknown or other
  misc_feature (210)..(210): n is a, c, g, or t
  modified_base (215)..(215): a, c, t, g, unknown or other
  misc_feature (215)..(215): n is a, c, g, or t
  modified_base (314)..(314): a, c, t, g, unknown or other
  misc_feature (314)..(314): n is a, c, g, or t
  modified_base (327)..(327): a, c, t, g, unknown or other
  misc_feature (327)..(327): n is a, c, g, or t
  modified_base (342)..(342): a, c, t, g, unknown or other
  misc_feature (342)..(342): n is a, c, g, or t
tcagacatacgcgtcacgaccggtgctcgatttagtacacacacttagggattgggggaggaactgctcagttaggacccagacggaaccatggaagccccagcgcagcttctcttcctcctgctactctggctcccagtttcagataccactggagaaatagtgatgacgcagtctccagccaccctgtctgtgtctccgaggggaaangccanactctcctgcagggccagtcagagtgttagcagcagtcttagcctggtaccagcagaaacctggacccaggcctcccgaggcctcctcatctagtggtnctatcgtaacggnggcctagtcggtacncccccgagtccgtaggttcaggtggcgtgggtcgggtcgtagggacaggtacgttcactctcactatcagcacgcctgactagtcgtagtaagttcgtttgacgtttagtttacttacgttcgtactacgtactacttaaattaactaacgtcggtacccttacgttaacgttacggtttacggaccggtaacgggtaaccacggtcgttaaggaacgtacgtaacgaaaacgtacgtacggtcggtactacg

SEQ ID NO: 308907 - DNA, 575 bp, Homo sapiens
  misc_feature: GZ8MTXP02IK3D7.22.59.F04.1.454.CMB.2.raw
  modified_base (356)..(356): a, c, t, g, unknown or other
  misc_feature (356)..(356): n is a, c, g, or t
  modified_base (412)..(412): a, c, t, g, unknown or other
  misc_feature (412)..(412): n is a, c, g, or t
tcagacatacgcgtcacgaccggtgctcgatttagtacacacacttagggattgggggaggaactgctcagttaggacccagacggaaccatggaagccccagcgcagcttctcttcctcctgctactctggctcccagtttcagataccactggagaaatagtgatgacgcagtctccagccaccctgtctgtgtctccaggggaaagagccacactctcctgcagggccagtcagagtgttagcagcagcttagcctggtaccagcagaacctggccaggcctcccaggctcctcatctatggtgcatctacgagggccacgtggtactcccccgagcccaggttcaggtggcngggtgggtctggggacagtgttcactctcaccatcagcagcctgcagtctgaagtntttgcttagtttattactgtcagtactaacttaataacttaactcggtacccttaccgttacttacggttttcggaccggtaacgggggtacccgtaaaacggtccgttagggaacgtaacgtaaccgtaaaaccggtaacgttacggtacggtacgttacgg

SEQ ID NO: 308908 - DNA, 574 bp, Homo sapiens
  misc_feature: GZ8MTXP02GC6VF.22.59.F04.1.454.CMB.2.raw
  modified_base (210)..(210): a, c, t, g, unknown or other
  misc_feature (210)..(210): n is a, c, g, or t
  modified_base (284)..(284): a, c, t, g, unknown or other
  misc_feature (284)..(284): n is a, c, g, or t
  modified_base (293)..(293): a, c, t, g, unknown or other
  misc_feature (293)..(293): n is a, c, g, or t
  modified_base (303)..(303): a, c, t, g, unknown or other
  misc_feature (303)..(303): n is a, c, g, or t
  modified_base (354)..(354): a, c, t, g, unknown or other
  misc_feature (354)..(354): n is a, c, g, or t
tcagacatacgcgtcacgaccggtgctcgatttagtacacacacttagggattgggggaggaactgctcagttaggacccagacggaaccatggaagccccagcgcagcttctcttcctcctgctactctggctcccagtttcagataccactggagaaatagtgatgacgcagtctccagccaccctgtctgtgtctccgaggggaaanagccacactctcctgcagggccagtcagagtgtagcagcagcttagcctggtaccagcagaacctggccaggcnccagctccnatctatggtncatctacggaggccacgtggtactcccccgagccctaggttcaggttggcngggtcgggtcgtgggacagtacgtttcactctacgaccatacagcacgcctgacgtagtctagaaagttactttgacttagtttattacgtgtacagtactaacttaataataacgtcgtacccgttacgttacgttaggtttacgggaccgtaacggggtaccgaaagtcgtaggaacgtaacgtaaccgaaaacggtacgttaggacggtacgtacgg

SEQ ID NO: 308909 - DNA, 519 bp, Homo sapiens
  misc_feature: GZ8MTXP02GK2G3.22.59.F04.1.454.CMB.2.raw
  modified_base (209)..(209): a, c, t, g, unknown or other
  misc_feature (209)..(209): n is a, c, g, or t
  modified_base (305)..(305): a, c, t, g, unknown or other
  misc_feature (305)..(305): n is a, c, g, or t
  modified_base (314)..(314): a, c, t, g, unknown or other
  misc_feature (314)..(314): n is a, c, g, or t
  modified_base (325)..(325): a, c, t, g, unknown or other
  misc_feature (325)..(325): n is a, c, g, or t
  modified_base (343)..(343): a, c, t, g, unknown or other
  misc_feature (343)..(343): n is a, c, g, or t
  modified_base (411)..(411): a, c, t, g, unknown or other
  misc_feature (411)..(411): n is a, c, g, or t
  modified_base (416)..(416): a, c, t, g, unknown or other
  misc_feature (416)..(416): n is a, c, g, or t
tcagacatacgcgtcacgaccggtgctcgatttagtacacacacttagggattgggggaggaactgctcagttaggacccagacggaaccatggaagccccagcgcagcttctcttcctcctgctactctggctcccagtttcagataccactggagaaatagtgatgacgcagtctccagccaccctgtctgtgtctccaggggaaanagccacactctcctgcagggccagtcagagtgtagcagcagcttagcctggtaccagcagaaacctggccaggctccaggctcctcatctatggtncatcgacgnggccatgtacnccccagccagtcagtgcngtggtctgggacagagtcactcacaacatcagcacgctgcagtactagaagtattgtatattattatntacanactataataaataactacgtctacgtacgttagtttacggtacgaacggacgaacgacgaggaagaacgtaacgaaaacgtaaacgtacgtacggtacgtacg

SEQ ID NO: 308910 - DNA, 567 bp, Homo sapiens
  misc_feature: GZ8MTXP02H1V58.22.59.F04.1.454.CMB.2.raw
  modified_base (209)..(209): a, c, t, g, unknown or other
  misc_feature (209)..(209): n is a, c, g, or t
  modified_base (275)..(275): a, c, t, g, unknown or other
  misc_feature (275)..(275): n is a, c, g, or t
  modified_base (317)..(317): a, c, t, g, unknown or other
  misc_feature (317)..(317): n is a, c, g, or t
  modified_base (355)..(355): a, c, t, g, unknown or other
  misc_feature (355)..(355): n is a, c, g, or t
  modified_base (418)..(418): a, c, t, g, unknown or other
  misc_feature (418)..(418): n is a, c, g, or t
tcagacatacgcgtcacgaccggtgctcgatttagtacacacacttagggattgggggaggaactgctcagttaggacccagacggaaccatggaagccccagcgcagcttctcttcctcctgctactctggctcccagtttcagataccactggagaaatagtgatgacgcagtctccagccaccctgtctgtgtctccaggggaaanagccacactctcctgcagggccagtcagagtgttagcagcagcttagcctggaccagcagaaaccnggccaggcctcccaggctcctcatctatggtgcatcgtacgnggccactggtactcccccgagccctaggttcagtggcngggtgggtctgggggaccaggagttcactctacaccatcagcacgcctgcagtctagtaagtnttttgactttagtttattactgtacagtactactaataataacgtacggtcccgttacgtacgttacggttttacggaccggtaacggggtacccgaaggtaccgtagggtaacgactaacgaaaacgtaacgtaggttcggactacgg

SEQ ID NO: 308911 - DNA, 559 bp, Homo sapiens
  misc_feature: GZ8MTXP02IYWIS.22.59.F04.1.454.CMB.2.raw
  modified_base (210)..(210): a, c, t, g, unknown or other
  misc_feature (210)..(210): n is a, c, g, or t
  modified_base (315)..(315): a, c, t, g, unknown or other
  misc_feature (315)..(315): n is a, c, g, or t
tcagacatacgcgtcacgaccggtgctcgatttagtacacacacttagggattgggggaggaactgctcagttaggacccagacggaaccatggaagccccagcgcagcttctcttcctcctgctactctggctcccagtttcagataccactggagaaatagtgatgacgcagtctccagccaccctgtctgtgtctccgaggggaaangccacactctcctgcagggccagtcagagtgttagcagcagcttagcctggtaccagcagaaaccctggacccaggcctccccgaggcctcctcatctagtggtncatctacggacgggccagtcggtactcccccgagccctaggttccaggtcggctagggtggggtctagggggactagtacgtttcactctcaccatcagcacgcctgctagtctagaagtactttgactagtttacttactgtcagtctaacttataataactcggtcctacggtactaggtttacggacgtaacgggaccgtaacgcgtaggaagacgtacgaaacgtacgtagtcggactcg

SEQ ID NO: 308912 - DNA, 572 bp, Homo sapiens
  misc_feature: GZ8MTXP02JOCMW.22.59.F04.1.454.CMB.2.raw
  modified_base (355)..(355): a, c, t, g, unknown or other
  misc_feature (355)..(355): n is a, c, g, or t
  modified_base (419)..(419): a, c, t, g, unknown or other
  misc_feature (419)..(419): n is a, c, g, or t
tcagacatacgcgtcacgaccggtgctcgatttagtacacacacttagggattgggggaggaactgctcagttaggacccagacggaaccatggaagccccagcgcagcttctcttcctcctgctactctggctcccagtttcagataccactggagaaatagtgatgacgcagtctccagccaccctgtctgtgtctccaggggaaagagccacactctcctgcagggccagtcagagtgtagcagcagcttagcctggtaccagcagaaacctggccaggctcccaggctcctcatctatggtgcatcgtacggagggccagtggtactcccccgagccaggttcaggtggcnggtgggtctggggacaggtagttcactctcaccatcagcacgcctgctagtcgtagaaaggttntttagacttagtttattacgttagtactagtactaacttaattaactacgtacgtaccgttaccgttacgttacggtttacggaccggtaacggggaccgtaacggtcgtaggaacgtacgtaaccgaaacgtacgtacggtacggtacgtcg

SEQ ID NO: 308913 - DNA, 579 bp, Homo sapiens
  misc_feature: GZ8MTXP02GLK7R.22.59.F04.1.454.CMB.2.raw
  modified_base (211)..(211): a, c, t, g, unknown or other
  misc_feature (211)..(211): n is a, c, g, or t
  modified_base (449)..(449): a, c, t, g, unknown or other
  misc_feature (449)..(449): n is a, c, g, or t
tcagacatacgcgtcacgaccggtgctcgatttagtacacacacttagggattgggggaggaactgctcagttaggacccagacggaaccatggaagccccagcgcagcttctcttcctcctgctactctggctcccagtttcagataccactggagaaatagtgatgacgcagtctccagccaccctgtctgtgtctccgaaggggaaangccacactctcctgcagggccagtcagagtgtagcagcagcttagcctggtaccagcagaaacctggaccaggcctcccaggcctcctcatctagtggtgcatcgtacggacgggcctagtggtactcccccgagccctaggttcaggtcggctagggtcggggtctaggggacctaggtacgtttccactcctacaccgtatccgaagcacgcctggacctagtcgtagtaaagttnttttgacgtttagttttactacgtgtacctagactaactaattaactaacgtcgacccttacgtactaggtttacggacggacgggtacgaacgcgtagaagactaacgaaaacgacgtgtacggctacg

SEQ ID NO: 308914 - DNA, 602 bp, Homo sapiens
  misc_feature: GZ8MTXP02FJICJ.22.59.F04.1.454.CMB.2.raw
  modified_base (209)..(209): a, c, t, g, unknown or other
  misc_feature (209)..(209): n is a, c, g, or t
  modified_base (299)..(299): a, c, t, g, unknown or other
  misc_feature (299)..(299): n is a, c, g, or t
  modified_base (309)..(309): a, c, t, g, unknown or other
  misc_feature (309)..(309): n is a, c, g, or t
tcagacatacgcgtcacgaccggtgctcgatttagtacacacacttagggattgggggaggaactgctcagttaggacccagacggaaccatggaagccccagcgcagcttctcttcctcctgctactctggctcccagtttcagataccactggagaaatagtgatgacgcagtctccagccaccctgtctgtgtctccaggggaaangccacactctcctgcagggccagtcagagtgtagcagcagcttagcctggtaccagcaagaaacctggccaggcctcccgaggcctcctnatctatggtnactatccgtacggacgggcccagttcgggtactcccccccgagtcccctaagggtttccaaggttcggctaggggtcggggtcctagggggaccaggtacgtttccactcctcaccatcagcacgccgtgcagtctagtaaagttagtttgacttagtttatttacgtgtacctagtactactaattaataacgtcggtcccttacgtacgttacggttttcggaccgtaacggggaaccctaaggtccgtaggaagtacgtaaccgaaaacggtacgtacggtcggcgtacg

SEQ ID NO: 308915 - DNA, 575 bp, Homo sapiens
  misc_feature: GZ8MTXP02G2YAQ.22.59.F04.1.454.CMB.2.raw
  modified_base (210)..(210): a, c, t, g, unknown or other
  misc_feature (210)..(210): n is a, c, g, or t
  modified_base (305)..(305): a, c, t, g, unknown or other
  misc_feature (305)..(305): n is a, c, g, or t
tcagacatacgcgtcacgaccggtgctcgatttagtacacacacttagggattgggggaggaactgctcagttaggacccagacggaaccatggaagccccagcgcagcttctcttcctcctgctactctggctcccagtttcagataccactggagaaatagtgatgacgcagtctccagccaccctgtctgtgtctccgaggggaaangccacactctcctgcagggccagtcagagtgtagcagcagcttagcctggaccagcagaacctggccaggcctccaggcctcctcatctatggtncatctacggagggccagtggtactcccccgagccctaggttcaggtggctagggtcggggtcctgggggaccagtacgttccactctcaccatcagcagcctgccgtagtcgtagtaaagtcttttagcttagtttattacgtgtactagtactaacttaataacgtaacgtcggtacccttaccgttaacgtaggttttacggaccgtaacgggggaccctaaggccgtaggaacgtaacgtaacgaaacgtaacgtggtacggctacg

SEQ ID NO: 308916 - DNA, 555 bp, Homo sapiens
  misc_feature: GZ8MTXP02HE5MJ.22.59.F04.1.454.CMB.2.raw
  modified_base (210)..(210): a, c, t, g, unknown or other
  misc_feature (210)..(210): n is a, c, g, or t
  modified_base (311)..(311): a, c, t, g, unknown or other
  misc_feature (311)..(311): n is a, c, g, or t
  modified_base (436)..(436): a, c, t, g, unknown or other
  misc_feature (436)..(436): n is a, c, g, or t
tcagacatacgcgtcacgaccggtgctcgatttagtacacacacttagggattgggggaggaactgctcagttaggacccagacggaaccatggaagccccagcgcagcttctcttcctcctgctactctggctcccagtttcagataccactggagaaatagtgatgacgcagtctccagccaccctgtctgtgtctccgaggggaaanagccacactctcctgcagggccagtcagagtgttagcagcagcttagcctggtaccagcagaaacctggaccaggctcccgaggcctcctcatctatggtnctatcgtacggagggccagtcggtactccccccagccctagggttcaggtggctgggtgggtactgggggaactagggtacgttccacgtctacaccctatcagcacgcctgcagtctagtaatntttgcgttagtttattactgtacagactaatataaatacgtcggcccttacgtacgttggtttcggaccgacggggacctaggctagggaacagtaacgaacgtaatcggaggtctacg

SEQ ID NO: 308917 - DNA, 544 bp, Homo sapiens
  misc_feature: GZ8MTXP02JR141.22.59.F04.1.454.CMB.2.raw
  modified_base (210)..(210): a, c, t, g, unknown or other
  misc_feature (210)..(210): n is a, c, g, or t
  modified_base (296)..(296): a, c, t, g, unknown or other
  misc_feature (296)..(296): n is a, c, g, or t
  modified_base (353)..(353): a, c, t, g, unknown or other
  misc_feature (353)..(353): n is a, c, g, or t
tcagacatacgcgtcacgaccggtgctcgatttagtacacacacttagggattgggggaggaactgctcagttaggacccagacggaaccatggaagccccagcgcagcttctcttcctcctgctactctggctcccagtttcagataccactggagaaatagtgatgacgcagtctccagcccaccctgtctgtgtctccaggggaaangccacactctcctgcagggccagtcagagtgtagcagcagcttagcctggtaccagcagaacctggccaggctcccaggcctcctnatctatggtgcatcgtacgagggccagtggtactcccccgagccaggttcagtggcnggtgggtctggggacagacgttcactctaccacatcagcagcctgcagtctagagtatttgactagtttatactagtacagtactaactataactacgtacggccttacgtactaggtttacggaccgtaacggggaccaaaggtcgtaaggaagtaacgtaacgaaaacggtaacgttggacggtctacg

SEQ ID NO: 308918 - DNA, 580 bp, Homo sapiens
  misc_feature: GZ8MTXP02HAQRX.22.59.F04.1.454.CMB.2.raw
  modified_base (209)..(209): a, c, t, g, unknown or other
  misc_feature (209)..(209): n is a, c, g, or t
  modified_base (214)..(214): a, c, t, g, unknown or other
  misc_feature (214)..(214): n is a, c, g, or t
  modified_base (260)..(260): a, c, t, g, unknown or other
  misc_feature (260)..(260): n is a, c, g, or t
  modified_base (268)..(268): a, c, t, g, unknown or other
  misc_feature (268)..(268): n is a, c, g, or t
  modified_base (274)..(274): a, c, t, g, unknown or other
  misc_feature (274)..(274): n is a, c, g, or t
  modified_base (282)..(282): a, c, t, g, unknown or other
  misc_feature (282)..(282): n is a, c, g, or t
  modified_base (293)..(293): a, c, t, g, unknown or other
  misc_feature (293)..(293): n is a, c, g, or t
  modified_base (318)..(318): a, c, t, g, unknown or other
  misc_feature (318)..(318): n is a, c, g, or t
tcagacatacgcgtcacgaccggtgctcgatttagtacacacacttagggattgggggaggaactgctcagttaggacccagacggaaccatggaagccccagcgcagcttctcttcctcctgctactctggctcccagtttcagataccactggagaaatagtgatgacgcagtctccagccaccctgtctgtgtctccaggggaaangccanactctcctgcagggccagtcagagtgtagcagcagctagcctgacngcagaacngcagcnccagctcncatctatggtncatcgtagacggccacgtggtaccnccccgagccgtaggttcgaggtggacgtggggttcgggtcgtaggggactaggtacgttacaccttctaccacctatcgagcgtacgtccgtacgacgtacgtacgtagtaagttgtttacgtacgtttagtttacttacgtgtaacgtagtactaacttaataaacgtacgtcgtacccttacgtacgttacggtttacggacgtacggacgtagtcgtaggaacgtacgtaacgtaaacgtacgtcggtacgtacgtacg

SEQ ID NO: 308919 - DNA, 586 bp, Homo sapiens
  misc_feature: GZ8MTXP02GLOPG.22.59.F04.1.454.CMB.2.raw
  modified_base (325)..(325): a, c, t, g, unknown or other
  misc_feature (325)..(325): n is a, c, g, or t
  modified_base (340)..(340): a, c, t, g, unknown or other
  misc_feature (340)..(340): n is a, c, g, or t
tcagacatacgcgtcacgaccggtgctcgatttagtacacacacttagggattgggggaggaactgctcagttaggacccagacggaaccatggaagccccagcgcagcttctcttcctcctgctactctggctcccagtttcagataccactggagaaatagtgatgacgcagtctccagccaccctgtctgtgtctccgaggggaaagagccacactctcctgcagggccagtcagagtgttagcagcagcttagcctggtaccagcaagaaacctggaccaggcctcccaggcctcctcatctagtggtgcatccgtacggngggccacgtggtacncccccgagcctaggttcaggtggctgggtgggtctggggacagtacgttcactctcaccatcagcagcctgcagtctagtaagttacgtttgacttagtttacttaacgtgtactagtactaactaattaaagtaacgtcggtacccttaccgttacgttacggtttcgggaccgtacgggggtaaccgaacggtcgtaggaacgtacgttaaccgaaaacggtaacgttcggtacggtcgtacgg

SEQ ID NO: 308920 - DNA, 611 bp, Homo sapiens
  misc_feature: GZ8MTXP02J4VQC.22.59.F04.1.454.CMB.2.raw
  modified_base (209)..(209): a, c, t, g, unknown or other
  misc_feature (209)..(209): n is a, c, g, or t
  modified_base (213)..(213): a, c, t, g, unknown or other
  misc_feature (213)..(213): n is a, c, g, or t
  modified_base (218)..(218): a, c, t, g, unknown or other
  misc_feature (218)..(218): n is a, c, g, or t
  modified_base (220)..(220): a, c, t, g, unknown or other
  misc_feature (220)..(220): n is a, c, g, or t
  modified_base (224)..(224): a, c, t, g, unknown or other
  misc_feature (224)..(224): n is a, c, g, or t
  modified_base (227)..(227): a, c, t, g, unknown or other
  misc_feature (227)..(227): n is a, c, g, or t
  modified_base (234)..(236): a, c, t, g, unknown or other
  misc_feature (234)..(236): n is a, c, g, or t
  modified_base (239)..(240): a, c, t, g, unknown or other
  misc_feature (239)..(240): n is a, c, g, or t
  modified_base (242)..(242): a, c, t, g, unknown or other
  misc_feature (242)..(242): n is a, c, g, or t
  modified_base (245)..(245): a, c, t, g, unknown or other
  misc_feature (245)..(245): n is a, c, g, or t
  modified_base (253)..(253): a, c, t, g, unknown or other
  misc_feature (253)..(253): n is a, c, g, or t
  modified_base (286)..(286): a, c, t, g, unknown or other
  misc_feature (286)..(286): n is a, c, g, or t
tcagacatacgcgtcacgaccggtgctcgatttagtacacacacttagggattggggaggaactgctcagttaggacccagacggaaccatggaagccccagcgcagcttctcttcctcctgctactctggctcccagtttcagataccactggagaaatagtgatgacgcagtctccagccaccctgtctgtgtctccaggtagagcncacnctctngngcgntgnagtgttnnnacnntntcncgtacacnacaacgtacgcgacgcgtcctacgcgtccttcntacgtctggtggtcactacgttaccgcgggacgtccgtacgtcgttaaccccgccgccgtccgtaaaggttcgtacgttggtcgggtacgttgggttccgaggttacgggactacgtcttacctcctactaccacgggtcacacgtcgcgcgtccgtacgtacgtagtagtttacgttagttagtttacgttacgttacgttacgtacgtacgtcgtacgtacgtaacgtacgtaacttactacgttaccgtacgtaaccgtcgttaccgtacgttacgtacgtaaccgtacgtaacggtactacggctacggaacgtaaaccgg

SEQ ID NO: 308921 - DNA, 526 bp, Homo sapiens
  misc_feature: GZ8MTXP02FSEG1.22.59.F04.1.454.CMB.2.raw
  modified_base (209)..(209): a, c, t, g, unknown or other
  misc_feature (209)..(209): n is a, c, g, or t
  modified_base (303)..(303): a, c, t, g, unknown or other
  misc_feature (303)..(303): n is a, c, g, or t
  modified_base (312)..(312): a, c, t, g, unknown or other
  misc_feature (312)..(312): n is a, c, g, or t
  modified_base (353)..(353): a, c, t, g, unknown or other
  misc_feature (353)..(353): n is a, c, g, or t
  modified_base (411)..(411): a, c, t, g, unknown or other
  misc_feature (411)..(411): n is a, c, g, or t
tcagacatacgcgtcacgaccggtgctcgatttagtacacacacttagggattgggggaggaactgctcagttaggacccagacggaaccatggaagccccagcgcagcttctcttcctcctgctactctggctcccagtttcagataccactggagaaatagtgatgacgcagtctccagccaccctgtctgtgtctccaggggaaangccacactctcctgcagggccagtcagagtgtagcagcagcttagcctggtaccagcagaaacctggccaggctccagctcctcatctatggtncatctacgngggccacgtggtactccccccagcccaaggtttcagtggcnggtgggtctggggacaggagtttcactctcaccatcagcagcctgcagtctgaaagtnttttgactagttttattactgtacagacactaataataactacgacgtccgtactagtttcgtacgacgggacgaacgacgtaggaagagacgaaacgaacgtacgtggcgtacg

SEQ ID NO: 308922 - DNA, 514 bp, Homo sapiens
  misc_feature: GZ8MTXP02GQ6UJ.22.59.F04.1.454.CMB.2.raw
  modified_base (208)..(208): a, c, t, g, unknown or other
  misc_feature (208)..(208): n is a, c, g, or t
  modified_base (354)..(354): a, c, t, g, unknown or other
  misc_feature (354)..(354): n is a, c, g, or t
  modified_base (398)..(398): a, c, t, g, unknown or other
  misc_feature (398)..(398): n is a, c, g, or t
tcagacatacgcgtcacgaccggtgctcgatttagtacacacacttagggattggggaggaactgctcagttaggacccagacggaaccatggaagccccagcgcagcttctcttcctcctgctactctggctcccagtttcagataccactggagaaatagtgatgacgcagtctccagccaccctgtctgtgtctccaggggaaanagccacactctcctgcagggccagtcagagtgttagcagcagcttagcctggtaccagcagaacctggaccaggctcccaggctcctcatctatggtgcatcctacgacgggccactggtactccccccagccaggttcagtggcnggtgggtctgggacagagttcactctcaccatcagcagcctgcngtctgaagtattttgctagtttatactgtcagctaactataataactgacctcgtactgtttcgaccgacggggtaccaagctggaacgtatacgaaacgacgtgtcggacgtacg

SEQ ID NO: 308923 - DNA, 568 bp, Homo sapiens
  misc_feature: GZ8MTXP02HM4E4.22.59.F04.1.454.CMB.2.raw
  modified_base (211)..(211): a, c, t, g, unknown or other
  misc_feature (211)..(211): n is a, c, g, or t
  modified_base (276)..(276): a, c, t, g, unknown or other
  misc_feature (276)..(276): n is a, c, g, or t
  modified_base (311)..(311): a, c, t, g, unknown or other
  misc_feature (311)..(311): n is a, c, g, or t
  modified_base (339)..(339): a, c, t, g, unknown or other
  misc_feature (339)..(339): n is a, c, g, or t
  modified_base (367)..(367): a, c, t, g, unknown or other
  misc_feature (367)..(367): n is a, c, g, or t
  modified_base (439)..(439): a, c, t, g, unknown or other
  misc_feature (439)..(439): n is a, c, g, or t
tcagacatacgcgtcacgaccggtgctcgatttagtacacacacttagggattgggggaggaactgctcagttaggacccagacggaaccatggaagccccagcgcagcttctcttcctcctgctactctggctcccagtttcagataccactggagaaatagtgatgacgcagtctccagccaccctgtctgtgtctccgaaggggaaanagccacactctcctgcgagggccagtcagagtgtagcagcagcttagcctgtaccagcagaaccnggaccaggcctcccgaggcctcctcatctatggcnctagtaccgacggacggcctagtgtacnccccgagccgtaggttcaggtcggacgngggttcgggtcgtaggggactaggtacgttcactctacaccatcagtcacgcctgacagtcgtagtaagttntttagactttagtttactacgttgtcagtactacgttaataactacgtcgacttaccgtacgttgttacggacgtacgggtaccagtcgtaggaacgtacgtaacgaaacgtcgtggtacgtacgtacg

SEQ ID NO: 308924 - DNA, 656 bp, Homo sapiens
  misc_feature: GZ8MTXP02I9C8Y.22.59.F04.1.454.CMB.2.raw
  modified_base (205)..(205): a, c, t, g, unknown or other
  misc_feature (205)..(205): n is a, c, g, or t
  modified_base (246)..(246): a, c, t, g, unknown or other
  misc_feature (246)..(246): n is a, c, g, or t
tcagacatacgcgtcacgaccggtgctcgatttagtacacacacttagggattgggggaggaactgctcagttaggacccagacggaaccatggaagccccagcgcagcttctcttcctcctgctactctggctcccagtttcagataccactggagaaatgtgatgacgcagtctccagccacctgtctgtgtctcgagggaangccacactctcctgcgagggccagtcagtagtgtagcagcngtctagccgtgtaccagcaacgaacctggacctacggcctaccccgaggtcctccgtacacttcgtagtgggtcactaacgtcgtaacgggacgggccctaacggtacggtacctcccccgaacgtccgtacggttacgaggtcggacgtaggggtcgggtacggtaaggggactaggtacgtttaccacgtacctaccaaacgtacaccgaacgacgtaccgtccgtagacgtaacgtcgtaaaggttaaagtttctttacgaacgtttaagttttacgtacgttacgtaacgaactactaaataacgttaaactaacgtcggtaccctagttacgttcgttacggacgaacgggtactaaggtcgaaggtaactacgaacgtaaaacggtagtcggttacggctaccg

SEQ ID NO: 308925 - DNA, 625 bp, Homo sapiens
  misc_feature: GZ8MTXP02G327W.22.59.F04.1.454.CMB.2.raw
tcagacatacgcgtcacgaccggtgctcgatttagtacacacacttagggattgggggaggaactgctcagttaggacccagacggaaccatggaagccccagcgcagcttctcttcctcctgctactctggctcccagtttcagataccactggagaaatagtgatgacgcagtctccagccaccctgtctgtgtctccgaggggaaagagccacactctcctgcagggccagtcagagtgttagcagcagcttagccgtggtaccagcaacgaaaccgtggccaggcctccccgaggcctcctcatctagtggtcgctactcgtaacgggacggggtccctacgtcggttaactccccccgagcccgtagggttccaggtgcgaggggttgggtcgtggggactggtacgttcactctcacctatcacgcacgtcctgcgtagtcgtagtaaagttgttttgactttagtttatttacgtgtacgtagtacttaataacttaaataaccgtcggtacccttacgttacgttacgggtttacggaccgggttaacgggacgtaaacggtcggttacggaagtaacgtaaacgtaaaacggtaccgtaggtacggtacgtaaccg

SEQ ID NO: 308926 - DNA, 551 bp, Homo sapiens
  misc_feature: GZ8MTXP02INKIQ.22.59.F04.1.454.CMB.2.raw
  modified_base (208)..(208): a, c, t, g, unknown or other
  misc_feature (208)..(208): n is a, c, g, or t
  modified_base (306)..(306): a, c, t, g, unknown or other
  misc_feature (306)..(306): n is a, c, g, or t
  modified_base (354)..(354): a, c, t, g, unknown or other
  misc_feature (354)..(354): n is a, c, g, or t
  modified_base (449)..(449): a, c, t, g, unknown or other
  misc_feature (449)..(449): n is a, c, g, or t
tcagacatacgcgtcacgaccggtgctcgatttagtacacacacttagggattgggggaggaactgctcagttaggacccagacggaaccatggaagccccagcgcagcttctcttcctcctgctactctggctcccagtttcagataccactggagaaatagtgatgacgcagtctccagccaccctgtctgtgtctcgaggggaangccacactctcctgcagggccagtcagagtgttagcagcagcttagcctggtaccagcagaacctggccaggcctcccaggcctcctcatctatggtncatctacggacggccagtggtactccccgagcctaggttcagtcggcngggtgggtctaggggaccaggtagttcactctacacctatcagcacgcctagcagtctaggtaatacttttaggactttagtttattactacgtntagactaatataattacgcgtaccttacgtacgttggttacggacgtaggaccaagtcgtaggaagtaacgtaacgtaaacgtacgtcggtacgtacgtacg

SEQ ID NO: 308927 - DNA, 624 bp, Homo sapiens
  misc_feature: GZ8MTXP02HJ5BG.22.59.F04.1.454.CMB.2.raw
  modified_base (210)..(210): a, c, t, g, unknown or other
  misc_feature (210)..(210): n is a, c, g, or t
  modified_base (272)..(272): a, c, t, g, unknown or other
  misc_feature (272)..(272): n is a, c, g, or t
  modified_base (306)..(306): a, c, t, g, unknown or other
  misc_feature (306)..(306): n is a, c, g, or t
tcagacatacgcgtcacgaccggtgctcgatttagtacacacacttagggattgggggaggaactgctcagttaggacccagacggaaccatggaagccccagcgcagcttctcttcctcctgctactctggctcccagtttcagataccactggagaaatagtgatgacgcagtctccagccaccctgtctgtgtctccgaggggaaangccacactctcctgcagggccagtcagagtgtagcagcagctagcctggaccagcagaaccnggccaggcctcccgaggcctcctcatctatggtnctatcgtacggacgggccctaagtggtaactcccccccgaagtcccgtaggggtttccagggtcggactggggtcggggtctagggggactaggtacgttccaactcgtacacctactcgagcacgtcctgacacgtcgtagtaaacgttagttttcggactttaagtttacttacgttcgttactacgtactaacttaattaaacttacgtacgtacccttacgtacgttaggtttacggaccggtaaacgggtaacgaaacggtcgtaacgggtaagtaacgtaacgtaaaacgtacgttacggtacggtactacg

SEQ ID NO: 308928 - DNA, 588 bp, Homo sapiens
  misc_feature: GZ8MTXP02I28GD.22.59.F04.1.454.CMB.2.raw
  modified_base (210)..(210): a, c, t, g, unknown or other
  misc_feature (210)..(210): n is a, c, g, or t
  modified_base (312)..(312): a, c, t, g, unknown or other
  misc_feature (312)..(312): n is a, c, g, or t
  modified_base (362)..(362): a, c, t, g, unknown or other
  misc_feature (362)..(362): n is a, c, g, or t
tcagacatacgcgtcacgaccggtgctcgatttagtacacacacttagggattgggggaggaactgctcagttaggacccagacggaaccatggaagccccagcgcagcttctcttcctcctgctactctggctcccagtttcagataccactggagaaatagtgatgacgcagtctccagccaccctgtctgtgtctccgaggggaaanagccacactctcctgcagggccagtcagagtgttagcagcagcttagcctggtaccagcagaaacctggccaggcctcccgaggcctcctcatctagtggtncatctacggacgggccacgtggtactcccccgagcccaggttcagtggcngggtgggtctgggacagtagttcactctcaccatcagcagccctgctagtctgtaaagtattttagacttagttttacttacgttgtacctagtactaacttaattaaacttaacgtacggtcccttaccggttacgttacggttttcgggacccggtaacgggggaaccctaaggtccgtagggaagtaactaacgaaaacggtaacgtcggtacggtactacgg

SEQ ID NO: 308929 - DNA, 604 bp, Homo sapiens
  misc_feature: GZ8MTXP02HTQQI.22.59.F04.1.454.CMB.2.raw
  modified_base (211)..(211): a, c, t, g, unknown or other
  misc_feature (211)..(211): n is a, c, g, or t
  modified_base (276)..(276): a, c, t, g, unknown or other
  misc_feature (276)..(276): n is a, c, g, or t
  modified_base (298)..(298): a, c, t, g, unknown or other
  misc_feature (298)..(298): n is a, c, g, or t
  modified_base (308)..(308): a, c, t, g, unknown or other
  misc_feature (308)..(308): n is a, c, g, or t
tcagacatacgcgtcacgaccggtgctcgatttagtacacacacttagggattgggggaggaactgctcagttaggacccagacggaaccatggaagccccagcgcagcttctcttcctcctgctactctggctcccagtttcagataccactggagaaatagtgatgacgcagtctccagccaccctgtctgtgtctccgaaggggaaanagccacactctcctgcagggccagtcagagtgttagcagcagcttagcctggaccagcagaaccnggccaggctcccaggcctcctnatctatggtncatcgtacggaggccagtggtactcccccgagcccgtaggttccaggtcggcgtagggtgggtctggggaccaggtacgtttccacgtctaccacctatccaagcacgccctgcagtctagtaaagttagtttgacttagtttattacgtgtacgacgtactaactaattaaacgttaacgtcggtacccttaccggtaacgttaggttttaccgggaccggtaaacgggggtacccaaacggtccgtaggaagtaacgtaaccgaaaacgtaaccgtacggtacggtactaccgg

SEQ ID NO: 308930 - DNA, 635 bp, Homo sapiens
  misc_feature: GZ8MTXP02FL578.22.59.F04.1.454.CMB.2.raw
  modified_base (212)..(212): a, c, t, g, unknown or other
  misc_feature (212)..(212): n is a, c, g, or t
  modified_base (317)..(317): a, c, t, g, unknown or other
  misc_feature (317)..(317): n is a, c, g, or t
  modified_base (424)..(424): a, c, t, g, unknown or other
  misc_feature (424)..(424): n is a, c, g, or t
tcagacatacgcgtcacgaccggtgctcgatttagtacacacacttagggattgggggaggaactgctcagttaggacccagacggaaccatggaagccccagcgcagcttctcttcctcctgctactctggctcccagtttcagataccactggagaaatagtgatgacgcagtctccagcccaccctgtctgtgtctccgaaggggaagngccacactctcctgcgagggccagtcagagtgttagcagcagtcttagcctggtaccagcaagaacctggaccaggcctcccgaggtcctcctcatctagtggtnctatcgtacggacggccagtggtactccccccgaagtcctaaggttcaggtcggactggggttcggggtcgaggggtacaggtacgtttaccacgtcctacacctancgagcacgcctgctacgtacgtagtaaagttagtttgtacttagtttacttacgtagttacacgtactaacttaattaaacgttaaccgtcggtaacccgttaccgttacgttacggttttacgggaacccggttaacggggtaacccgaaggtccggtaggtaagtaaccgttaaacgaaaacggttacgtacggtacgtaccggtaacg

SEQ ID NO: 308931 - DNA, 593 bp, Homo sapiens
  misc_feature: GZ8MTXP02GGUX5.22.59.F04.1.454.CMB.2.raw
  modified_base (313)..(313): a, c, t, g, unknown or other
  misc_feature (313)..(313): n is a, c, g, or t
tcagacatacgcgtcacgaccggtgctcgatttagtacacacacttagggattgggggaggaactgctcagttaggacccagacggaaccatggaagccccagcgcagcttctcttcctcctgctactctggctcccagtttcagataccactggagaaatagtgatgacgcagtctccagccaccctgtctgtgtctccgaggggaaagagccacactctcctgcagggccagtcagagtgtagcagcagcttagcctggtaccagcaagaaacctggccaggcctcccgaggcctccgtcatctagtggtncatctacggaggccagtcggtactcccccagccctaggttacaggtcggcgtagggtcgggtcgtaggggacaggtacgttcacctctccaccgatacagcacgcctgcagtctagtaagtatttgcttagtttattacgtgtacagactaactaattaaataacgtggtacccttaccggttacgtaggttttcggacccggtaacgggggtaacccgtaaggtcgttaaggggaagtaacgtaaccgtaaaacggtaacggtacggttaggcctacgg

SEQ ID NO: 308932 - DNA, 738 bp, Homo sapiens
  misc_feature: GZ8MTXP02IGPVN.22.59.F04.1.454.CMB.2.raw
  modified_base (212)..(212): a, c, t, g, unknown or other
  misc_feature (212)..(212): n is a, c, g, or t
  modified_base (316)..(316): a, c, t, g, unknown or other
  misc_feature (316)..(316): n is a, c, g, or t
tcagacatacgcgtcacgaccggtgctcgatttagtacacacacttagggattgggggaggaactgctcagttaggacccagacggaaccatggaagccccagcgcagcttctcttcctcctgctactctggctcccagtttcagataccactggagaaatagtgatgacgcagtctccagcccaccctgtctgtgtctccgaaggggaaanagccacactctcctgcagggccagtcagagtgttagcagcagcttagcctggtaccagcagaaacctggaccaggcctcccgaggtcctcctcatctagtggtnctactcgtacgacggccagttggtactcccccgagccgaggttcaggtcggacgtggggtcgggtcgtaggggactaggtacgttccactcccgtacaacccgtatccgagaccctacggtcccttacgaccgtaacggttaccgttaaggaaaacgggttttactttttacgggaaccgtttttaagggttttttaaacctttccgggttattaaccccggtaagttaccttaaaacgttttaaaacttaaacgttaacccgttacgggtaccccctttttaaaccgggttaaacgtttaccgggggtttttaccgggaaacccgggttaaaacgggggtaccctaaaacggttaccggttaaggggaaacttaaccgtaaaaccggtaaaaccggtacggttcggtacggtacctaccgg

SEQ ID NO: 308933 - DNA, 636 bp, Homo sapiens
  misc_feature: GZ8MTXP02HEAS1.22.59.F04.1.454.CMB.2.raw
  modified_base (211)..(211): a, c, t, g, unknown or other
  misc_feature (211)..(211): n is a, c, g, or t
tcagacatacgcgtcacgaccggtgctcgatttagtacacacacttagggattgggggaggaactgctcagttaggacccagacggaaccatggaagccccagcgcagcttctcttcctcctgctactctggctcccagtttcagataccactggagaaatagtgatgacgcagtctccagccaccctgtctgtgtctccgaaggggaaanagccacactctcctgcagggccagtcagagtgtagcagcagcttagcctggtaccagcacgaaacctggaccaggcctcccgaggcctcctcatctagtggtgctagtcgtacggacgggcctaacgtcggtactccccccgagtcctaggttccgaggtcggcgtggggtcggggtcgtaggggacgtaggtacgttccgaacctcctccaacctatcgagccacggtccctgctaagtcgtagtaaagttttgtttacgtacgtttaagtttacttacgtagtactacgtactaaacttaaacttaacgtaccgttcggtacccttacggttacgttcgggttacggaccggtaacgggtaacctaacggtacgtacggaacgtaacgtaaaccgtaaaacggtacgtcggtacggacgtacg

SEQ ID NO: 308934 - DNA, 584 bp, Homo sapiens
  misc_feature: GZ8MTXP02GB8CF.22.59.F04.1.454.CMB.2.raw
  modified_base (210)..(210): a, c, t, g, unknown or other
  misc_feature (210)..(210): n is a, c, g, or t
  modified_base (308)..(308): a, c, t, g, unknown or other
  misc_feature (308)..(308): n is a, c, g, or t
  modified_base (334)..(334): a, c, t, g, unknown or other
  misc_feature (334)..(334): n is a, c, g, or t
tcagacatacgcgtcacgaccggtgctcgatttagtacacacacttagggattgggggaggaactgctcagttaggacccagacggaaccatggaagccccagcgcagcttctcttcctcctgctactctggctcccagtttcagataccactggagaaatagtgatgacgcagtctccagccaccctgtctgtgtctccgaggggaaangccacactctcctgcagggccagtcagagtgttagcagcagcttagctggaccagcaagaacctggaccaggctcccaggcctcctcatctagtggtncatcgtacggacggcctagtggtacncccccgagccgaggttcaggtggctgggtgggtctgggggactagacgtttccaacgtctcacctatcgagtcgacgcctgctagtcgtagtaaagttgttttagctttaagtttattacgttgtactagtactaacttaataacgtaacgttcgtaccgttacgttacgttaggtttcggaccggtacgggggtacctaaggtcgtaggggaactacgtaacgaaaacggtacgtcggtacggtctacg

SEQ ID NO: 308935 - DNA, 640 bp, Homo sapiens
  misc_feature: GZ8MTXP02FIWHD.22.59.F04.1.454.CMB.2.raw
  modified_base (212)..(212): a, c, t, g, unknown or other
  misc_feature (212)..(212): n is a, c, g, or t
  modified_base (313)..(313): a, c, t, g, unknown or other
  misc_feature (313)..(313): n is a, c, g, or t
tcagacatacgcgtcacgaccggtgctcgatttagtacacacacttagggattgggggaggaactgctcagttaggacccagacggaaccatggaagccccagcgcagcttctcttcctcctgctactctggctcccagtttcagataccactggagaaatagtgatgacgcagtctccagcccaccctgtctgtgtctccgaaggggaaanagccacactctcttgcagggccagtcagagtgtagcagcagctagcctggaccagacagaaacctggaccaggcctcccgaggcctcctcatctagtggtnctatcgaacgggacggacccagttcggtactccccccgaggtcccagggttccagggtcggcgtaggggtggggtcgtagggggaacctaggtagtttcccactcctaccaacctactacgagaccgtacgccgtgtacgtagtacgtagtaaagttacgtttagtacgttagtttaacttacgtacgtacgtaacgtactaacttaaacttaaacgtaaccgtacggtacccttaccgttacgttacggtttacgggaccggtaacgggaaccgtaacggacgtaggaacgtaacgtaacgtaaaacgtacgtggacggtcgtacg

SEQ ID NO: 308936 - DNA, 591 bp, Homo sapiens
  misc_feature: GZ8MTXP02JIS4M.22.59.F04.1.454.CMB.2.raw
  modified_base (210)..(210): a, c, t, g, unknown or other
  misc_feature (210)..(210): n is a, c, g, or t
  modified_base (309)..(309): a, c, t, g, unknown or other
  misc_feature (309)..(309): n is a, c, g, or t
  modified_base (323)..(323): a, c, t, g, unknown or other
  misc_feature (323)..(323): n is a, c, g, or t
  modified_base (366)..(366): a, c, t, g, unknown or other
  misc_feature (366)..(366): n is a, c, g, or t
  modified_base (439)..(439): a, c, t, g, unknown or other
  misc_feature (439)..(439): n is a, c, g, or t
tcagacatacgcgtcacgaccggtgctcgatttagtacacacacttagggattgggggaggaactgctcagttaggacccagacggaaccatggaagccccagcgcagcttctcttcctcctgctactctggctcccagtttcagataccactggagaaatagtgatgacgcagtctccagccaccctgtctgtgtctccgaggggaaangccacactctcctgcagggccagtcagagtgtagcagcagtcttagcctggaccagcaagaacctggaccaggcctcccaggcctcctcatctatggtnactatcgtaacggngggccagtggtactcccccgagtcccgaggttcaggtcggacnggggttcgggtcgtaggggaccaggtacgtttcactctaccacctactcgagcacgcctgctagtctgtaatnttttagacttagtttacttacgttgtcgtacgtactaacgttaattaaacgtaacgtcgtaccttaccgttacgttagtttcggacggtaacggggacgtaacgcggtaggaacgtaacgtaaccgaaaacgtaccgttaggcggtacgtcg

SEQ ID NO: 308937 - DNA, 541 bp, Homo sapiens
  misc_feature: GZ8MTXP02FOFWQ.22.59.F04.1.454.CMB.2.raw
  modified_base (210)..(210): a, c, t, g, unknown or other
  misc_feature (210)..(210): n is a, c, g, or t
  modified_base (356)..(356): a, c, t, g, unknown or other
  misc_feature (356)..(356): n is a, c, g, or t
  modified_base (417)..(417): a, c, t, g, unknown or other
  misc_feature (417)..(417): n is a, c, g, or t
tcagacatacgcgtcacgaccggtgctcgatttagtacacacacttagggattgggggaggaactgctcagttaggacccagacggaaccatggaagccccagcgcagcttctcttcctcctgctactctggctcccagtttcagataccactggagaaatagtgatgacgcagtctccagccaccctgtctgtgtctccaggggaaagngccacactctcctgcagggccagtcagagtgtagcagcagcttagcctggtaccagcagaaacctggccaggcctccaggcctcctcatctatggtgcatcctacgagggccacgtggtactcccccagcccaggttcaggtggcnggtgggtcgtgggggcagtagtcactctcacctatcgagcacgcctgcagtctagtaagtntttgacttagtttattactgtacagtcaacttataataactcgtaccttacgtactaggtttcggaccgtacggggaccaagtcgtaggaacgtactaacgaaaacgtacgtggtacgcgtacg

SEQ ID NO: 308938 - DNA, 673 bp, Homo sapiens
  misc_feature: GZ8MTXP02G7DB1.22.59.F04.1.454.CMB.2.raw
  modified_base (208)..(208): a, c, t, g, unknown or other
  misc_feature (208)..(208): n is a, c, g, or t
  modified_base (213)..(213): a, c, t, g, unknown or other
  misc_feature (213)..(213): n is a, c, g, or t
tcagacatacgcgtcacgaccggtgctcgatttagtacacacacttagggattgggggaggaactgctcagttaggacccagacggaaccatggaagccccagcgcagcttctcttcctcctgctactctggctcccagtttcagataccactggagaaatagtgatgacgcagtctccagccaccctgtctgtgtctccaggggaangccanactctcctgcagggccagtcagagtgttagcagcagcttagcctggaccagcagaacctggaccaggctcccaggctcctcatctatggtgctatctacggacgggtaccctagtggtactcccccgacgtcccgtaggttccaggttggcctaggggtcggggtccgtaggggaacctaggtacgtttaccacgtaccctaccgaaccctactaccgacggtaccgaacggtcccctggtaccgtaacggttccgttaaggtaaacgttacgtttttaggaccgtttaagttttacttaaccgtcgttaacgacgtacctaactaaacttaaacgttaacgtacggtaccccttacgttacgttacggtttacggaccgtaacgggggtaacctaacggtacgttaggaaacccgtaagttaaaccgaaaacgtaccgtacggttacgggactaaccgg

SEQ ID NO: 308939 - DNA, 580 bp, Homo sapiens
  misc_feature: GZ8MTXP02JPF9V.22.59.F04.1.454.CMB.2.raw
  modified_base (194)..(194): a, c, t, g, unknown or other
  misc_feature (194)..(194): n is a, c, g, or t
  modified_base (207)..(207): a, c, t, g, unknown or other
  misc_feature (207)..(207): n is a, c, g, or t
  modified_base (299)..(299): a, c, t, g, unknown or other
  misc_feature (299)..(299): n is a, c, g, or t
tcagacatacgcgtcacgaccggtgctcgatttagtacacacacttagggattgggggaggaactgctcagttaggacccagacggaaccatggaagccccagcgcagcttctcttcctcctgctactctggctcccagtttcagataccactggagaaatgtgatgacgcagtctccagccaccctgtctgtntctcgaggggaangccacactctcctgcagggccagtcagagtgtagcagcagcttagcctggtacagcagaacctgaccaggctcccgagctcctcatcatggnctatcgtacggacggccagtcggtactcccccgaggtccaggttccaggtcggctggggttgggtctaggggactaggtacgttcacgtcgtacacgatacagccagccgtagcctagtccgtagtaaaccgttagttttggacctttagtttacttacctgtacagtacctaattactaactacgtgacccgtttcgtattacggtttacggaccctaaggggtaccaaggtcgaacgggaagaacttaaccgaaaacgttcgcggttaacggcctaacg

SEQ ID NO: 308940 - DNA, 605 bp, Homo sapiens
  misc_feature: GZ8MTXP02HRGFM.22.59.F04.1.454.CMB.2.raw
  modified_base (211)..(211): a, c, t, g, unknown or other
  misc_feature (211)..(211): n is a, c, g, or t
  modified_base (348)..(348): a, c, t, g, unknown or other
  misc_feature (348)..(348): n is a, c, g, or t
  modified_base (417)..(417): a, c, t, g, unknown or other
  misc_feature (417)..(417): n is a, c, g, or t
tcagacatacgcgtcacgaccggtgctcgatttagtacacacacttagggattgggggaggaactgctcagttaggacccagacggaaccatggaagccccagcgcagcttctcttcctcctgctactctggctcccagtttcagataccactggagaaatagtgatgacgcagtctccagccaccctgtctgtgtctccgaaggggaaanagccacactctcctgcagggccagtcagagtgttagcagcagcttagcctggaccagcagaacctggaccaggactccccgaggcctccctcatcgtagtggtcgctatcgtaacggacgggacctacgtaggtacncccccgagtcctaggttcaggtcggctggtgggtcgaggggacagtacgtcacctctacaccatccgancgacgctgactagtcgtagtaaagttgtttagctttaagtttattacgttcgtactaagtactaacttaaataaacttaaccgtcgtacccgttacgtacgttacggtttcggaccgtaacggggtaccaaaggtccggtaggaactaacgtaaccgtaaaacggtaccgtaggtacgtacgtaccgg

SEQ ID NO: 308941 - DNA, 740 bp, Homo sapiens
  misc_feature: GZ8MTXP02JTHVB.22.59.F04.1.454.CMB.2.raw
  modified_base (208)..(208): a, c, t, g, unknown or other
  misc_feature (208)..(208): n is a, c, g, or t
tcagacatacgcgtcacgaccggtgctcgatttagtacacacacttagggattgggggaggaactgctcagttaggacccagacggaaccatggaagccccagcgcagcttctcttcctcctgctactctggctcccagtttcagataccactggagaaatagtgatgacgcagtctccagccacctgtctgtgtctccgaggggaancgccacactctctgcagggccagtcagagtgtagcagcagtcttagccgtcggaccagaccaagaacccgtggaccacggtcctaccccgaggtcctacctcgtattccgtagtcggtcgacctacgtaccggtacggaccgggtaccctacggttacggtacctaccccccggacgtaccggtaacggttcgaagggtcgggtacggtcgggggttcgggtacgggtaggggtactaacgggttacggtttaccacccggtcctacccgtaacccgtactccgaaacggcccgtaccggtcccgtggtaccgtacggttaccgtaaggtttaacgtttagtttttacgtacggttttaactttacgtttacgttacggttaccacgttaaccttaaacgttaaacttaaacgttaaccgttccgttaacccgttacggtttacgttacgggtttaccggaccggtaaacgggtacgtacggtcgtaacggtaacgtacgtaaccgtaaacgtcgtacggtcgtacgtaccg

SEQ ID NO: 308942 - DNA, 644 bp, Homo sapiens
  misc_feature: GZ8MTXP02HTBNU.22.59.F04.1.454.CMB.2.raw
  modified_base (209)..(209): a, c, t, g, unknown or other
  misc_feature (209)..(209): n is a, c, g, or t
tcagacatacgcgtcacgaccggtgctcgatttagtacacacacttagggattgggggaggaactgctcagttaggacccagacggaaccatggaagccccagcgcagcttctcttcctcctgctactctggctcccagtttcagataccactggagaaatagtgatgacgcagtctccagccaccctgtctgtgtctccgaggggaanagccacactctcctgcagggccagtcagagtgttagcagcagctagcctggtaccagcacgaaacctggccaggcctccccgaggcctccgtcatctagtggtgcctatccgtacggacgggccctaacgtcggtactccccccgaggtcccgtaggtttccgaggttcggctacggggttcggggtaccgtgggggaacctagggtaacgttcctactcctaccaccgtatccgaggcctacgcccgtgccgtagtccgtagtaaagtttgttttacgatttagtttacttacgtgttaccagtacctaattaactaactaacgtcggtacccttacggtaccgttagggttttaccgaccggttaaacgggaccctaaggtccgttagggaacgtagtaaaccgaaacgtacggttacgtaacgggtctaccg

SEQ ID NO: 308943 - DNA, 652 bp, Homo sapiens
  misc_feature: GZ8MTXP02JN3JI.22.59.F04.1.454.CMB.2.raw
  modified_base (212)..(212): a, c, t, g, unknown or other
  misc_feature (212)..(212): n is a, c, g, or t
  modified_base (240)..(240): a, c, t, g, unknown or other
  misc_feature (240)..(240): n is a, c, g, or t
  modified_base (246)..(246): a, c, t, g, unknown or other
  misc_feature (246)..(246): n is a, c, g, or t
  modified_base (266)..(266): a, c, t, g, unknown or other
  misc_feature (266)..(266): n is a, c, g, or t
  modified_base (275)..(275): a, c, t, g, unknown or other
  misc_feature (275)..(275): n is a, c, g, or t
  modified_base (313)..(313): a, c, t, g, unknown or other
  misc_feature (313)..(313): n is a, c, g, or t
  modified_base (338)..(338): a, c, t, g, unknown or other
  misc_feature (338)..(338): n is a, c, g, or t
tcagacatacgcgtcacgaccggtgctcgatttagtacacacacttagggattgggggaggaactgctcagttaggacccagacggaaccatggaagccccagcgcagcttctcttcctcctgctactctggctcccagtttcagataccactggagaaatagtgatgacgcagtctccagcccaccctgtctgtgtctccgaaggggaaangccacactctcctgcagggccagtcagngtgtancagcagcttagcctggaccngcagaaccnggaccaggcctcccgaggcctcctcgatctagtggtcncatcgtacggacggccagtggtacncccccaggcctaggttcaggtggactgggtcgggcgtaggggactaaggtcgttccacgtcctaccgaaccctagtccgagacgtacgcccttgaaccgtgttaccgtaggtaaaggtttctttaggaaccgtttagtttaacgtttaccgtagttacccgaagttacctaaattaaacttaacgttaaccgttcggtaccccgtttacggttaaacggttcggtttaccggggaacccggtaacgggggttacccaaaggtccgtaaggggaactaacgtaacgaaaaccggtcgttcgggacggtactaccg

SEQ ID NO: 308944 - DNA, 647 bp, Homo sapiens
  misc_feature: GZ8MTXP02I5L8F.22.59.F04.1.454.CMB.2.raw
  modified_base (210)..(210): a, c, t, g, unknown or other
  misc_feature (210)..(210): n is a, c, g, or t
  modified_base (296)..(296): a, c, t, g, unknown or other
  misc_feature (296)..(296): n is a, c, g, or t
  modified_base (308)..(308): a, c, t, g, unknown or other
  misc_feature (308)..(308): n is a, c, g, or t
tcagacatacgcgtcacgaccggtgctcgatttagtacacacacttagggattgggggaggaactgctcagttaggacccagacggaaccatggaagccccagcgcagcttctcttcctcctgctactctggctcccagtttcagataccactggagaaatagtgatgacgcagtctccagccaccctgtctgtgtctccgaggggaaangccacactctcctgcagggccagtcagagtgttagcagcagcttagcctggaccagcagaacctgccaggcctccaggtcctcctnatctagtggtcnctatcgtaacggacgggcctagtggtactcccccgagcccgtaggttcgaggtcggacgtgggtcggggtcgtaggggactaggtacgtttcaccgtcctcaccctagtcgagcacgccctagcctagtcgtagtaaagttattttgacgtttaagtttacttacgtgtaccgtagtacctaacttaaattaaacgttaacgttccggtacccgtttaaccggttacgtttaaccgggtttcgggaaacccggttacgggggtaaaccctaaagggtcccgttaaggggaacgtaaacgtaaacggtaaaaccggtacgttacggtacggtacgtaccg

SEQ ID NO: 308945 - DNA, 595 bp, Homo sapiens
  misc_feature: GZ8MTXP02JYG1L.22.59.F04.1.454.CMB.2.raw
  modified_base (212)..(212): a, c, t, g, unknown or other
  misc_feature (212)..(212): n is a, c, g, or t
  modified_base (308)..(308): a, c, t, g, unknown or other
  misc_feature (308)..(308): n is a, c, g, or t
  modified_base (360)..(360): a, c, t, g, unknown or other
  misc_feature (360)..(360): n is a, c, g, or t
  modified_base (378)..(378): a, c, t, g, unknown or other
  misc_feature (378)..(378): n is a, c, g, or t
  modified_base (425)..(425): a, c, t, g, unknown or other
  misc_feature (425)..(425): n is a, c, g, or t
tcagacatacgcgtcacgaccggtgctcgatttagtacacacacttagggattgggggaggaactgctcagttaggacccagacggaaccatggaagccccagcgcagcttctcttcctcctgctactctggctcccagtttcagataccactggagaaatagtgatgacgcagtctccagcccaccctgtctgtgtctccgaggggaaagngccacactctcctgcagggccagtcagagtgtagcagcagcttagcctggaccagcagaacctggccaggcctcccgaggcctcctcatctatggngcatctacggagggccacgtggtactccccccgagcctaggttcaggtggcnggggtcgggtctggggangtagtttccactctcacctatcagcagcctgctagtctagtaagttnttttggacttagtttttacttacgttagtactagtacctaataattaactaacgtcgggtaccctttaccggtactttacgggttttacgggaccgtaacgggggtacccaacggtccgttaaggggaataacgttaaccgaaaacggtaacgtcggtacggtcgtaccg

SEQ ID NO: 308946 - DNA, 646 bp, Homo sapiens
  misc_feature: GZ8MTXP02JS5IX.22.59.F04.1.454.CMB.2.raw
  modified_base (208)..(208): a, c, t, g, unknown or other
  misc_feature (208)..(208): n is a, c, g, or t
  modified_base (470)..(470): a, c, t, g, unknown or other
  misc_feature (470)..(470): n is a, c, g, or t
tcagacatacgcgtcacgaccggtgctcgatttagtacacacacttagggattgggggaggaactgctcagttaggacccagacggaaccatggaagccccagcgcagcttctcttcctcctgctactctggctcccagtttcagataccatggagaaatagtgatgacgcagtctccagccaccctgtctgtgtctccgaggggaangccaacactctcctgcagggccagtcagtagtgttagcagcagcttagcctggtaccagcagaaacctggccgaggtcctacccgagtcctaccgtcatctatggtgactatcgtacgacggtaccacgtcgtactcccccgagtccgtacggttcacggtcggacctagggtcgggtacgttacggggactaggtacgtttccgactcgtacctacgactacacgctaggacctgacgtacgtccgtaggtaaaccgtttnttacgggtacttaaacggtttacttaccggtacgttacaacggtacctaaaccgttaattaaccggtacttcggaccctttacgtacgttagtttacggaacccgggttaaggacccgtaaggtacgtacggaacgtaaacgtaaccgtaaaacgtacgttacggcgtaaccgtcg

SEQ ID NO: 308947 - DNA, 578 bp, Homo sapiens
  misc_feature: GZ8MTXP02FMYAW.22.59.F04.1.454.CMB.2.raw
  modified_base (210)..(210): a, c, t, g, unknown or other
  misc_feature (210)..(210): n is a, c, g, or t
  modified_base (309)..(309): a, c, t, g, unknown or other
  misc_feature (309)..(309): n is a, c, g, or t
  modified_base (418)..(418): a, c, t, g, unknown or other
  misc_feature (418)..(418): n is a, c, g, or t
tcagacatacgcgtcacgaccggtgctcgatttagtacacacacttagggattgggggaggaactgctcagttaggacccagacggaaccatggaagccccagcgcagcttctcttcctcctgctactctggctcccagtttcagataccactggagaaatagtgatgacgcagtctccagccaccctgtctgtgtctccgaggggaaanagccacactctcctgcagggccagtcagagtgtagcagcagcttagcctggtaccagcagaacctggccaggcctcccaggcctcctcatctagtggtncatccgtacggagggccagtggtactccccccgagcccaggttcaggtcggctagggtcgggtcgtggggacctaggtacgtttcactctccaccactcagcacgcctncagtctagtaagttatttgcttagtttacttactgtacagtactataattaaactacgtacggtacctaccgttactacggtttacggaccggtacggggtaccgtaacggcgttagggaacgtaacgtaacgaaaacgtaacgtacggtacggcgtacg

SEQ ID NO: 308948 - DNA, 544 bp, Homo sapiens
  misc_feature: GZ8MTXP02GTGD9.22.59.F04.1.454.CMB.2.raw
  modified_base (210)..(210): a, c, t, g, unknown or other
  misc_feature (210)..(210): n is a, c, g, or t
  modified_base (267)..(267): a, c, t, g, unknown or other
  misc_feature (267)..(267): n is a, c, g, or t
  modified_base (320)..(320): a, c, t, g, unknown or other
  misc_feature (320)..(320): n is a, c, g, or t
  modified_base (357)..(357): a, c, t, g, unknown or other
  misc_feature (357)..(357): n is a, c, g, or t
tcagacatacgcgtcacgaccggtgctcgatttagtacacacacttagggattgggggaggaactgctcagttaggacccagacggaaccatggaagccccagcgcagcttctcttcctcctgctactctggctcccagtttcagataccactggagaaatagtgatgacgcagtctccagccaccctgtctgtgtctccgaggggaaanagccacactctcctgcagggccagtcagagtgttagcagcagcttagcctggtaccngcagaaacctggccaggcctcccgaggcctcctcatctatggtgcatcacggngggccacgtggtactcccccagcctaggtcagtggcnggtgggtctggggacagacgttcactctcaccatcagcacgcctgcagtctagtaagtagtttgacttagtttattacgtgtaccagtctaactataataacgtggtaccctaccgtactagtttcggaccgtacggggtaccagcgtaggaacgtacgtaacgaaacgtacgtaggtcgacgtacg

SEQ ID NO: 308949 - DNA, 610 bp, Homo sapiens
  misc_feature: GZ8MTXP02HW55Z.22.59.F04.1.454.CMB.2.raw
  modified_base (211)..(211): a, c, t, g, unknown or other
  misc_feature (211)..(211): n is a, c, g, or t
  modified_base (276)..(276): a, c, t, g, unknown or other
  misc_feature (276)..(276): n is a, c, g, or t
  modified_base (295)..(295): a, c, t, g, unknown or other
  misc_feature (295)..(295): n is a, c, g, or t
  modified_base (306)..(306): a, c, t, g, unknown or other
  misc_feature (306)..(306): n is a, c, g, or t
  modified_base (362)..(362): a, c, t, g, unknown or other
  misc_feature (362)..(362): n is a, c, g, or t
  modified_base (401)..(401): a, c, t, g, unknown or other
  misc_feature (401)..(401): n is a, c, g, or t
tcagacatacgcgtcacgaccggtgctcgatttagtacacacacttagggattgggggaggaactgctcagttaggacccagacggaaccatggaagccccagcgcagcttctcttcctcctgctactctggctcccagtttcagataccactggagaaatagtgatgacgcagtctccagccaccctgtctgtgtctccgaaggggaaangccacactctcctgcagggccagtcagagtgttagcagcagcttagcctgtaccagcaagaaccngccaggcctccagctcctnatctagtggtnactatcgtaggacggcctagtcggtactcccccgagtcccgtaggtcaggtcgacngggtcgggtacagggactagtacgtcacgtcaccactanacgacgcaggccctgacgtagtcgtaagtaagtttacttagtacttttagttaacttacgtagtacaacgtacttaaagtaaacttaaacgtacgtcgtaacccgtttaccgttaacggttacggttaccggaccggtaaacgggaacctacggtacggtaaggaacgtaaaccgaaaacggtaaacgtacgtcggtacgtacgtaacg

SEQ ID NO: 308950 - DNA, 683 bp, Homo sapiens
  misc_feature: GZ8MTXP02GVY45.22.59.F04.1.454.CMB.2.raw
  modified_base (210)..(210): a, c, t, g, unknown or other
  misc_feature (210)..(210): n is a, c, g, or t
  modified_base (316)..(316): a, c, t, g, unknown or other
  misc_feature (316)..(316): n is a, c, g, or t
tcagacatacgcgtcacgaccggtgctcgatttagtacacacacttagggattgggggaggaactgctcagttaggacccagacggaaccatggaagccccagcgcagcttctcttcctcctgctactctggctcccagtttcagataccactggagaaatagtgatgacgcagtctccagccaccctgtctgtgtctccgaggggaaangccacactctcctgcgagggccagtcagagtgtagcagcagcttagcctggtaccagcaagaaacctggacctaggcctcccgaggccctcctcattctagtgggnactagtcgtaacggcggggcctacgttcgggtacctcccccgaaggtcccgtagggtttaccgagggtaccggtcgtagggggttcggggtcgtaacgggggtactaacgggtacggttacctacctaccgtacaacccgtacgtacacgtacgacgtccgtcgtacgtacgtacgtagtaaacgttatttacggtaactttagtttacttacgtagttaccgatactaaactaaataacgtttaacgtaccgtcccttacggttacgttacggtttacggaaccggtaaacggggtaccgtaacggacggttacgaaacgtacgttaaacccgaaaacggtacgttacggtacgggtactaaccgg

SEQ ID NO: 308951 - DNA, 651 bp, Homo sapiens
  misc_feature: GZ8MTXP02H0EMO.22.59.F04.1.454.CMB.2.raw
  modified_base (212)..(212): a, c, t, g, unknown or other
  misc_feature (212)..(212): n is a, c, g, or t
tcagacatacgcgtcacgaccggtgctcgatttagtacacacacttagggattgggggaggaactgctcagttaggacccagacggaaccatggaagccccagcgcagcttctcttcctcctgctactctggctcccagtttcagataccactggagaaatagtgatgacgcagtctccagcccaccctgtctgtgtctccgagggggaaangccacactctcctgcagggccagtcaggagtgttagcagcagtcttagcctggtaccagcaagaaaccgtggaccaggcctccccgaggtcctcctcatctagtggtgctagtcgacgacggtccacgtgtactccccacgtccgtaggttcaggtcggcgtggggtggggtcgtagggggactagggtacgtttacaccttaccacaacctatccgacgccgtacggccctggaccgttaggtccgtaaggttaaattacgtttttagaccgtttagttttacttacgttcgtaacgatactaacgtaaattaacgtacgtcgtaccctttacgtacgtttagggtttacggaccggtacggggaccctaaggggtcgttaacgggaacgtaacgtaaaccggttaaaaccggtaggttacggttacggacttaccgg

SEQ ID NO: 308952 - DNA, 678 bp, Homo sapiens
  misc_feature: GZ8MTXP02G7QYD.22.59.F04.1.454.CMB.2.raw
tcagacatacgcgtcacgaccggtgctcgatttagtacacacacttagggattgggggaggaactgctcagttaggacccagacggaaccatggaagccccagcgcagcttctcttcctcctgctactctggctcccagtttcagataccactggagaaatagtgatgacgcagtctccagccaccctgtctgtcgtctccgaaggggaaagacgccacactctcctgcgagggccagtcagtagtgtagcagcagtcttacgcctggtaccagacaacgaaaccgtggacccacggacctcccgaggtcccttcccgtactaacttctagttcggtacgctacgtaccgtaccggacggtcccgtacgtcggtaccacccccgtagtcccgtaggtcgacgggttacggcgtaggggtcggggtcgtaggggtacaggttacgtcgactcgtcactatcgaagtcgagtcccgtagtccgtaagtcgttaagaaagtttcgtttacggtactttaagttttattactacggtactaacgtacttaaaccgtaattaaacgtaccgtcgtacccgtttacggttaacgttccggggtttaaccggaccggtaaacggggtactaacggtacgttacgggaataaacgttaacgaaacgtagtttcggacgtcgtaccg

SEQ ID NO: 308953 - DNA, 584 bp, Homo sapiens
  misc_feature: GZ8MTXP02JA5D1.22.59.F04.1.454.CMB.2.raw
  modified_base (209)..(209): a, c, t, g, unknown or other
  misc_feature (209)..(209): n is a, c, g, or t
  modified_base (295)..(295): a, c, t, g, unknown or other
  misc_feature (295)..(295): n is a, c, g, or t
tcagacatacgcgtcacgaccggtgctcgatttagtacacacacttagggattgggggaggaactgctcagttaggacccagacggaaccatggaagccccagcgcagcttctcttcctcctgctactctggctcccagtttcagataccactggagaaatagtgatgacgcagtctccagccaccctgtctgtgtctcgaggggaaangccacactctcctgcagggccagtcagagtgttagcagcagcttagcctgaccagcagaacctggccaggcctccgaggcctcctnatctagtggtgcatcgtacggacggtcctaatcggtactccccgagtaccgtagttccaggtcgacgtgggtcgggtcgtagggactaggtactcgtactccgtacacactacacgcacgcctgcgtagtactagtaacgttgtttacgactttaagtttacttacgttgtacgtacgtactaacgttaataaacgttacgtcggtacccttacggtaacgttcggttacggaccgtaacgggacctaaggcgtagaagtacgtaacgaaacgtgtacgtacgctaacg

SEQ ID NO: 308954 - DNA, 638 bp, Homo sapiens
  misc_feature: GZ8MTXP02FGPLA.22.59.F04.1.454.CMB.2.raw
  modified_base (211)..(211): a, c, t, g, unknown or other
  misc_feature (211)..(211): n is a, c, g, or t
  modified_base (349)..(349): a, c, t, g, unknown or other
  misc_feature (349)..(349): n is a, c, g, or t
tcagacatacgcgtcacgaccggtgctcgatttagtacacacacttagggattgggggaggaactgctcagttaggacccagacggaaccatggaagccccagcgcagcttctcttcctcctgctactctggctcccagtttcagataccactggagaaatagtgatgacgcagtctccagccaccctgtctgtgtctccgaaggggaaancgccacactctcctgcagggccagtcagagtgtagcagcagcttagcctggtaccagcagaacctggaccaggcctaccgaggtcctccactatcgtagtggtcgacaagtccgtacgggacggccagttcgggtacnccccccgagcccgaggttcaggttcggcgtacggggtcggggtactgggggaactaggtacgtttacccacgtcctacacctatcagcgacgcctgacgtgtacgtagtaaaggtttatttaggtacttagttttaacttaccgttagtacctaagtacctaaacgttaaactaaacgttaaaccgttcggtacccgttaccggttacgttacgggtttacggaccggttaacggggaccgtaaacgcgtaggaacgtaactaacgaaacgtacgtcggacgtctaacg

SEQ ID NO: 308955 - DNA, 655 bp, Homo sapiens
  misc_feature: GZ8MTXP02IZDNU.22.59.F04.1.454.CMB.2.raw
  modified_base (209)..(209): a, c, t, g, unknown or other
  misc_feature (209)..(209): n is a, c, g, or t
  modified_base (214)..(214): a, c, t, g, unknown or other
  misc_feature (214)..(214): n is a, c, g, or t
tcagacatacgcgtcacgaccggtgctcgatttagtacacacacttagggattgggggaggaactgctcagttaggacccagacggaaccatggaagccccagcgcagcttctcttcctcctgctactctggctcccagtttcagataccactggagaaatagtgatgacgcagtctccagccaccctgtctgtgtctccgaggggaangccanactctcctgcagggccagtcagagtgttagcagcagtcttagcctggaccagcagaacctggaccaggcctcccgaggtcctccgtacattccgtatggtcgctagtccgtacggacgggtccctagtcggtaactcccccccgaagcccgtagggtttccaggttcggacctaggggtcggggtactagggggacctggtacgttaccacgtctaccgacctatcgaacgtcgagtcctagaccgtaaggtctagtaacggttattttacgacgtttaagttttacctacgttaggttaccacggttacacgttaataacgttactaccgggttacctaccggttaacttagggtttcggaacccggttaggggacctaaacggtccgttaagggaactaacgtaaccgaaacggttacgtccggtaggtacccttacgg

SEQ ID NO: 308956 - DNA, 742 bp, Homo sapiens
  misc_feature: GZ8MTXP02FGUZD.22.59.F04.1.454.CMB.2.raw
  modified_base (209)..(209): a, c, t, g, unknown or other
  misc_feature (209)..(209): n is a, c, g, or t
tcagacatacgcgtcacgaccggtgctcgatttagtacacacacttagggagttgggggaggaactgctcagttaggacccagacggaaccatggaagccccagcgcagcttctcttcctcctgctactctggctcccagtttcagataccactggagaaatgtgatgacgcagtctccagccacctgtctgtgtctccgaggggaaancgccacactctcctgcagggccagtcagagtgtagcagcagcttagcctggtaccagtcaacgaacctggaccaaggcctaccgaggtccctcgtactaacttcgtaagtcggtcgactagtccgtacgggacgggtccaaggttcggtaacctcccccggagtacccgaggtttaccaggttacggccgtaggggtcggggtaccttagggggacctagggtacggtttaccaccgttaccgttaccaaacccgtactacgtacgtaccgacgcccgttacgggaccctaggttaaccgtagggttaaacgtttagtttacgggtaaccgttatttttaacgtacccgggttatacccggtaacgttacgttaaccgttaaataaacggttaacccgtttacgggtaaccccttaccggttaaacggtttaacgggttttaccggaaccgggttaaacggggacccgtaaaacggtccggttaaggaacggtaacttacgaaaaaccgtcgttaacgggacgtcggtaaccg

SEQ ID NO: 308957 - DNA, 530 bp, Homo sapiens
  misc_feature: GZ8MTXP02GHVJE.22.59.F04.1.454.CMB.2.raw
  modified_base (210)..(210): a, c, t, g, unknown or other
  misc_feature (210)..(210): n is a, c, g, or t
  modified_base (290)..(290): a, c, t, g, unknown or other
  misc_feature (290)..(290): n is a, c, g, or t
  modified_base (303)..(303): a, c, t, g, unknown or other
  misc_feature (303)..(303): n is a, c, g, or t
  modified_base (444)..(444): a, c, t, g, unknown or other
  misc_feature (444)..(444): n is a, c, g, or t
tcagacatacgcgtcacgaccggtgctcgatttagtacacacacttagggattgggggaggaactgctcagttaggacccagacggaaccatggaagccccagcgcagcttctcttcctcctgctactctggctcccagtttcagataccactggagaaatgtgatgacgcagtctccagccaccctgtctgtgtctccaagggggaaangccacactctcctgccagggccagtcagagtgtagcagcagcttagcctgaccagcagaacctggccaggcctccagccnctcatctatggtnctatctagagggccagtcggtactccccgagccgaggttccaggtgacgtggtcgggtctaggggacctagtacgtttcacgtctacaccatcagcacgcctgcagtctagactagtttgctagtttagtactgtcacgtntaactataaataacgtcgaccgtcgtaactggtttcgaccgtaggggacctagctaggaacgatacgaaaacacgtgtacggctag

SEQ ID NO: 308958 - DNA, 504 bp, Homo sapiens
  misc_feature: GZ8MTXP01CU2AI.4.10.A10.1.454.CMB.2.raw
  modified_base (361)..(361): a, c, t, g, unknown or other
  misc_feature (361)..(361): n is a, c, g, or t
  modified_base (466)..(466): a, c, t, g, unknown or other
  misc_feature (466)..(466): n is a, c, g, or t
  modified_base (478)..(478): a, c, t, g, unknown or other
  misc_feature (478)..(478): n is a, c, g, or t
  modified_base (502)..(504): a, c, t, g, unknown or other
  misc_feature (502)..(504): n is a, c, g, or t
tcagagcactgtagcacgaccggtgctcgatttagcgtcgatctcaggggtccctgagactctcctgtgcagcctctggattcaccttcacctcgtatagcatgacctgggtccgccaggctccagggaaggggctggagtgggtctcatccattggtactggtagtccttacatatactacttagactcagtgaggggccgattctccatctccagagacgactccaagaactcagtgtatctgcacatggacagcctgagagccgaggacacggctgtgtatttctgtgggaggtctccgggtggtgctgagaaacggcgttgacttctgggggccagggaaccctgggtcaaccgtcncctcagcctcaccaagggcccatcgtctcccctggcgccctgctccaggacgcacctcgagagcacacgcggccctgggctgcctggtcaaggctactccctaangttgcttcgtgngcgggcttgggcaggcgcattagnnn

SEQ ID NO: 308959 - DNA, 528 bp, Homo sapiens
  misc_feature: GZ8MTXP01AG3ER.4.10.A10.1.454.CMB.2.raw
  modified_base (484)..(484): a, c, t, g, unknown or other
  misc_feature (484)..(484): n is a, c, g, or t
  modified_base (511)..(511): a, c, t, g, unknown or other
  misc_feature (511)..(511): n is a, c, g, or t
tcagagcactgtagcacgaccggtgctcgatttagcgtcgatctcaggggggtagagaagacaggactcaggacaatctccagcatggccagcttccctctcctcctcaccctcctcactcactgtgcagggtcctgggcccactctgtgctgactcagccaccctcagcgtctgggacccccggcagaggtcaccatctcttgtctggaagcacctccaacatcggaagtaattctgtaaactggttccagcaactcccaggaacgggcccccaaagtcctcatctatggtcagaatcagcgtcccctgacgggggtcccctgacccgattctctggctccaagtcctgacacctcagccctccctggcccatcagtcgggctcagtctgaggatgaggctgattattactgtgcaacagtgggggatgacacgtccgtacgtggtgcggtgttcggcggagggcctaaggtcgaccggtcgngggtcagcccgaggctcgcccctggcncttctcgttcccgtccc

SEQ ID NO: 308960 - DNA, 609 bp, Homo sapiens
  misc_feature: GZ8MTXP01ALW3B.4.10.A10.1.454.CMB.2.raw
  modified_base (190)..(190): a, c, t, g, unknown or other
  misc_feature (190)..(190): n is a, c, g, or t
  modified_base (286)..(286): a, c, t, g, unknown or other
  misc_feature (286)..(286): n is a, c, g, or t
tcagagcactgtagcacgaccggtgctcgatttagcgtcgatctcagggggggtagagaagacaggactcaggacaatctccagcatggccagcttccctctcctcctcaccctcctcactcactgtgcagggtcctgggcccactctgtgctgactcagcccaccctcagcgtcgtcgggacccccggnaggaggtcaccatctcttgtctggaagcacctccaacatcggaagtaatcctagtaaactggtccagcaactccgaggaacggccccaaagtcctnatctatggtcagaatcagccgtccctcgacgggggtcccctggacccgattctcgtcggctccaagtccctgacaccctcacgccctcccgtgccatcaggtcgggctcgagtctagaggatgaggctagtattatactgtgacaacagtgggggattgactacgttcccgtaggtgggtggtcggggttggttccggggacgggtaacgggacctaagggttcgacccggtccggttcggggtccgacggccccgaagggttcccgtcccggtcccccgtcgggttcccaccgttcccgttcccgttcccccgtaacccccg

SEQ ID NO: 308961 - DNA, 602 bp, Homo sapiens
  misc_feature: GZ8MTXP01D7NQ4.4.10.A10.1.454.CMB.2.raw
  modified_base (189)..(189): a, c, t, g, unknown or other
  misc_feature (189)..(189): n is a, c, g, or t
tcagagcactgtagcacgaccggtgctcgatttagcgtcgatctcgagggggggtagagaagacaggactcaggacaatctccagcatggccagcttccctctcctcctcaccctcctcactcactgtgcagggtcctgggcccactctgtgctgactcagccaccctcagcgtctcgggacccccggnagaggtcaccatctcttgtctggaagcacctccaacatcgaagtaatcctagtaaactggttccagcaactcccaggaacggccccaaagtcctcatctatggtcagaatcacgcgtcccctcgacggggtcccctgacccgtattcctctcggctccaagtccctagacacccgtcacgccctccctggcctatcagtgggctccgagtctgaggatgagctagtatttatactgtcgacaaacgtagtgggggattggaactacgtccgtaggtggtggtcggttggtcggggacggtacgggaacctaaggttcgacccggttccgttggggtaccacggaccccgttaagggcccttaacccggccccccttggtcccacttccgttaacccgttcccccgtaaccccg

SEQ ID NO: 308962 - DNA, 570 bp, Homo sapiens
  misc_feature: GZ8MTXP01DVH30.4.10.A10.1.454.CMB.2.raw
  modified_base (285)..(285): a, c, t, g, unknown or other
  misc_feature (285)..(285): n is a, c, g, or t
  modified_base (361)..(361): a, c, t, g, unknown or other
  misc_feature (361)..(361): n is a, c, g, or t
  modified_base (434)..(434): a, c, t, g, unknown or other
  misc_feature (434)..(434): n is a, c, g, or t
  modified_base (442)..(442): a, c, t, g, unknown or other
  misc_feature (442)..(442): n is a, c, g, or t
  modified_base (551)..(551): a, c, t, g, unknown or other
  misc_feature (551)..(551): n is a, c, g, or t
tcagagcactgtagcacgaccggtgctcgatttagcgtcgatctcagggggggtagagaagacaggactcaggacaatctccagcatggccagcttccctctcctcctcaccctcctcactcactgtgcagggtcctgggcccactctgtgctgactcagccaccctcagcgtcgtgggaccccccgggcagagggtcaccatctcttgttctggaagcacctccaacatcggaagtaatcctgtaaactggttccagcaactccaggacggccccaaagtcctnatctatggtcagaaatcagccgtcccctcgagggggtcccctgacccgtattcctctcggctccaagtcctgaacnccctcacgtcccctccctcgggaccatccaggtcgggcctccagtctgaggatggaggtctagtattattacngtgacaangtgggggaattggaactactccgtagtgggtgtcgggttgttcggggcggtaacgggcctaaggttcgaccgtcgttgggtcacgccgaggctccgccccgtcggtacncttctccgttcccgtcccc

SEQ ID NO: 308963 - DNA, 545 bp, Homo sapiens
  misc_feature: GZ8MTXP01CYZBA.4.10.A10.1.454.CMB.2.raw
  modified_base (259)..(259): a, c, t, g, unknown or other
  misc_feature (259)..(259): n is a, c, g, or t
  modified_base (418)..(418): a, c, t, g, unknown or other
  misc_feature (418)..(418): n is a, c, g, or t
  modified_base (496)..(496): a, c, t, g, unknown or other
  misc_feature (496)..(496): n is a, c, g, or t
  modified_base (508)..(508): a, c, t, g, unknown or other
  misc_feature (508)..(508): n is a, c, g, or t
  modified_base (536)..(536): a, c, t, g, unknown or other
  misc_feature (536)..(536): n is a, c, g, or t
  modified_base (539)..(539): a, c, t, g, unknown or other
  misc_feature (539)..(539): n is a, c, g, or t
  modified_base (541)..(541): a, c, t, g, unknown or other
  misc_feature (541)..(541): n is a, c, g, or t
  modified_base (543)..(543): a, c, t, g, unknown or other
  misc_feature (543)..(543): n is a, c, g, or t
  modified_base (545)..(545): a, c, t, g, unknown or other
  misc_feature (545)..(545): n is a, c, g, or t
tcagagcactgtagcacgaccggtgctcgatttagcgtcgatctcaggggtccctgagactctcctgtgcagcctctggattcaccttcacctcgtatagcatgacctgggtccgccaggctccgagggaaggggctggagtgggtctcatccattggtactggtagtccttacatatactacttagactcagtgaggggccattctccatctccagagacgactccaagaactcagtgtatctgcacatggacagccngagagccgaggacacggctgtgtatttcgtggtgggagtcgtccggtggtcgctggaagaaacggtcgttgacttcgtcggggccagggaccctggtccaacccgtctcctcacgccctacccaccgaacgggcccagtccggtccctccccgtggccnccctgctccgaggcgccaccgtcgagcgcgacgacggccgcccgtggctcgctcggctaaggccttaccgtcctaacngcgtcttcgtgnggcgggcttcgggaacgaacgggccganagngngngn

SEQ ID NO: 308964 - DNA, 642 bp, Homo sapiens
  misc_feature: GZ8MTXP01DISIJ.4.10.A10.1.454.CMB.2.raw
  modified_base (192)..(192): a, c, t, g, unknown or other
  misc_feature (192)..(192): n is a, c, g, or t
  modified_base (609)..(609): a, c, t, g, unknown or other
  misc_feature (609)..(609): n is a, c, g, or t
tcagagcactgtagcacgaccggtgctcgatttagcgtcgatctcgagggggggtagagaagacaggactcaggacaatctccagcatggccagcttccctctcctcctcaccctcctcactcactgtgcagggtcctgggcccactctgtgctgactcagccaccctcagcgtcgtcgggaccccccgggnaggaggtcaccatctcttgttctggaagcacctccaacatcggaagtaatcctagtaaactggttccagcaactcccgaggaacggcccccaaagtccctacatctatggtacagaaatcacgccgtccccgtcgacgggggtcccctagacccgtacttctcgtcggctaccaagtccctgacacctcacgccctccctggccatccgagtcgggctcgagtctgaggatgaggctagtatttatacgtgtcgaccaaagtagttaggggggattacggaactaacgtcccgttaggtggtgggtccggggttggttcggggcggggaaacgggtaccctaaagggtttcggacccggttcgttcgggtaccaacgcccggaacgggccttcccggccccccgttgggttaacccnccttcccggttccgtttaaccccccccgtcccg

SEQ ID NO: 308965 - DNA, 582 bp, Homo sapiens
  misc_feature: GZ8MTXP01D05IG.4.10.A10.1.454.CMB.2.raw
  modified_base (205)..(205): a, c, t, g, unknown or other
  misc_feature (205)..(205): n is a, c, g, or t
  modified_base (257)..(257): a, c, t, g, unknown or other
  misc_feature (257)..(257): n is a, c, g, or t
  modified_base (439)..(439): a, c, t, g, unknown or other
  misc_feature (439)..(439): n is a, c, g, or t
  modified_base (578)..(578): a, c, t, g, unknown or other
  misc_feature (578)..(578): n is a, c, g, or t
  modified_base (580)..(580): a, c, t, g, unknown or other
  misc_feature (580)..(580): n is a, c, g, or t
  modified_base (582)..(582): a, c, t, g, unknown or other
  misc_feature (582)..(582): n is a, c, g, or t
tcagagcactgtagcacgaccggtgctcgatttagcgtcgatctcaggggtccctgagactctcctgtgcagcctctggattcaccttcacctcgtatagcatgacctgggtccgccaggctccagggaaggggctggagtgggtctcatccattggtactggtagtccttacatatactacttagactcagtgagggccattcnccatctccagagacgactccaagaactcagtgtatctgcacatggacagccngagagccgaggacacggctgtgtatttcgtggtgggagtcgtcggtggtgctgaagaacggcgttgacttcgtcggggccacgggaccctggtccaacccgttctcccgtcacgcccctaccaccgaacggggcccctagtcccggtccttcccccgtggcccgtccctgccctccgaggcnccacccgtcgagacgcgacgacggcccggcccgtcggggcctcggccgtcgggtacctaaacggtaccttaccttccccgtaactcgttcgccgttcgtgggacggccggggttcttcgggaaccgaagggcgcagagngngn

SEQ ID NO: 308966 - DNA, 605 bp, Homo sapiens
  misc_feature: GZ8MTXP01BLMH4.4.10.A10.1.454.CMB.2.raw
  modified_base (217)..(217): a, c, t, g, unknown or other
  misc_feature (217)..(217): n is a, c, g, or t
  modified_base (288)..(288): a, c, t, g, unknown or other
  misc_feature (288)..(288): n is a, c, g, or t
  modified_base (340)..(340): a, c, t, g, unknown or other
  misc_feature (340)..(340): n is a, c, g, or t
  modified_base (356)..(356): a, c, t, g, unknown or other
  misc_feature (356)..(356): n is a, c, g, or t
  modified_base (408)..(408): a, c, t, g, unknown or other
  misc_feature (408)..(408): n is a, c, g, or t
tcagagcactgtagcacgaccggtgctcgatttagcgtcgatctcaggggggtagagaagacaggactcaggacaatctccagcatggccagcttccctctcctcctcaccctcctcactcactgtgcagggtcctgggcccactctgtgctgactcagccaccctcagcgtcgtcgggacccccgggcaggaggtcaccatctcttgttctggaancacctcaacatcggaagtaatcctagtaaactggttccagcaactcccgaggaacggccccaaagtccctnatctatggtcagaatcacgccgtccctcgacggggtccctagacccgattcncgtggctcaagtcccngacacctcacgtccctccctggcctatcgacggtcgggctcgagtctgaggntcggagctagtattattactgtgacaacgtaggtggggattaggactacttccgtaacgttgggtcgtcgggttgttcgggacgggacgggtaaccgtaacggttcggacccggttcggttcgggtaccgacggttcccgaacgggttccctccgacccccgttcggtcccgacgttccgtccgtttcccgtccccg

SEQ ID NO: 308967 - DNA, 687 bp, Homo sapiens
  misc_feature: GZ8MTXP01CQNBM.4.10.A10.1.454.CMB.2.raw
  modified_base (223)..(223): a, c, t, g, unknown or other
  misc_feature (223)..(223): n is a, c, g, or t
tcagagcactgtagcacgaccggtgctcgatttagcgtcgatctcagggggggtagagaagacaggactcaggacaatctccagcatggccagcttccctctcctcctcaccctcctcactcactgtgcagggtcctgggcccactctgtgctgactcagccaccctcagcgtcgtcgggaccccggcagaggtcaccatctctgttctggaagcacctcaanatacgaatatcctagtaactggtcagcaactccgaggacggccccaaagtcctcatctatggtcagaatcagcgtccctcgacggggtccctgacccgtattctcgtgctaccaagtccctgactctcacgccctccctggcctagtccgaggtcgggctccgagtcgtaggaggtactggacggtcgtagttatttaagtttaccgtggttacgaacgaaacgtaggtggggggtaacttaggtaacctacgttcccggttaacggttgggggttacgggtccgggggtttacggggttccgggggaccggggtaacggggtaacccggtaaagggtttaccgggttaacccgggttccgggttcggggttacccgaacgggttaccccgacgggttcccgttaacccggccccccggttgggtcccctaccgttcccgttccccggttccccctaacccccg

SEQ ID NO: 308968 - DNA, 290 bp, Homo sapiens
  misc_feature: GZ8MTXP01DFZ5F.4.10.A10.1.454.CMB.2.raw
  modified_base (289)..(290): a, c, t, g, unknown or other
  misc_feature (289)..(290): n is a, c, g, or t
tcagagcactgtagcacgaccggtgctcgatttagcgtcgatctcaggggtccctgaccgattctctggctccaagtctgacacctcagcctccctggccatcagtgggctccagtctgaggatgaggctgattattactgtgcaacatgggatgacatcctacgtggtgcggtgttcggcggaggaccaagttgaccgtcctgggtcagcccaaggctcgcccctcggtcactctcgttccccaccctcctcctacagtgctctgagcgggctggcaaggcgcatagnn

SEQ ID NO: 308969 - DNA, 737 bp, Homo sapiens
  misc_feature: GZ8MTXP01CC0GB.4.10.A10.1.454.CMB.2.raw
  modified_base (193)..(193): a, c, t, g, unknown or other
  misc_feature (193)..(193): n is a, c, g, or t
tcagagcactgtagcacgaccggtgctcgatttagcgtcgatctcgagggggggtagagaagacaggactcaggacaatctccagcatggccagcttccctctcctcctcaccctcctcactcactgtgcagggtcctgggcccactctgtgctgactcagcccaccctcagcgtcgtcggggacccccgggnaggaggtcaccatctcttgttctggaagccacctccaacatacggaagtatcctagtaaactggttaccagcaactcccaggaacggcccccaaagtccctacatctagtggtcaagaaatcgacgtccgtacccctcggacgggggtcccctggaaccccgtatttcctcgttggcctaccgaagtccctacgactacctccacggtcccttccccgtggaccctacgtccgaggtcggggcccttccgagtccgtggaaggagtcgggaaggtcgttagttaatttagttaccgtggtacgaacctaaagtaggttaggggggaattacggaacctacgttaccgtaacgggttggggtcggtaccggggttgggttccggggacgggtaacgggaaccccggtaaagggtttccgggaaccccggttcccgggttggggtaccgaaccggttcccggaaacgggttccccgtcccggtacccccccggttcggggtacccttacccggttccctttcccggtttccccccgttaacccccg

SEQ ID NO: 308970 - DNA, 585 bp, Homo sapiens
  misc_feature: GZ8MTXP01AVZX9.4.10.A10.1.454.CMB.2.raw
  modified_base (258)..(258): a, c, t, g, unknown or other
  misc_feature (258)..(258): n is a, c, g, or t
  modified_base (580)..(580): a, c, t, g, unknown or other
  misc_feature (580)..(580): n is a, c, g, or t
  modified_base (582)..(582): a, c, t, g, unknown or other
  misc_feature (582)..(582): n is a, c, g, or t
  modified_base (584)..(584): a, c, t, g, unknown or other
  misc_feature (584)..(584): n is a, c, g, or t
tcagagcactgtagcacgaccggtgctcgatttagcgtcgatctcaggggtccctgagactctcctgtgcagcctctggattcaccttcacctcgtatagcatgacctgggtccgccaggctccagggaaggggctggagtgggtctcatccattggtactggtagtccttacatatactacttagactcagtgaggggccattctccatctccagagacgactccaagaactcagtgtatctgcacatggacagccngagagccgaggacacggctgtgtatttctggtgggaggtctcggtggtgctgagaacggcgttgacttcgtcggggccaggggaaccctgggtccaaccgtctccgtcacgccctaccaccgaacggggcccagtccggtccttcccccgtggccgcccctgcctccgaggacgccacctcgagcgcgacgacggccggcccgtgggcctcggcccgtacgggtacctaaacgggtaccttacccgttccccgtaactacggttcgtccgttccgtgggacggccgggggccttacggggccgaagggccgacgagttaggngngng

SEQ ID NO: 308971 - DNA, 658 bp, Homo sapiens
  misc_feature: GZ8MTXP01B10EQ.4.10.A10.1.454.CMB.2.raw
tcagagcactgtagcacgaccggtgctcgatttagcgtcgatctcagggggggtagagaagacaggactcaggacaatctccagcatggccagcttccctctcctcctcaccctcctcactcactgtgcagggtcctgggcccactctgtgctgactcagccaccctcagcgtcgtcgggacccccggcaggacggtcaccatctcttgttctggaagccacctccaacatcggaataactcctagtaaactggttccagcaactcccgaggaacggccccaaagtcctcatctatggtcagaatcagccgtccctcgacggggtcccctgaccgtattctctggctccaagtcctcgacacctcacgtcccctcctcggccatcgaggtcgggctccgagttctggaggagtgaggtcttaggtaatttacttacgtgtagactaaactaggttggggggaattcggaacctacgttacccgttacgggttgggttcggtccgggggttcggttccgggggacgggtaacgggggtacccgtaaagggtttcggaacccggttcccggttgggtacccgaccggaccccgttaagggttcccgtcccggtcccccgtcgggttccaccgtttcccgtcccgtttcccccgtaacccc

SEQ ID NO: 308972 - DNA, 557 bp, Homo sapiens
  misc_feature: GZ8MTXP01EX7KF.4.10.A10.1.454.CMB.2.raw
  modified_base (188)..(188): a, c, t, g, unknown or other
  misc_feature (188)..(188): n is a, c, g, or t
  modified_base (225)..(225): a, c, t, g, unknown or other
  misc_feature (225)..(225): n is a, c, g, or t
  modified_base (282)..(282): a, c, t, g, unknown or other
  misc_feature (282)..(282): n is a, c, g, or t
  modified_base (540)..(540): a, c, t, g, unknown or other
  misc_feature (540)..(540): n is a, c, g, or t
tcagagcactgtagcacgaccggtgctcgatttagcgtcgatctcagggggggtagagaagacaggactcaggacaatctccagcatggccagcttccctctcctcctcaccctcctcactcactgtgcagggtcctgggcccactctgtgctgactcagccaccctcagcgtctcgggacccccggnagaggtcaccatctcttgttctggaagcacctccaanatcggaataatcctgtaaactggttccagcaactccaggacggcccccaaagtcctnatctatggtcagaatcagccgtccctcgagggggtcccctgacccgtatttcctctggcctccaagtccctgacacctcacgccctccctggcccatcagtcgggctccagtctgaggatgaggctagtatttatactgtcgacaaacgtagtggggggattcggaactacgtccgtacggtgggtcgcgggttgttcgggcggtacgggccaaggttcgacccggtcgttgggtcacgccgagcctcgcccctggcncttctcgttcccctccc

SEQ ID NO: 308973 - DNA, 603 bp, Homo sapiens
  misc_feature: GZ8MTXP01AJ1N1.4.10.A10.1.454.CMB.2.raw
  modified_base (403)..(403): a, c, t, g, unknown or other
  misc_feature (403)..(403): n is a, c, g, or t
tcagagcactgtagcacgaccggtgctcgatttagcgtcgatctcagggggggtagagaagacaggactcaggacaatctccagcatggccagcttccctctcctcctcaccctcctcactcactgtgcagggtcctgggcccactctgtgctgactcagccaccctcagcgtcgtcgggacccccggcaggaggtcaccatctcttgttctggaagccacctccaacatcggaataatcctagtaaactggtccagcaactccaggacggccccaaagtcctcatctatggtcagaatcagccgtccctcgacggggtcccctgaccgtattcctctggcctccaagtccctcgactaccctcacgccctccctggcccagtcgagtcgggcctccgagtcnggagatggagtctagtattattacgtgtgacaagaggttgggggattgactactccgtacgtggcgtcgggtggttcgggacgggtacgggtaccaaggttcggaccggttccgttcgggggtcaccggttcccggaacggttccgtaaccccggcccccgttggtccctaccgttcgtcccgtttcccccgtaaccccg

SEQ ID NO: 308974 - DNA, 714 bp, Homo sapiens
  misc_feature: GZ8MTXP01A7EF1.4.10.A10.1.454.CMB.2.raw
  modified_base (191)..(191): a, c, t, g, unknown or other
  misc_feature (191)..(191): n is a, c, g, or t
tcagagcactgtagcacgaccggtgctcgatttagcgtcgatctcagggggggtagagaagacaggactcaggacaatctccagcatggccagcttccctctcctcctcaccctcctcactcactgtgcagggtcctgggcccactctgtgctgactcagccaccctcagcgtcgtcggggacccccgggnaggacgggtcaccatctcttgttctggaagcacctccaacatcggaaagtaatcctagtaaactggttaccagcaactccgaaggaacggccccaaagtcctacatctatcggtacagaatcacgcgtccctcgacggggtccctgacccgtattctcgtcggctaccgaagtccctcgaacctaccctcacgtccccttcccgtgggccctaagtccgaggtcggggcctacgagtcgtggaggtagtggaggtcttaggtaatttagttacgtgtacgacctaaagtagtacgggggtatacggactaacgttccgtaacgggtggttcggtcggggttcggttaccggggacggggtaacggggtaaccgttaaagggttcgggttacccggtttcccgggttcgggggttacccgaaacccgggttccccggttaaacggggttccccgttccccgggtcccccccggttcgggttccctacccgttcccggtttcccggtttccccccggttcccccg

SEQ ID NO: 308975 - DNA, 601 bp, Homo sapiens
  misc_feature: GZ8MTXP01D2769.4.10.A10.1.454.CMB.2.raw
  modified_base (194)..(194): a, c, t, g, unknown or other
  misc_feature (194)..(194): n is a, c, g, or t
  modified_base (223)..(223): a, c, t, g, unknown or other
  misc_feature (223)..(223): n is a, c, g, or t
  modified_base (285)..(285): a, c, t, g, unknown or other
  misc_feature (285)..(285): n is a, c, g, or t
  modified_base (428)..(428): a, c, t, g, unknown or other
  misc_feature (428)..(428): n is a, c, g, or t
  modified_base (447)..(447): a, c, t, g, unknown or other
  misc_feature (447)..(447): n is a, c, g, or t
  modified_base (452)..(452): a, c, t, g, unknown or other
  misc_feature (452)..(452): n is a, c, g, or t
tcagagcactgtagcacgaccggtgctcgatttagcgtcgatctcgaggggggggtagagaagacaggactcaggacaatctccagtatggccagcttccctctcctcctcaccctcctcactcactgtgcagggtcctgggcccactctgtgctgactcacgccaccctcagccgtcgtcggggacccccggnaggagggtcaccatctcttgttctggaancacctcaacatcgaataatctagtaactggtccagcactccgaggaacggccccaaagtccncatctatggtacaagaatcagtccgtccctcgacgggggttcccctaggaccgtatttctcgtggcctacgaagtctacgacctacctcgacgtcccctacccgtggccctatcgacggtcggcctcgagtcgtgagtagtgnggctgtaattattactgtnacaanagtgggatcgatactcgtagtggtgtcggtcggttcgggcgggtaggtaccgtaggtaacggtaccgttcggtcgggttacgacggacccgttaacggccgttccgtccccgtacggtcctaccgtcttccgttccccaacccgttccc

SEQ ID NO: 308976 - DNA, 619 bp, Homo sapiens
  misc_feature: GZ8MTXP01AF9DM.4.10.A10.1.454.CMB.2.raw
  modified_base (169)..(169): a, c, t, g, unknown or other
  misc_feature (169)..(169): n is a, c, g, or t
  modified_base (189)..(189): a, c, t, g, unknown or other
  misc_feature (189)..(189): n is a, c, g, or t
tcagagcactgtagcacgaccggtgctcgatttagcgtcgatctcgagggggggtagagaagacaggactcaggacaatctccagcatggccagcttccctctcctcctcaccctcctcactcactgtgcagggtcctgggcccactctgtgctgactcagccaccctnagcgtctcgggacccccggnaggaggtcaccatctcttgtctggaagcacctccaacatcggaagtaatcctagtaaactggttccagcaactcccaggaacggccccaaagtcctcatctatggtcagaatcagcgtccctcgaggggtccctgaccgtattctctggctccaagtcctgacaccgtcacgccctccctgccatcagtcgggctccagtctgaggatggaggtctagatttattactgtgacaaacgtagtaggggggataggaactacgtcctaacggtggtcgacgggttgttcggggacggggtaggggaaccctaaagggttcgacccgggttccgttacggggttaccgaacggcccccgaaaggggccccttccgggccccccccgttcggggttcccaccgttcccgttccggtttccccccctaacccccg

SEQ ID NO: 308977 - DNA, 745 bp, Homo sapiens
  misc_feature: GZ8MTXP01ACP6E.4.10.A10.1.454.CMB.2.raw
  modified_base (167)..(167): a, c, t, g, unknown or other
  misc_feature (167)..(167): n is a, c, g, or t
tcagagcactgtagcacgaccggtgctcgatttagcgtcgatctcagggggggtagagaagacaggactcaggacaatctccagcatggccagcttccctctcctcctcaccctcctcactcactgtgcagggtcctgggcccatctgtgctgactcagccaccctnagcgtctcgggacccccggagaggtcaccatctcttgttctggaagcacctcaacatacggaagtaatcctagtaaactggtccagcaactccgaggaacggccccaaagtcctacatctatggtacagaatcagtccgtccctcgacgggggtcccctgacccgtatttcctcgtcggccctaccgtaacggtccccttacgacctaccctcacgtccccttcccgtggaccctaagtccgaggttcgggcctccgagtctaggaggtagtggaacggtctaggtatttacgttaacgtggttacgaccgaaacgtaggtaggggggtactacggtaaccgtaaccgtttacccggttaagggttcggggttacgggttaccggggtttcgggtttacccgggggaccggggtaaccggggtaaccgttaaacgggtttccgggttaaaccccgggtttaccggttcggggttaacccgtaaccggaccccggttaaagggttccccgtaacccgggtccccccgttcgggtaacccttacccgttcccgttcccggttcccccccgttaacccccg

SEQ ID NO: 308978 - DNA, 285 bp, Homo sapiens
  misc_feature: GZ8MTXP01APQT2.4.10.A10.1.454.CMB.2.raw
  modified_base (283)..(285): a, c, t, g, unknown or other
  misc_feature (283)..(285): n is a, c, g, or t
tcagagcactgtagcacgaccggtgctcgatttagcgtcgatctcaggggtccctgaccgattctctggctccaagtctgacacctcagcctccctggccatcagtgggctccagtctgaggatgaggctgattattactgtgcaacatgggatgacatcctacgtggtgcggtgttcggcggaggaccaagttgaccgtctgggtcagccaaggctcgccccctggtcactctcgttcccacctcctctacgtgctctgagcgggctggcaaggcgcatagnnn

SEQ ID NO: 308979 - DNA, 646 bp, Homo sapiens
  misc_feature: GZ8MTXP01CSJP4.4.10.A10.1.454.CMB.2.raw
  modified_base (191)..(191): a, c, t, g, unknown or other
  misc_feature (191)..(191): n is a, c, g, or t
  modified_base (219)..(219): a, c, t, g, unknown or other
  misc_feature (219)..(219): n is a, c, g, or t
  modified_base (347)..(347): a, c, t, g, unknown or other
  misc_feature (347)..(347): n is a, c, g, or t
  modified_base (364)..(364): a, c, t, g, unknown or other
  misc_feature (364)..(364): n is a, c, g, or t
tcagagcactgtagcacgaccggtgctcgatttagcgtcgatctcgagggggggtagagaagacaggactcaggacaatctccagcatggccagcttccctctcctcctcaccctcctcactcactgtgcagggtcctgggcccactctgtgctgactcagccaccctcagcgtcgtcggggacccccggnaggaggtcaccatctcttgttctggaancacctcaacatcggaagtaatcctagtaaactggttacagcaactccaggaacggccccaaagtcctcatctatggtcagaatcagccgtccctcgacgggtcctgaccgtatctctgctacagtccngacactcacgccctccngccatcgagtcgggctcagtctgaggatgaggctagtattattacgtgtgacaacgagttaggggggatggtaaccacgttacccgtaggttgggtggtaccggggtttcggttccggggaccggggaagggtaacccggtaacgggtttccggaaacccgggtttccgggttaggggtaccccgtaacgggcccccgaaagggggttcccttaacccgggtccccccgttcgggtacccctacccggttcctttccccggttaaccccccgtttaaccccg

SEQ ID NO: 308980 - DNA, 773 bp, Homo sapiens
  misc_feature: GZ8MTXP01DS6IB.4.10.A10.1.454.CMB.2.raw
  modified_base (169)..(169): a, c, t, g, unknown or other
  misc_feature (169)..(169): n is a, c, g, or t
  modified_base (190)..(190): a, c, t, g, unknown or other
  misc_feature (190)..(190): n is a, c, g, or t
  modified_base (217)..(217): a, c, t, g, unknown or other
  misc_feature (217)..(217): n is a, c, g, or t
  modified_base (226)..(226): a, c, t, g, unknown or other
  misc_feature (226)..(226): n is a, c, g, or t
tcagagcactgtagcacgaccggtgctcgatttagcgtcgatctcgagggggggtagagaagacaggactcaggacaatctccagcatggccagcttccctctcctcctcaccctcctcactcactgtgcagggtcctgggcccactctgtgctgactcagccaccctnagcgtcgtcgggacccccggnagaggtcaccatctcttgttctggaancacctcaanatcgaagtaatcctagtaaactggttccagcaactccgaaggacggccccaaagtcctcatctatggtacaagaatcgacgtccgtcccctcgacgggggtcccctaggacccgtattccgtcgtcggcctaccgaagttccccacggaacctacccgtccgaaccggtcccccttaccccgtgggacccctaaagttccgacgggttccggggacccttacccggaaggttccgttaggaacgggtatcggtaagggtcctttaggtaattttacgttaaccgtgttacgaacgtaaacgtggttacggggggtaacttacgggaacctaacgtttacccggttaagggttccggggttaggtaccgggggtttcgggtttccgggggaaccggggtaaccggggtaaacccgttaaaggtttcccggacccgggtttcccggttaggggtaccgtaaccggaccccgttaacgggttccccgttcccggaccccccgttgggtacccctaccgtttcccgttaaccccggttccccctaaccccg

SEQ ID NO: 308981 - DNA, 580 bp, Homo sapiens
  misc_feature: GZ8MTXP01D3MI6.4.10.A10.1.454.CMB.2.raw
  modified_base (206)..(206): a, c, t, g, unknown or other
  misc_feature (206)..(206): n is a, c, g, or t
  modified_base (259)..(259): a, c, t, g, unknown or other
  misc_feature (259)..(259): n is a, c, g, or t
  modified_base (375)..(375): a, c, t, g, unknown or other
  misc_feature (375)..(375): n is a, c, g, or t
  modified_base (576)..(576): a, c, t, g, unknown or other
  misc_feature (576)..(576): n is a, c, g, or t
  modified_base (578)..(578): a, c, t, g, unknown or other
  misc_feature (578)..(578): n is a, c, g, or t
  modified_base (580)..(580): a, c, t, g, unknown or other
  misc_feature (580)..(580): n is a, c, g, or t
tcagagcactgtagcacgaccggtgctcgatttagcgtcgatctcaggggtccctgagactctcctgtgcagcctctggattcaccttcacctcgtatagcatgacctgggtccgccaggctccagggaaggggctggagtgggtctcatccattggtactggtagtccttacatatactacttagactcagtgaggggccattcnccatctccagagacgactaccaagaactcagtgtatctgcacatggacagccngagagccgaggacacggctgtgtattcgtggtggggaggtcgtccggtggtgcgtaggaaggaaacggtcgttgacttcggtcggggccaacgggaccctggtccaaccgtctccncacgccctccaccgacgggcccagtccgtcctccccgtggccgcctcgcctcgacggacgccaccgtcgagacgcgacgacggcccggcccgtcgggcctcggccgtcggtaccgtaacggtaccttacccgttcccctaacgtcggttcgccgttcgtcgggacgggccgggcgttcgggaacgaacgggccgacagcgngngn

SEQ ID NO: 308982 - DNA, 729 bp, Homo sapiens
  misc_feature: GZ8MTXP01EIZS8.4.10.A10.1.454.CMB.2.raw
  modified_base (193)..(193): a, c, t, g, unknown or other
  misc_feature (193)..(193): n is a, c, g, or t
  modified_base (390)..(390): a, c, t, g, unknown or other
  misc_feature (390)..(390): n is a, c, g, or t
  modified_base (396)..(396): a, c, t, g, unknown or other
  misc_feature (396)..(396): n is a, c, g, or t
tcagagcactgtagcacgaccggtgctcgatttagcgtcgatctcgaggggggggtagagaagacaggactcaggacaatctccagcatggccagcttccctctcctcctcaccctcctcactcactgtgcagggtcctgggcccactctgtgctgactcacgccaccctcagcgtcgtcggggacccccggnaggacggtcaccattctcttgttctggaacgccacctaccaacatacggaagtaactcctagtaaactggttaccagacaactcccgaaggaaccgggacccccaaagtccctacatctagtggtacaagaatcacgtccgtcccctacggtacgggggtcccctggacccgtattcgtcgtcgcctaccagtcccncgaccncctccacgtccctcccgtggcctagtccgaggtcgggcctcgagtctgaggagtggagtcttagtatttatacgtgtacgactaaacgtggtacgggggtatacggtaacctaccgttaccggttaacgggttggggttacgggttcggggtttcgggttaccgggggaccggggtaaaccgggtaacccggttaaagggttccggttaacccgggttccgggttacggggtacccgtaacccggacccggttacggttccccggttccccgggtcccccgttccgggttaccctacccgtttcccgttccccggtttaacccccttcccccg

SEQ ID NO: 308983 - DNA, 610 bp, Homo sapiens
  misc_feature: GZ8MTXP01BUQ1X.4.10.A10.1.454.CMB.2.raw
tcagagcactgtagcacgaccggtgctcgatttagcgtcgatctcgagggggggtagagaagacaggactcaggacaatctccagcatggccagcttccctctcctcctcaccctcctcactcactgtgcagggtcctgggcccactctgtgctgactcagccaccctcagcgtcgtcgggacccccggcaggaggtcaccatctcttgttctggaagcacctccaacatcggaagtatcctagtaaactggtcagcaactccgaggacggccccaaagtcctcatctatggtacagaactcacgccgtccctcgacggggtcccctgacccgtattctctcggtctccaagtcctgacacctcacgccctcccgtgcctatcaggtcggctccagtctgaggatgaggtctagtactttatactgtgacaaagtagtggggggatacggaactcgttacccgtaggttcgggtggtccgggttacggttccggggacgggtacggggacctaaaggttcggacccggtaccgttgggtaccgacgacccgttaagggccctccggtcccccgtcggtccaccgttccgtaaccgtttcccctaaccccg

SEQ ID NO: 308984 - DNA, 737 bp, Homo sapiens
  misc_feature: GZ8MTXP01ADGUF.4.10.A10.1.454.CMB.2.raw
  modified_base (169)..(169): a, c, t, g, unknown or other
  misc_feature (169)..(169): n is a, c, g, or t
  modified_base (191)..(191): a, c, t, g, unknown or other
  misc_feature (191)..(191): n is a, c, g, or t
  modified_base (230)..(230): a, c, t, g, unknown or other
  misc_feature (230)..(230): n is a, c, g, or t
  modified_base (291)..(291): a, c, t, g, unknown or other
  misc_feature (291)..(291): n is a, c, g, or t
tcagagcactgtagcacgaccggtgctcgatttagcgtcgatctcgagggggggtagagaagacaggactcaggacaatctccagcatggccagcttccctctcctcctcaccctcctcactcactgtgcagggtcctgggcccactctgtgctgactcagccaccctnagcgtcgtcggggacccccggnaggaggtcaccatctcttgttctggaagccacctccaanatacggaataactcctagtaaactggtccagcaactccgaggaaccggccccaaagtcctnatctatggtacagaatcacgccgtccctagacgggggtccctagaccgtatttccgtcgtcggcctaccgaacggtccctacggacctaccctcgaccgtacccccttcccgtcgggaccctaacgtccgtaacgggttcggggcccttacccggtaaggttccgtaaggggaagggttaacggtacgggtacgtacgttaaggttaactttacggttacgtaggtacgaactaaacgtagggtaggggtactacggtaacctaccggttaccgttacgggtgggtaccgggttcggggttacgggtaccggggacgggtacgggtaaccgttaacgggttccggttacccggtcggttacggtaccgaccgacccggttacggcccgttccccggtccccgtccgtaccctaccgttcccgtaaccccgttaaccccgtaacccg

SEQ ID NO: 308985 - DNA, 682 bp, Homo sapiens
  misc_feature: GZ8MTXP01D1SBE.4.10.A10.1.454.CMB.2.raw
  modified_base (191)..(191): a, c, t, g, unknown or other
  misc_feature (191)..(191): n is a, c, g, or t
  modified_base (219)..(219): a, c, t, g, unknown or other
  misc_feature (219)..(219): n is a, c, g, or t
  modified_base (402)..(402): a, c, t, g, unknown or other
  misc_feature (402)..(402): n is a, c, g, or t
tcagagcactgtagcacgaccggtgctcgatttagcgtcgatctcgagggggggtagagaagacaggactcaggacaatctccagcatggccagcttccctctcctcctcaccctcctcactcactgtgcagggtcctgggcccactctgtgctgactcacgccaccctcagcgtcgtcgggacccccggnaggaggtcaccatctcttgtctggaacncacctcaacatacggaataatcctagtaaactggtaccagcaactccgaaggacggaccccaaagtcctacatctatcggtacagaactcgacgccgtccctcggacgggtcctagtacccgtatttcctacgtcggcctaccgaagttcccctacgaacctacctcaccgtccccttcccgnggaccctagtccgagggttccggggaccttcccgtagtcgtaggaggtagtaggaggtacttaggtaattttacttacgtgtacgaaccgtaaagtggttagggggtaacttcggtaaccttacggttacccgtaggttcgggtcggtcggggttcggtcggggacggggtaacggtacccgtaaggtttccggccggttccggttagggtaccacggacccggaggttcccgtccgtccccgttcggtccctacgttccgttcccggttccccgtcccg

SEQ ID NO: 308986 - DNA, 706 bp, Homo sapiens
  misc_feature: GZ8MTXP01BLB1F.4.10.A10.1.454.CMB.2.raw
  modified_base (189)..(189): a, c, t, g, unknown or other
  misc_feature (189)..(189): n is a, c, g, or t
  modified_base (217)..(217): a, c, t, g, unknown or other
  misc_feature (217)..(217): n is a, c, g, or t
  modified_base (225)..(225): a, c, t, g, unknown or other
  misc_feature (225)..(225): n is a, c, g, or t
  modified_base (253)..(253): a, c, t, g, unknown or other
  misc_feature (253)..(253): n is a, c, g, or t
  modified_base (277)..(277): a, c, t, g, unknown or other
  misc_feature (277)..(277): n is a, c, g, or t
  modified_base (288)..(288): a, c, t, g, unknown or other
  misc_feature (288)..(288): n is a, c, g, or t
  modified_base (293)..(293): a, c, t, g, unknown or other
  misc_feature (293)..(293): n is a, c, g, or t
tcagagcactgtagcacgaccggtgctcgatttagcgtcgatctcagggggggtagagaagacaggactcaggacaatctccagcatggccagcttccctctcctcctcaccctcctcactcactgtgcagggtcctgggcccactctgtgctgactcagccaccctcagcgtcgtcgggacccccggnaggacggtcaccatctcttgtctggaancactcaanatcggaatatctagtaactgtcagcacnccgaggaacggccccaaagtcctnatctatggtanagaancagtccgtccctcggacgggtccctggacccgtattccgtcgtcggtcctacgtaacgtccctacgacctaccctccgaccgcccctcccgtcggccctacgtcgacggtcggggtcctacccgtagtcgtcgggaaggtagagggtacggtcgttaggtaacttttattaaccgtgtacgaacgtaacgtaggttagggggacgtaggaaccttacgtttaccggtaccgggtttgggtcggttcggggtttacgggtccgggggacggggtaaaccggggtaaccgtaacgggtttcccggacccgggtttccggttccggggtaccggtacggaccccggttaacggcccggttccccggtaccccgtccggtaccctcccgttccgttaaccccgtttcccctcccccg

SEQ ID NO: 308987 - DNA, 620 bp, Homo sapiens
  misc_feature: GZ8MTXP01B6T8H.4.10.A10.1.454.CMB.2.raw
  modified_base (244)..(244): a, c, t, g, unknown or other
  misc_feature (244)..(244): n is a, c, g, or t
  modified_base (255)..(255): a, c, t, g, unknown or other
  misc_feature (255)..(255): n is a, c, g, or t
  modified_base (310)..(310): a, c, t, g, unknown or other
  misc_feature (310)..(310): n is a, c, g, or t
  modified_base (607)..(607): a, c, t, g, unknown or other
  misc_feature (607)..(607): n is a, c, g, or t
  modified_base (616)..(616): a, c, t, g, unknown or other
  misc_feature (616)..(616): n is a, c, g, or t
  modified_base (618)..(618): a, c, t, g, unknown or other
  misc_feature (618)..(618): n is a, c, g, or t
  modified_base (620)..(620): a, c, t, g, unknown or other
  misc_feature (620)..(620): n is a, c, g, or t
tcagagcactgtagcacgaccggtgctcgatttagcgtcgatctcaggggtccctgagactctcctgtgcagcctctggattcaccttcacctcgtatagcatgacctgggtccgccaggctccagggaagggctggagtgggtctcatccattggtactggtagtccttacatatactacttagactcagtgagggccattctcatctccagagacactaccaagactcagtgtatctgacanatggacagccngagacggccgaggacacggtctgtgtatttcgtggtggggagtcgtcgggtggtncgttggagaaacggcgttagacttcggtcggggccaggggtaaccctggtccaacccgtcctccgcacggcccctcccgaaccgaacggggtcccctacgtcccggttccttcccccccggttgggccccgtccccgtcggccttcccgaacggcgaccacccgtccgagaccgcgacgaggcccggcccgtacgggtcctcggccgttacgggtcgtaaacgggtacccttaaccttcccctaagtacgttcgcccgttcgtacggcgggttcgggcttcggggaacgaacgggcncgaattggngngn

SEQ ID NO: 308988 - DNA, 769 bp, Homo sapiens
  misc_feature: GZ8MTXP01D716B.4.10.A10.1.454.CMB.2.raw
  modified_base (194)..(194): a, c, t, g, unknown or other
  misc_feature (194)..(194): n is a, c, g, or t
  modified_base (316)..(316): a, c, t, g, unknown or other
  misc_feature (316)..(316): n is a, c, g, or t
tcagagcactgtagcacgaccggtgctcgatttagcgtcgatctcgagggggggtagagaagacaggactcaggacaatctccagcatggccagcttccctctcctcctcaccctcctcactcactgtgcagggtcctgggcccactctgtgctgactcacgcccaccctcacgcgtccgtcgggacccccggnaggacggtcaccatctcttgttctaggaacgcctacctaccaaactagtacggaaagttaactcctagtaaacgtcggttaccagaccaacgtcccgaaaggaaccggccccaaagtccctnaactctagtcggtacaagtaaatccgagcccgttccccgtacggtaaccgggggtcccctacggaacccgtttactttccgtacgttcgggtacctttaaccccgaacggtttccccgtaccgacccgtaaccccgttcgaacccccggtcccccttaaccccgtcgggtcccaaaccgttaccggtacggggtttcggggtcccttcccggtaaagttccggtaagggtacggtagtacgggtacgtacgtttaggttaatttaccgtaacgtgacgtacgaagttacgtggggggtatacggactacgttcccgtaagggttcgggtcggtcggttcggtaccggggacggaacgggtaacctaaggttccgaccggtggttaccggacgccgaccgttggttccccgccgtacccgtcgtactccgttccttcccgttaaccccttcccg

SEQ ID NO: 308989 - DNA, 518 bp, Homo sapiens
  misc_feature: GZ8MTXP02J0EEQ.4.10.A10.1.454.CMB.2.raw
  modified_base (393)..(393): a, c, t, g, unknown or other
  misc_feature (393)..(393): n is a, c, g, or t
tcagagcactgtagcacgaccggtgctcgatttagcgtcgatctcaggggggtagagaagacaggactcaggacaatctccagcatggccagcttccctctcctcctcaccctcctcactcactgtgcagggtcctggcccactctgtgctgactcagccaccctcagcgtctggggaccccccgggcaggagggtcaccatctcttgttctggaagcacctccaacatcggaataatcctgtaaactggtccagcactcccaggaaggccccccaaagtcctcatctatggtcagaatcagcgtccctcaggggtcccctgaccgattctctggctccagtcctgacactcagcctccctggcccatcagtgggctccagtctgaggatganactgatttattactgtgcaacattgggatgacatcctacgtggtgcggtgttcggcgggagaccgaagttgaccgtcctgggtcacgcccaggctgccccctcggtcactctcgttcccgtcccc

SEQ ID NO: 308990 - DNA, 289 bp, Homo sapiens
  misc_feature: GZ8MTXP02H1TBR.4.10.A10.1.454.CMB.2.raw
  modified_base (287)..(289): a, c, t, g, unknown or other
  misc_feature (287)..(289): n is a, c, g, or t
tcagagcactgtagcacgaccggtgctcgatttagcgtcgatctcagggtccctgaccgattctctggctccaagtctgacacctcagcctccctggccatcagtgggctccagtctgaggatgaggctgattattactgtgcaacatgggatgacatcctacgtggtgcggtgttcggcggagggaccaagttgaccgtcctgggtcagccaaggctgccccctggtcactctgttcccgccctctcctacagtcgctctggagcgggctggcaaggcgcaatagnnn

SEQ ID NO: 308991 - DNA, 562 bp, Homo sapiens
  misc_feature: GZ8MTXP02JNIIM.4.10.A10.1.454.CMB.2.raw
  modified_base (417)..(417): a, c, t, g, unknown or other
  misc_feature (417)..(417): n is a, c, g, or t
tcagagcactgtagcacgaccggtgctcgatttagcgtcgatctcagggggtagagaagacaggactcaggacaatctccagcatggccagcttccctctcctcctcaccctcctcactcactgtgcagggtcctgggcccactctgtgctgactcagccaccctcagcgtctcgggacccccgggcagagggtcaccatctcttgttctggaagcacctccaacatcggaagtaatcctgtaaactggttccagcaactccaggacggccccaaagtcctcatctatggtcagaatcagcgtccctcaggggtcccctgacccgattctctggcctccaagtccctgaccacctcacgcctcctggccatcagtgggctccagtctgaggatgaggctgattatactgtgacaaangtgggaatcgaacattacccgtaggtggtcgtcggtggttcgggacggaggggaccctaagggttcgacccggtccgttaggggccacgccccgaaagggccctcggcccccgtcggttcaccttcctccggttaccccctcccc

SEQ ID NO: 308992 - DNA, 287 bp, Homo sapiens
  misc_feature: GZ8MTXP02HX0GF.4.10.A10.1.454.CMB.2.raw
  modified_base (287)..(287): a, c, t, g, unknown or other
  misc_feature (287)..(287): n is a, c, g, or t
tcagagcactgtagcacgaccggtgctcgatttagcgtcgatctcaggggtccctgaccgattctctggctccaagtctgacacctcagcctccctggccatcagtgggctccagtctgaggatgaggctgattattactgtgcaacatgggatgacatcctacgtggtgcggtgttcggcggagggaccaagttgaccgtcctgggtcagcccaaggctgccccctggtcactctgttcccgccctcctcctacagtgctctgagcgggctggcaaggcgcatagn

SEQ ID NO: 308993 - DNA, 650 bp, Homo sapiens
  misc_feature: GZ8MTXP02HAG0H.4.10.A10.1.454.CMB.2.raw
  modified_base (311)..(311): a, c, t, g, unknown or other
  misc_feature (311)..(311): n is a, c, g, or t
  modified_base (334)..(334): a, c, t, g, unknown or other
  misc_feature (334)..(334): n is a, c, g, or t
  modified_base (403)..(403): a, c, t, g, unknown or other
  misc_feature (403)..(403): n is a, c, g, or t
  modified_base (435)..(435): a, c, t, g, unknown or other
  misc_feature (435)..(435): n is a, c, g, or t
tcagagcactgtagcacgaccggtgctcgatttagcgtcgatctcaggggggtagagaagacaggactcaggacaatctccagcatggccagcttccctctcctcctcaccctcctcactcactgtgcagggtcctgggcccactctgtgctgactcagcccaccctcagcgtctcggggacccccgggcaggagggtcaccatctcttgttctggaagcacctcaacatcggaataatcctgtaaactggttccagcaactcccaggaacggccccaaagtcctcatctatggtcagaatcagcgtcccncgacggggtccctgaccgattcnctggctccgaagtccctagaccacctcacgccctccctggccatccgagtcgggctcagtctgaggagnggaggctagtattattactgtacgacaaacgngtgggatgaactacgttaccgtacggtggtcggtccgggttggttccggggacggggtaacggggtaccccggtaaaaggttcgggtaaccccggttcccggttagggggtacccgaaccggaccccggtaaacggggtcccgttaacccggcccccccggttcgggttacccctaacccggttcccgtttacccgggttccccccgttcccccg

SEQ ID NO: 308994 - DNA, 495 bp, Homo sapiens
  misc_feature: GZ8MTXP02GQVO7.4.10.A10.1.454.CMB.2.raw
  modified_base (184)..(184): a, c, t, g, unknown or other
  misc_feature (184)..(184): n is a, c, g, or t
  modified_base (374)..(374): a, c, t, g, unknown or other
  misc_feature (374)..(374): n is a, c, g, or t
  modified_base (399)..(399): a, c, t, g, unknown or other
  misc_feature (399)..(399): n is a, c, g, or t
  modified_base (431)..(431): a, c, t, g, unknown or other
  misc_feature (431)..(431): n is a, c, g, or t
  modified_base (468)..(468): a, c, t, g, unknown or other
  misc_feature (468)..(468): n is a, c, g, or t
tcagagcactgtagcacgaccggtgctcgatttagcgtcgatctcaggggtagagaagacaggactcaggacaatctccagcatggccagcttccctctcctcctcaccctcctcactcactgtgcagggtcctgggcccactctgtgctgactcagccaccctcagcgtctgggacccccggnagagggtcaccatctcttgttctggaagcacctcaacatcggaataatcctgtaaactggtccagcactccaggaggccccaaagtcctcatctatggtcagaatcagcgtccctcaggggtccctgaccgattctctgctccaagtcctgacactcagcctcctggccatcagtggctccagtctgagntgaggctgattatactgtgcaaacngtgggatgacatcctacgtgtgcggtgtcggnggaggacaagttcgaccgtctgggtcacgccgaagcncgccctcggcacgtctccgttccgccc

SEQ ID NO: 308995 - DNA, 575 bp, Homo sapiens
  misc_feature: GZ8MTXP02G42ZM.4.10.A10.1.454.CMB.2.raw
  modified_base (362)..(362): a, c, t, g, unknown or other
  misc_feature (362)..(362): n is a, c, g, or t
  modified_base (446)..(446): a, c, t, g, unknown or other
  misc_feature (446)..(446): n is a, c, g, or t
tcagagcactgtagcacgaccggtgctcgatttagcgtcgatctcagggggggtagagaagacaggactcaggacaatctccagcatggccagcttccctctcctcctcaccctcctcactcactgtgcagggtcctgggcccactctgtgctgactcagccaccctcagcgtcgtcggggaccccccgggcaggacgggtcaccatctcttgttctggaagcacctccaacatcggaataatcctagtaaactggtccagcaactcccaggaacggccccaaagtcctcatctatggtacagaatcagcgtccctcacggggtccctgacccgtattctctggcctccaagtccctgaccncctcacgtccctccctgggccatccgagtcggggcctccgtagtcgtcgaggatggaggctgtaattagttactgtgacaaacngtaggattgaactgtaccgtacggtggtgtcgggtcggttcgggacggagggacccgtaaggttcgaccgtcggtggtcgacgcccgaagccgtcgccccctcggtccacgtcctccgttaccctaccc

SEQ ID NO: 308996 - DNA, 603 bp, Homo sapiens
  misc_feature: GZ8MTXP02JTRPR.4.10.A10.1.454.CMB.2.raw
  modified_base (231)..(231): a, c, t, g, unknown or other
  misc_feature (231)..(231): n is a, c, g, or t
  modified_base (322)..(322): a, c, t, g, unknown or other
  misc_feature (322)..(322): n is a, c, g, or t
  modified_base (333)..(333): a, c, t, g, unknown or other
  misc_feature (333)..(333): n is a, c, g, or t
  modified_base (372)..(372): a, c, t, g, unknown or other
  misc_feature (372)..(372): n is a, c, g, or t
  modified_base (441)..(441): a, c, t, g, unknown or other
  misc_feature (441)..(441): n is a, c, g, or t
tcagagcactgtagcacgaccggtgctcgatttagcgtcgatctcgaggggggtagagaagacaggactcaggacaatctccagcatggccagcttccctctcctcctcaccctcctcactcactgtgcagggtcctgggcccactctgtgctgactcagcccaccctcagcgtcgtcggggacccccggcaggagggtcaccatctcttgttctggaagcacctccaacntcggaataatcctagtaactggtccagcactccaggaacggccccaaagtcctacatctagtggtcagatcagcgtccctgacggggtccngaccgatttcncgtggcctccaagtccctagacctacctcacgccctccnggcccatccgagtcgggcctccagtctagaggatggagtctagtaattacttacgtgtacgacaaacgngtagggatagactactacgtacggtggtcgtcgggttcggtcgggacgggacgggtaccgtaacggttcggacccggttccggtcgggtaccgacgtaccccggaagggtcccgtcccgtcccccgtacggtcctaccgtccggttcccgtccccgtccccc

SEQ ID NO: 308997 - DNA, 291 bp, Homo sapiens
  misc_feature: GZ8MTXP02JN34B.4.10.A10.1.454.CMB.2.raw
  modified_base (288)..(291): a, c, t, g, unknown or other
  misc_feature (288)..(291): n is a, c, g, or t
tcagagcactgtagcacgaccggtgctcgatttagcgtcgatctcaggggtccctgaccgattctctggctccaagtctgacacctcagcctccctggccatcagtgggctccagtctgaggatgaggctgattattactgtgcaacatgggatgacatcctacgtggtgcggtgttcggcggaggaccaagttgaccgtcctgggtcacgccaaggctcgcccctcggtcactctcgttcccgccctcctcctacagtgctctgaggcggctggcaaggcgcatagnnnn

SEQ ID NO: 308998 - DNA, 656 bp, Homo sapiens
  misc_feature: GZ8MTXP02GHQAU.4.10.A10.1.454.CMB.2.raw
  modified_base (189)..(189): a, c, t, g, unknown or other
  misc_feature (189)..(189): n is a, c, g, or t
  modified_base (369)..(369): a, c, t, g, unknown or other
  misc_feature (369)..(369): n is a, c, g, or t
tcagagcactgtagcacgaccggtgctcgatttagcgtcgatctcaggggggtagagaagacaggactcaggacaatctccagcatggccagcttccctctcctcctcaccctcctcactcactgtgcagggtcctgggcccactctgtgctgactcagccaccctcagcgtcgtcgggacccccgggnaggagggtcaccatctcttgttctggaagcacctccaacatcggaataatcctagtaaactggttccagcaactcccaggaacggccccaaagtcctcatctatggtcagaatcagccgtcctcgacggggtccctgacccgattctctggctccaagtcctgaccactcacgccttccnggccatcagtcgggctcagtctgagatgaggctagatttattacgtgtacgactaaacgagttaggggaattggaactagttacccgttaacggttggggtacggtccggggttggttccggggacggggtaacgggggaacccttaaaagggttccggaaacccggttccggttacgggggttacccgaaccgggtacccccgaaaggggtcccctaacccgggtacccccccgttcggggttaccctaacccgttccgtttcccggtttccccccggttcccccg

SEQ ID NO: 308999 - DNA, 535 bp, Homo sapiens
  misc_feature: GZ8MTXP02FN97M.4.10.A10.1.454.CMB.2.raw
  modified_base (187)..(187): a, c, t, g, unknown or other
  misc_feature (187)..(187): n is a, c, g, or t
  modified_base (453)..(453): a, c, t, g, unknown or other
  misc_feature (453)..(453): n is a, c, g, or t
tcagagcactgtagcacgaccggtgctcgatttagcgtcgatctcagggggtagagaagacaggactcaggacaatctccagcatggccagcttccctctcctcctcaccctcctcactcactgtgcagggtcctgggcccactctgtgctgactcagccaccctcagcgtctgggaccccccgggnagagggtcaccatctcttgttctggaagcacctccaaacatcggaagtaatcctgtaaactggttccagcaactcccaggaaggcccccaaagtcctcatctatggtcagaatcagcgtccctcgaggggtcccctgacccgattctctgctccaagtcctgaccactcagccctcctgccatcagtcggctcagtctgagatgaggctgattattactgtagcaaacagtgggactgactatccgtacgtggtgcggtgttcggngggacgggacctaagttcgaccggtctgggtacacgcccgaaggcctcgcccccgtcggtccactccgtcgttccccgcccc

SEQ ID NO: 309000 - DNA, 679 bp, Homo sapiens
  misc_feature: GZ8MTXP02JVOCO.4.10.A10.1.454.CMB.2.raw
  modified_base (186)..(186): a, c, t, g, unknown or other
  misc_feature (186)..(186): n is a, c, g, or t
  modified_base (332)..(332): a, c, t, g, unknown or other
  misc_feature (332)..(332): n is a, c, g, or t
tcagagcactgtagcacgaccggtgctcgatttagcgtcgatctcaggggggtagagaagacaggactcaggacaatctccagcatggccagcttccctctcctcctcaccctcctcactcactgtgcagggtcctgggcccactctgtgctgactcagccaccctcagcgtctgggacccccggnagagggtcaccatctcttgttctggaagcacctccaacatcggaagtaatcctgtaaactggttccagcaactcccaggaacggccccaaagtcctcatctatggtcagaatcagcgtccctcgacggggtccctgaccgattccncgtggcctccaagtccctgaccacctcacgtccctcccgtggcccatccagtcgggcctccgagtcgtgaggatggaggcttgattattacgtgtgactaaacgagttggggaatgaacctacgttacccgtaacggttcggggttcgggtccggggtgggtttaccgggggaccgggggtaaggggtaaccccgtaaaggggtttcccggtacccgggttccccggttacgggggtaccgaacccgggacccccgtaaaaggggtcccgttcccggtaccccccccggtttcggttaccccggtaccctttcccggtttccccggtttaccccccttacccccccg

SEQ ID NO: 309001 - DNA, 631 bp, Homo sapiens
  misc_feature: GZ8MTXP02IHR1M.4.10.A10.1.454.CMB.2.raw
  modified_base (285)..(285): a, c, t, g, unknown or other
  misc_feature (285)..(285): n is a, c, g, or t
tcagagcactgtagcacgaccggtgctcgatttagcgtcgatctcaggggggtagagaagacaggactcaggacaatctccagcatggccagcttccctctcctcctcaccctcctcactcactgtgcagggtcctgggcccactctgtgctgactcagccaccctcagcgtctcggggaccccccgggcaggagggtcaccatctcttgttctggaagcacctccaaacatcggaataatcctagtaaactggttccagcactccaggacggccccaaagtccnatctatggtcagaatcagccgtcccctcgaggggtcccctggacccgtatttcctcgtggcctaccaagttccctacgaccacctcacgtccccttccctgggccatcgagtcgggctccagtctgaggatggaggctgtatttacttacgtgtagacaaacgtagtagggatagacctagttcccgtacggttgggtggtcgggttcggttcgggacggggtaacggggaccctaaagggttcggacccggttccggttcgggggtaccacgggaccccgtaagggtccctccggtccccccgttcgggtcccaccgtttcccgttcccggttcccccgtccccc

SEQ ID NO: 309002 - DNA, 660 bp, Homo sapiens
  misc_feature: GZ8MTXP02IT227.4.10.A10.1.454.CMB.2.raw
tcagagcactgtagcacgaccggtgctcgatttagcgtcgatctcaggggggtagagaagacaggactcaggacaatctccagcatggccagcttccctctcctcctcaccctcctcactcactgtgcagggtcctgggcccactctgtgctgactcagccaccctcagcgtcgtcggggacccccgggcaggacggtcaccatctcttgttctggaagcacctccaacatcggaagtatcctagtaaactggtccagcaactccgaggacggaccccaaagtcctcatctatggtacagaactcacgtccgtccctcgacggggtcccctggacccgtattctcgtcgtctaccgtaagtcccctacgacctaccctacacgtccccttcccgtcggccctatccgtaaggtcggggtcctccgtagttccgtggtaaggagtggacggtcttaggtaacttagttacgtgtacgactaaacgtaggtacgggtattacgactacgttaccgttacgggtggtcggttcgggtcggttcgggacggggtaacggtactaacggttcgacccggtcggtcgggacctaccggaccgtaacggccgtaacccggcccccgtacggtacctcccgttccgtacccgttacccccgtaccccc

SEQ ID NO: 309003 - DNA, 617 bp, Homo sapiens
  misc_feature: GZ8MTXP02HOEQB.4.10.A10.1.454.CMB.2.raw
  modified_base (208)..(208): a, c, t, g, unknown or other
  misc_feature (208)..(208): n is a, c, g, or t
  modified_base (612)..(612): a, c, t, g, unknown or other
  misc_feature (612)..(612): n is a, c, g, or t
  modified_base (615)..(617): a, c, t, g, unknown or other
  misc_feature (615)..(617): n is a, c, g, or t
tcagagcactgtagcacgaccggtgctcgatttagcgtcgatctcaggggtccctgagactctcctgtgcagcctctggattcaccttcacctcgtatagcatgacctgggtccgccaggctccgagggaaggggctgggagtgggtctcatccattggtactggtagtccttacatatactacttagactcagtgaggggccattcnccatctccagagacgactccaagaactcagtgtatctgcacatggacagcctggagacgccgagacacggctgtgttatttcgtggtggggagtcgtccgggtggtgcgtaggaggtaaacggtcgttagacgttcggcggggaccgaacggggtacccctacgggtaacccgttcctcccgtccgacggtcccctaccgaacccgaacggggcccctagttccccggttccctttcccccgtcggcccgtccccgtcgccctaccgacggcgacccacccgtccgacgacgccgaacgcggcccggcccgtcgggacctcgccgtacggtacacggtaccttaccgttcctacgtacgtcgtcgtcgtacggacgcgggcgtcggacgaacggcgacgtacgngcnnn

SEQ ID NO: 309004 - DNA, 634 bp, Homo sapiens
  misc_feature: GZ8MTXP02HHNLL.4.10.A10.1.454.CMB.2.raw
  modified_base (189)..(189): a, c, t, g, unknown or other
  misc_feature (189)..(189): n is a, c, g, or t
tcagagcactgtagcacgaccggtgctcgatttagcgtcgatctcaggggggtagagaagacaggactcaggacaatctccagcatggccagcttccctctcctcctcaccctcctcactcactgtgcagggtcctgggcccactctgtgctgactcagccaccctcagcgtcgtcgggacccccgggnagagggtcaccatctcttgttctggaagcacctccaacatcggaatatcctagtaaactggtccagcaactcccaggaacggccccaaagtcctcatctatggtacagaatcagcgtccctcgacggggtccctgaccgtattctcgtggcctaccgaagttcccctagaccacctcacgtcccctaccctgggccctatccgagtcggggcctaccgagtctggacggatggaggtctagtacttagttacgtgtgacaaacgagttagggattagactacgttacccgtaggtgggtcgtcgggttcggttccgggcggggaagggtacccgtaaagggttccggacccggttccggttacggggacctacggacccccgtaaggtccgtcccggtcccccgtacgggtcctaccgttccgttcccgttaccccctacccccg

SEQ ID NO: 309005 - DNA, 544 bp, Homo sapiens
  misc_feature: GZ8MTXP02GA1NM.4.10.A10.1.454.CMB.2.raw
  modified_base (226)..(226): a, c, t, g, unknown or other
  misc_feature (226)..(226): n is a, c, g, or t
  modified_base (523)..(523): a, c, t, g, unknown or other
  misc_feature (523)..(523): n is a, c, g, or t
tcagagcactgtagcacgaccggtgctcgatttagcgtcgatctcaggggggtagagaagacaggactcaggacaatctccagcatggccagcttccctctcctcctcaccctcctcactcactgtgcagggtcctgggcccactctgtgctgactcagccaccctcagcgtctgggacccccgggcaggagggtcaccatctcttgttctggaagcacctcaaanatcggaagtatcctagtaaactggttcagcaactccaggaaggccccaaagtcctcatctatggtcagaatcagcgtccctgacggggtccctgacccgattctctggctccaagtcctgacactcagcctcctggccatcagtggctcgagtctgaggactgaggctagatttattactgtagcaaacagtgggatgactatcctaacgtggtgcggtgttcggcggagggacctaaaggttcgaccgtcgtcggggtcacgtacccgaaggccgtaaccgcccccgtcggtaccncctcgtccgttccctaccccc

SEQ ID NO: 309006 - DNA, 583 bp, Homo sapiens
  misc_feature: GZ8MTXP02GGQQZ.4.10.A10.1.454.CMB.2.raw
  modified_base (579)..(579): a, c, t, g, unknown or other
  misc_feature (579)..(579): n is a, c, g, or t
  modified_base (581)..(583): a, c, t, g, unknown or other
  misc_feature (581)..(583): n is a, c, g, or t
tcagagcactgtagcacgaccggtgctcgatttagcgtcgatctcaggggtccctgagactctcctgtgcagcctctggattcaccttcacctcgtatagcatgacctgggtccgccaggctccagggaaggggctggagtgggtctcatccattggtactggtagtccttacatatactacttagactcagtgaggggccattctccatctccagagacgactccaagaactcagtgtatctgcacatggacagcctgagagccgaggacacggctgtgtatttctggtgggaggtcgtccggtggtgctggaggaaacggcgttgacttcgcggggccagggacctggtcaccgtctcctcacgcctccaccgaacgggcccagtccggtcccttcccccgtggcccgccctgcctccgaggacgccacccgtccgaagacgccacgacggcccggcccgtcgggcctcggcccgtacgggtaccgaaacgggacccttaccgttaccccgtaacgacggttccgccgttccgtcggaccgggccggggtacgtcgggaacgaacgggccgacaagngnnn

SEQ ID NO: 309007 - DNA, 578 bp, Homo sapiens
  misc_feature: GZ8MTXP02GC886.4.10.A10.1.454.CMB.2.raw
  modified_base (409)..(409): a, c, t, g, unknown or other
  misc_feature (409)..(409): n is a, c, g, or t
  modified_base (427)..(427): a, c, t, g, unknown or other
  misc_feature (427)..(427): n is a, c, g, or t
  modified_base (430)..(430): a, c, t, g, unknown or other
  misc_feature (430)..(430): n is a, c, g, or t
  modified_base (438)..(438): a, c, t, g, unknown or other
  misc_feature (438)..(438): n is a, c, g, or t
tcagagcactgtagcacgaccggtgctcgatttagcgtcgatctcagggggggtagagaagacaggactcaggacaatctccagcatggccagcttccctctcctcctcaccctcctcactcactgtgcagggtcctgggcccactctgtgctgactcagccaccctcagcgtcgtcggggacccccgggcaggagggtcaccatctcttgttctggaagcacctcaaacatcggaagtaatcctagtaaactggtccagcaactccaggaacggccccaaagtcctcatctatggtcagaatcagccgtccctcgaggggtcccctggacccgtattcctctggctaccaagtcctgaccacctcacgccctccctggcccatccaggtcgggctccagtctgacggntgaggctgatttattacngtnacaaacgngtgggatgactatcccgtaggtggtcgcggttggtcggacgggtagggacctaaggttcggaccgtcgtgggtacacgacccgaagggtcctccggcccccgttacgggtcacccgttcgttcccgttacccctaccccg

SEQ ID NO: 309008 - DNA, 664 bp, Homo sapiens
  misc_feature: GZ8MTXP02HHTKO.4.10.A10.1.454.CMB.2.raw
  modified_base (221)..(221): a, c, t, g, unknown or other
  misc_feature (221)..(221): n is a, c, g, or t
  modified_base (230)..(230): a, c, t, g, unknown or other
  misc_feature (230)..(230): n is a, c, g, or t
  modified_base (284)..(284): a, c, t, g, unknown or other
  misc_feature (284)..(284): n is a, c, g, or t
  modified_base (320)..(320): a, c, t, g, unknown or other
  misc_feature (320)..(320): n is a, c, g, or t
  modified_base (376)..(376): a, c, t, g, unknown or other
  misc_feature (376)..(376): n is a, c, g, or t
tcagagcactgtagcacgaccggtgctcgatttagcgtcgatctcagggggggtagagaagacaggactcaggacaatctccagcatggccagcttccctctcctcctcaccctcctcactcactgtgcagggtcctgggcccactctgtgctgactcagccaccctcagcgtcgtcggggaccccccgggcaggacgggtcaccatctcttgtctggaancacctcaantcggaatactctagtaaactgtccagcactccgaggacggaccccaaagcctanatctatgcaagaatcacgcgtcctcgacggggtccngtacccgtattctcgtaggtcctactaagtccctcgaccacctcacgcccttccgngcctactcgtcggtcggcctcgtagtcgtaggaggagtggacgtacgttagttactttacgtacgtgtaacacgtaacgtaggttaggtacgttacgtacgtacgttaccgttacggttcggttcggttcgggttcgggttacgggtacgggtaacgggtaacggttaacggttacggttaccggtaccggttacgggtaccggtaccgtaccggtaaccggtaccgtcccggtcccgtacccggttaccgttaccgttacccgttacccgtttaccccgttaccccg

SEQ ID NO: 309009 - DNA, 616 bp, Homo sapiens
  misc_feature: GZ8MTXP02FHVGW.4.10.A10.1.454.CMB.2.raw
  modified_base (189)..(189): a, c, t, g, unknown or other
  misc_feature (189)..(189): n is a, c, g, or t
  modified_base (204)..(204): a, c, t, g, unknown or other
  misc_feature (204)..(204): n is a, c, g, or t
  modified_base (405)..(405): a, c, t, g, unknown or other
  misc_feature (405)..(405): n is a, c, g, or t
  modified_base (540)..(540): a, c, t, g, unknown or other
  misc_feature (540)..(540): n is a, c, g, or t
  modified_base (551)..(551): a, c, t, g, unknown or other
  misc_feature (551)..(551): n is a, c, g, or t
  modified_base (589)..(589): a, c, t, g, unknown or other
  misc_feature (589)..(589): n is a, c, g, or t
tcagagcactgtagcacgaccggtgctcgatttagcgtcgatctcagggggggtagagaagacaggactcaggacaatctccagcatggccagcttccctctcctcctcaccctcctcactcactgtgcagggtcctgggcccactctgtgctgactcagccaccctcagcgtctcgggacccccgggnagaggtcaccatctnttgttctggaacgcacctccaaacatcggaagtaatcctagtaaactggttccagcaactcccgaggacggacccccaaagtcctcatctatggtcagaatcagccgtcctcgacggggtcccctagaccgtatctctggctaccgaagtccctgaccacctcacgccccttcccgtggcccatcagtggcctccagttcngaggatggagtctgattattactgtagacaacgagtaggggactggaactacttacccgttcggttgggtcggtccggggttggttcgggggacggggtacggggaaccgtaacggttcggaacccggttccggnggggttacccncggacccgacggtcccgtcccgtccccgtcggtacccnccgttccgttcccgttccccgtccccg

SEQ ID NO: 309010 - DNA, 680 bp, Homo sapiens
  misc_feature: GZ8MTXP02FKOI5.4.10.A10.1.454.CMB.2.raw
  modified_base (189)..(189): a, c, t, g, unknown or other
  misc_feature (189)..(189): n is a, c, g, or t
  modified_base (282)..(282): a, c, t, g, unknown or other
  misc_feature (282)..(282): n is a, c, g, or t
  modified_base (308)..(308): a, c, t, g, unknown or other
  misc_feature (308)..(308): n is a, c, g, or t
  modified_base (320)..(320): a, c, t, g, unknown or other
  misc_feature (320)..(320): n is a, c, g, or t
tcagagcactgtagcacgaccggtgctcgatttagcgtcgatctcagggggggtagagaagacaggactcaggacaatctccagcatggccagcttccctctcctcctcaccctcctcactcactgtgcagggtcctgggcccactctgtgctgactcagccaccctcagcgtctcggggacccccggnaggagggtcaccatctcttgttctggaagcacctcaacatcggaataatcctagtaaactggtccagcaactccaggacggccccaaagtccnatctatggtcagaatcagccgtcccngacggggtcccngacccgtattctcgtggcctacctaagtccctacgaccacctccacgccccttcccgtgggaccctagttaccgagggtcgggtacctacccgaaggttccgtaggaacggtaagttcggaaacggggtccttaggtaacttttaacgttaaccgttgtacgacgtaaacgtagtaggggtaactacggactacgttaccgtacggtgggtcggtcgggttggttacgggacgggtaacgggtaacctaagggttccggacccggttccggtagggtaccaccggacccgtaacggtccgtcccgggtaccccccgttcgggtaccctaccgtttccgtcccggttaccccctacccccg

SEQ ID NO: 309011 - DNA, 722 bp, Homo sapiens
  misc_feature: GZ8MTXP02FJZFN.4.10.A10.1.454.CMB.2.raw
  modified_base (191)..(191): a, c, t, g, unknown or other
  misc_feature (191)..(191): n is a, c, g, or t
tcagagcactgtagcacgaccggtgctcgatttagcgtcgatctcagggggggtagagaagacaggactcaggacaatctccagcatggccagcttccctctcctcctcaccctcctcactcactgtgcagggtcctgggcccactctgtgctgactcagccaccctcagcgtctcggggaccccccgggnagaggtcaccatctcttgttctggaagcacctccaacatcggaatatcctagtaaactggtccagcaactcccgaggacggccccaaagtcctcatctatggtcaagaatcacgccgtcccctcgacggggtcccctggacccgtattccgtcgtggcctacccgaaagttcccctacgaaccctacccttcgaaccgtcccccttcccgtgggaccccctaagttccgacggggttcggggcccttcccgtaaggttccgttagggaacgggtagttacgggtaacgggtccttaggtaactttttaacgtttaccgttaggttacgaccgtaaaaccgtaggtaggggtaacttacggaacctacgtttacccgttacgggttgggtcggtccggggttggttccggggacgggtacggggtaacctaaggttccggacccggttcggtggggtaccaccgtacccgaacggtccctcccggtcccccgttcggtacctcccttcgttacccgttccccctaacccccg

SEQ ID NO: 309012 - DNA, 799 bp, Homo sapiens
  misc_feature: GZ8MTXP02IAX65.4.10.A10.1.454.CMB.2.raw
  modified_base (190)..(190): a, c, t, g, unknown or other
  misc_feature (190)..(190): n is a, c, g, or t
  modified_base (213)..(213): a, c, t, g, unknown or other
  misc_feature (213)..(213): n is a, c, g, or t
tcagagcactgtagcacgaccggtgctcgatttagcgtcgatctcgaggggggtagagaagacaggactcaggacaatctccagcatggccagcttccctctcctcctcaccctcctcactcactgtgcagggtcctgggcccactctgtgctgactcagccaccctcagcgtcgtcggggacccccggnaggaggtcaccatctcttgttcnggagcacctccaacatcggaataatctagtaaactgtcagcaactccaggaacggccccaaagtcctacatctatggtacaagaatcagccgtccctacgacggggtcccctaggaccgtatttcctcgtacggtcctaccgaaaggttcccctacgaaccctaacccttcgaacgtcccccgtttccccgtcgggaccctaacgttcccgtaaggggtccggggtccctaccccgtaaggtcccgttagggaaaccgggtacgttagggaacgggtcccttaggttaattttaacgtttaaaccgtggttacgaacccaaagtaggttgggggaacttacgggaacctacgttaccccgttaagggtggggttcgggtaccggggtttggggttaacccggggaccgggggtaaaacggggtaaaccccgttaaggggtttacccggtacccgggttaacccggtttcgggggtacccaacggggtacccccgttaaaggggcccccttaacccggtcccccccggttacgggtacccctaaccgtttccccggtttccccggtttaaaccccccttaccccccg

SEQ ID NO: 309013 - DNA, 603 bp, Homo sapiens
  misc_feature: GZ8MTXP02JGY4K.4.10.A10.1.454.CMB.2.raw
  modified_base (190)..(190): a, c, t, g, unknown or other
  misc_feature (190)..(190): n is a, c, g, or t
  modified_base (217)..(217): a, c, t, g, unknown or other
  misc_feature (217)..(217): n is a, c, g, or t
  modified_base (227)..(227): a, c, t, g, unknown or other
  misc_feature (227)..(227): n is a, c, g, or t
  modified_base (433)..(433): a, c, t, g, unknown or other
  misc_feature (433)..(433): n is a, c, g, or t
tcagagcactgtagcacgaccggtgctcgatttagcgtcgatctcagggggggtagagaagacaggactcaggacaatctccagcatggccagcttccctctcctcctcacccctcctcactcactgtgcagggtcctgggcccactctgtgctgactcagccaccctcagcgtctgggaccccccgggnagagggtcaccatctcttgtctggaancacctccaanatcggaataatcctagtaaactggttccagcaactccaggacggcccccaaagtccccatctatggtcagaatcagccgtccctgacggggtcccctggaccgtattctctcggcctccaaagtcctgacctacctcacgtccctccctggcccatccagttcgggctccgagtctgagtatgagtctagattaacttcgtggtanacctaagtagtggggattacggactacgttcccgttaaggtcggtggtcgggttgttcggggcggaacggacctaaggttccggaccgttccggtaggggtccacgggtacccgaaggccctaccgcccccgtgggaccctacgtccgtccgtcccccgtcccttacccg

SEQ ID NO: 309014 - DNA, 529 bp, Homo sapiens
  misc_feature: GZ8MTXP02I24U5.4.10.A10.1.454.CMB.2.raw
  modified_base (207)..(207): a, c, t, g, unknown or other
  misc_feature (207)..(207): n is a, c, g, or t
  modified_base (416)..(416): a, c, t, g, unknown or other
  misc_feature (416)..(416): n is a, c, g, or t
  modified_base (430)..(430): a, c, t, g, unknown or other
  misc_feature (430)..(430): n is a, c, g, or t
  modified_base (458)..(458): a, c, t, g, unknown or other
  misc_feature (458)..(458): n is a, c, g, or t
  modified_base (527)..(529): a, c, t, g, unknown or other
  misc_feature (527)..(529): n is a, c, g, or t
tcagagcactgtagcacgaccggtgctcgatttagcgtcgatctcaggggtccctgagactctcctgtgcagcctctggattcaccttcacctcgtatagcatgacctgggtccgccaggctccagggaaggggctggagtgggtctcatccattggtactggtagtccttacatatactacttagactcagtggaggggccattcnccatctccagagacgactccaagaactcagtgtatctgcacatggacagcctagagagccgaggacacggctgtgtatttcgtggtgggaggtcgtcgggtggtgcgtggaagaacggtcgttgacgttcggcggggaccagggaccctgggccaccgttctcctcacgcctaccgaacgacgggcccagtccgtccctccccgtgccncctgcctccgagcnccaccgtcgagcgcacgcgccgcgtgcncgcgtgacaggacctactaccacgtacgcgtctcgtcggacggcggtcgtaggcgaacggcgacagcgnnn

SEQ ID NO: 309015 - DNA, 597 bp, Homo sapiens
  misc_feature: GZ8MTXP02JVIMZ.4.10.A10.1.454.CMB.2.raw
  modified_base (187)..(187): a, c, t, g, unknown or other
  misc_feature (187)..(187): n is a, c, g, or t
  modified_base (282)..(282): a, c, t, g, unknown or other
  misc_feature (282)..(282): n is a, c, g, or t
  modified_base (320)..(320): a, c, t, g, unknown or other
  misc_feature (320)..(320): n is a, c, g, or t
  modified_base (327)..(327): a, c, t, g, unknown or other
  misc_feature (327)..(327): n is a, c, g, or t
  modified_base (331)..(331): a, c, t, g, unknown or other
  misc_feature (331)..(331): n is a, c, g, or t
  modified_base (358)..(358): a, c, t, g, unknown or other
  misc_feature (358)..(358): n is a, c, g, or t
tcagagcactgtagcacgaccggtgctcgatttagcgtcgatctcaggggggtagagaagacaggactcaggacaatctccagcatggccagcttccctctcctcctcaccctcctcactcactgtgcagggtcctgggcccactctgtgctgactcagccaccctcagcgtctgacgacccccggnaggaggtcaccatctcttgtctggaagcacctcaacatcggaataatcctagtaaactcggttccagcaactccgaggaacggccccaaagtccncatctagtggtacagatcagccgtccctgacgggtccngaccgtnttcngtgcctacacgtcagacctacctcacnccctccgtcggcctacgtccgaggtcggcctacgtacgtcgtaggacggatcggacgtacgtagtaactttacttacgtgtacgacaaacgtggtagggattacgacgtaactccgtaggttggtggtcgggttggttcgggaggacgggtaccgtaaggttccgacccgtcggtcggtcaccgcccgaaggtcccgtaccgtccccgttcggtcctaccgtccggttacctacccccg

SEQ ID NO: 309016 - DNA, 797 bp, Homo sapiens
  misc_feature: GZ8MTXP02HFUEQ.4.10.A10.1.454.CMB.2.raw
  modified_base (192)..(192): a, c, t, g, unknown or other
  misc_feature (192)..(192): n is a, c, g, or t
  modified_base (221)..(221): a, c, t, g, unknown or other
  misc_feature (221)..(221): n is a, c, g, or t
tcagagcactgtagcacgaccggtgctcgatttagcgtcgatctcagggggggtagagaagacaggactcaggacaatctccagcatggccagcttccctctcctcctcaccctcctcactcactgtgcagggtcctgggcccactctgtgctgactcagccaccctcagcgtcgtcggggaccccccgggnaggagggtcaccatctcttgttctggaancacctccaacatacggaatatctagtaactggtcagcaactccaggacggccccaaagtcctcatctagtcgtcaagatcagtccgtccctcgacggggtcccctgacccgtattccgtcgtcggtcctaccgaaggtcccctacgacctaccctacgacgtccccttcccgtcggaccatccgacggtcggcctacccgtagtacgtcggaaggtagtcgggaacggtaccttaggtaaattttaaacggttaccgtagggttacgaaccgtaaaacggtacggtttagggggaaaacttacggtaaactaccggtttacccgttacggggtacgggtttacggggtcgggggtttaccggggttaccgggggttaaaccggggaacgggggtaaaaccccggttttaaaacgggtccggggttaaaacccccggggttccgggttaacgggggtaccctaacccgggggacccccgtaaaacggggtcccccgttaacccgggtacccccccggttacgggttacccctaacccgttttccccgttacccggtttacccccccttaacccccgg

SEQ ID NO: 309017 - DNA, 795 bp, Homo sapiens
  misc_feature: GZ8MTXP02FW827.4.10.A10.1.454.CMB.2.raw
  modified_base (190)..(190): a, c, t, g, unknown or other
  misc_feature (190)..(190): n is a, c, g, or t
  modified_base (214)..(214): a, c, t, g, unknown or other
  misc_feature (214)..(214): n is a, c, g, or t
  modified_base (220)..(220): a, c, t, g, unknown or other
  misc_feature (220)..(220): n is a, c, g, or t
tcagagcactgtagcacgaccggtgctcgatttagcgtcgatctcagggggggtagagaagacaggactcaggacaatctccagcatggccagcttccctctcctcctcaccctcctcactcactgtgcagggtcctgggcccactctgtgctgactcagccaccctcagcgtctggggaccccccgggnaggaggtcaccatctcttgttcgnggaacnccacctaccaaacagtacggtaattaattctagttaaactggttaccagacaacctcccgaacgggaaccggaccccaaacgtccctacatctagtgtacaagaactcacgtccgtcccgtacggacggggtccctacgaccgtacttcctcgtcggcctaccgtaacgtccctacgaccctacccgtacaccgtccccttcccgtcgggaccctaacgtccgtacgggtcgggtaccttcccgtaacggttcgttaggaacgggtaagtacgggtacgggtcgttacgttaacttttaacgtttacgttggttacgaaccgtaaacgtaaggttaggggaacgtacgtaaccgttaacgttacccggttaacgggttcggggttcgggttacggggtttacgggttaccggggtaacgggggtaacgggggtaaacccgttaaacgggtttcccggtacccgggttcccggttacggggtacccgaccggtaccccggaaccggtacccgtcccggtccccccgttaccggttacccgtacccgttccgttccccggtttcccccgtacccccg

SEQ ID NO: 309018 - DNA, 695 bp, Homo sapiens
  misc_feature: GZ8MTXP02JTH0Q.4.10.A10.1.454.CMB.2.raw
  modified_base (432)..(432): a, c, t, g, unknown or other
  misc_feature (432)..(432): n is a, c, g, or t
tcagagcactgtagcacgaccggtgctcgatttagcgtcgatctcaggggggtagagaagacaggactcaggacaatctccagcatggccagcttccctctcctcctcaccctcctcactcactgtgcagggtcctgggcccactctgtgctgactcagccaccctcagcgtcgtcggggaccccccgggcagagggtcaccatctcttgttctggaagcacctccaacatcggaagtatcctagtaaactggtcagcactccgaggacggccccaaagtcctcactctatggtacagaatcgacgtccgtccctcgacggggtcccctgacccgtattcctcgtcggtcctaccgaagtccctacgacctaccctcacgtccccttcccgtcggccctaatccgagtcgggcctccgagttcgaggacggngtggaggtctagtatttacttacgtgtacgactaaagtgtaggggtactagacctacgttccgtaacgggttgggtacggtcggggtttcgggttccggggtaccggggtaaacgggtaacccgttaaaggggttccggtaaccccggttccgggtacggggtacccgaccgggtaaccccggtaacgggtcccgttcccggtccccccggttcggttacccgtacccgtttccccgtttcccggtaccccccttaccccccg

SEQ ID NO: 309019 - DNA, 803 bp, Homo sapiens
  misc_feature: GZ8MTXP02FKV38.4.10.A10.1.454.CMB.2.raw
  modified_base (289)..(289): a, c, t, g, unknown or other
  misc_feature (289)..(289): n is a, c, g, or t
  modified_base (350)..(350): a, c, t, g, unknown or other
  misc_feature (350)..(350): n is a, c, g, or t
tcagagcactgtagcacgaccggtgctcgatttagcgtcgatctcgagggggggtagagaagacaggactcaggacaatctccagcatggccagcttccctctcctcctcaccctcctcactcactgtgcagggtcctgggcccactctgtgctgactcacgccaccctcagcgtcgtcgggacccccgggcaggacggtcaccatctcttgttctggaacgcacctcaaacatcggaatatcctagtaaactggtaccagcaactccgaggaacggccccaaagtccncactctatggtacaagtaatcgacgtccgtccctacggacggggtcccctaggaacccgtntttcctctcggggccttaccgaaagttccccctacggaaccctaccccgttacgtaccgcccccttaccccgttcggggaccccctaaagttccgaacggggttccggggccctttacccgtaaacgtttccgtacgggtagggtaacgttacgggaacgggtcgttaggtaaacttttaagttaaccggttaggttacgaccgtaaaaacgtggttaacgggggtaacttacgggaaacttaccgtttacccggtaaacggtttgggttccggggtcgggtttacggggttccggggaacgggttaacggggaaccgttaaaacgggtttcgaaacccgggtttccggacggggttacctaaccgggaccccgtaaggggtccccttaaccggtaccccccgttgggtacccccttaacggtttccctaccggtttacccccttaacccccg

SEQ ID NO: 309020 - DNA, 638 bp, Homo sapiens
  misc_feature: GZ8MTXP02F4MCA.4.10.A10.1.454.CMB.2.raw
  modified_base (169)..(169): a, c, t, g, unknown or other
  misc_feature (169)..(169): n is a, c, g, or t
  modified_base (189)..(189): a, c, t, g, unknown or other
  misc_feature (189)..(189): n is a, c, g, or t
  modified_base (290)..(290): a, c, t, g, unknown or other
  misc_feature (290)..(290): n is a, c, g, or t
  modified_base (338)..(338): a, c, t, g, unknown or other
  misc_feature (338)..(338): n is a, c, g, or t
  modified_base (383)..(383): a, c, t, g, unknown or other
  misc_feature (383)..(383): n is a, c, g, or t
tcagagcactgtagcacgaccggtgctcgatttagcgtcgatctcgagggggggtagagaagacaggactcaggacaatctccagtatggccagcttccctctcctcctcaccctcctcactcactgtgcagggtcctgggcccactctgtgctgactcagccaccctnagcgtctggggacccccggnaggagggtcaccatctcttgttctggaagccacctccaaacatcggaataactcctagtaaacttgtccagcaactcccgaaggacggaccccaaagtccncatctatggtcagaatcagccgtccctcgacggggtccctggaccgtnttctcgtgcctccaaagtctcgaccaccgtcacgccctaccccgnggcccatcgaggtcggcctccgacggttctagaggtacgtgacggcgtagtaagttatttacgtgtgaccaataggtagggatacggactagtacccgttagttgggtcggttgggtcgggttcggggacggggaacgggtaaccggtaacggtttacgggcccgttaccgggtgggtaccgaacgtcccgaacgggtccctaccggcccccgttacggccgtaccttccgttccgttacccccgtacctccccg

SEQ ID NO: 309021 - DNA, 754 bp, Homo sapiens
  misc_feature: GZ8MTXP02GVYOV.4.10.A10.1.454.CMB.2.raw
  modified_base (222)..(222): a, c, t, g, unknown or other
  misc_feature (222)..(222): n is a, c, g, or t
  modified_base (232)..(232): a, c, t, g, unknown or other
  misc_feature (232)..(232): n is a, c, g, or t
  modified_base (292)..(292): a, c, t, g, unknown or other
  misc_feature (292)..(292): n is a, c, g, or t
tcagagcactgtagcacgaccggtgctcgatttagcgtcgatctcgaggggggtagagaagacaggactcaggacaatctccagcatggccagcttccctctcctcctcaccctcctcactcactgtgcagggtcctgggcccactctgtgctgactcagccaccctcagcgtccgtcggggaccccccggcaggacgggtccaccatctcttgtctggaanccacctcaanagtacgaatactcctagtaactggtccagcaactccgaaggacggaccccaaagtcctanatcagtggacagactcacgccgtccctgacggggtccctcgaccgtattctcgtcggacctaccgtaatccccgtacgaccctaccgtcgaccggcccttcccgtgggacccctaagtccgtaggtacgggtcccttacgaacggttccgtaggaaacgggtcgtacgggacgttacgttaagttaactttagttacgtacgtaccgtaacgtaaacggtaggttacgggaacttaccgtaaccttacggttacccggttacgggttacgggttcggggtacgggtttacgggtaccgggggtacgggtaaccggtaaccgttaaccgggttccggttaccggtttccgggtaacgggtacccggtaaccggtacccggtaaccggttccccgtaaccccggtacccccgttaacggtcccctacccggtttccccgttaccccggttacccccttaccccg

SEQ ID NO: 309022 - DNA, 520 bp, Homo sapiens
  misc_feature: GZ8MTXP01CH1EE.10.82.H05.1.454.CMB.2.raw
  modified_base (342)..(342): a, c, t, g, unknown or other
  misc_feature (342)..(342): n is a, c, g, or t
  modified_base (380)..(380): a, c, t, g, unknown or other
  misc_feature (380)..(380): n is a, c, g, or t
  modified_base (444)..(444): a, c, t, g, unknown or other
  misc_feature (444)..(444): n is a, c, g, or t
tcagcatagtagtgcacgaccggtgctcgatttagtcgagctctctcgcggggcttcagctgtgagcgcagaaggcaggactcgggacaatcttcatcatgacctgcctcccctctcctcctcacccttctcattcactgcacagggtcctgggcccagtctgtattgacgcagccgccctcagtgtctgcggccccaggacagaagtcaccatctctgctctggagcagttccaacattggaattcttatgtttcctggtaccagcacactccccgaggacggtcgacccccaaactccctacatatatgaagatagataagcgaccgtcagggattccgngaccgtaattctcgtgctcagtctgcacgtcgcctccngccatcgagtcggctccggcgaggatgacgcgtgtatttatacgtgtgtagcagtgggatgacngcctgagttgcttagtcgttacgttcggaacctggggaaccctaagggtcccaccggttcctaacgttcgaaccgg

SEQ ID NO: 309023 - DNA, 597 bp, Homo sapiens
  misc_feature: GZ8MTXP01DW7O8.10.82.H05.1.454.CMB.2.raw
tcagcatagtagtgcacgaccggtgctcgatttagtcgagctctctcgcgggggcttcagctgtgagcgcagaaggcaggactcgggacaatcttcatcatgacctgctccctctcctcctcacccttctcattcactgcacagggtcctgggcccagtctgtattgacgcagccgccctcagtgtctgcggcccaggacagaagtcacatctcctgctcgtggaggcagttccaactagttgggaattcttatgtttcctggtaccagcacactccccgaggacggtcgacccccaaactccctacatatatagaaagatagaataacgcgaccgtcgagggtattcccgtgacccgtaattctcgtcggtacctccgaagtccgtcgggctaccggtccgcccaccgtcgggacacgtccggaccggactccgagacgtcggggacgacggccgttagttttacgtggacggaacagtacggactaccgacgtcctgcgtagtgggtggtttcgggtttcgggacgggttagggaaccgagttcgttcgttacccgtaacgtaacgtcgacgaccgacgggtccttccgtccccg

SEQ ID NO: 309024 - DNA, 579 bp, Homo sapiens
  misc_feature: GZ8MTXP01BGMV4.10.82.H05.1.454.CMB.2.raw
tcagcatagtagtgcacgaccggtgctcgatttagtcgagctctctcgcgggggcttcagctgtgagcgcagaaggcaggactcgggacaatcttcatcatgacctgcctcccctctcctcctcacccttctcattcactgcacagggtcctgggcccagtctgtattgacgcagccgccctcagtgtctgccggccccaggacagaagtcaccatctcctgctcgtggagcagttccaacattggaattcttatgttcctggtaccagcacactcccgaggacggtcgacccccaaactcctacatatatagaagatgaataagcgaccgtcgaggtctcctgacccgtaattcctcgtgcctccaagtctcggccaccgtccgcccaccgtgggcacgtccgaccggactccgacgacgtcgggacgacggtaccgtagttttacgcggacgaacgtagtggactaccgacgcctgcgtagtgggtggttcgggtttcgggcgggacgggaccgaaggttcgttcgttacccgtaaccgtagtccgacggacccgacggtcccgttccggtcccccg

SEQ ID NO: 309025 - DNA, 547 bp, Homo sapiens
  misc_feature: GZ8MTXP01A0GW1.10.82.H05.1.454.CMB.2.raw
  modified_base (427)..(427): a, c, t, g, unknown or other
  misc_feature (427)..(427): n is a, c, g, or t
tcagcatagtagtgcacgaccggtgctcgatttagtcgagctctctcgcggggcttcagctgtgagcgcagaaggcaggactcgggacaatcttcatcatgacctgctcccctctcctcctcacccttctcattcactgcacagggtcctgggcccagtctgtattgacgcagccgccctcagtgtctgcggccccaggacagaaggtcaccatctcctgctctggagcagttccaacattggaattcttatgtttcctggtaccagcacatccccaggagtcgcccccaaactcctcatatatgaagatgataagcgaccgtccaggggattccgtgacccgaattctcgtggctccagtctcggcacgtcgccaccgtgggcatcgccgactccagacgtgggacgaggcccgtagtttttacgnggtacgaacgagtgggactaccgacgcctgcagtggtggttcggtttcgggcgggttacgggaccgtaaggccgttcgacccgtaacgtagtcgacgcccgaaggtccgttcgtcccccg

SEQ ID NO: 309026 - DNA, 583 bp, Homo sapiens
  misc_feature: GZ8MTXP01D8UDJ.10.82.H05.1.454.CMB.2.raw
  modified_base (347)..(347): a, c, t, g, unknown or other
  misc_feature (347)..(347): n is a, c, g, or t
  modified_base (446)..(446): a, c, t, g, unknown or other
  misc_feature (446)..(446): n is a, c, g, or t
tcagcatagtagtgcacgaccggtgctcgatttagtcgagctctctcgcgggggcttcagctgtgagcgcagaaggcaggactcgggacaatcttcatcatgacctgcctcccctctcctcctcacccttctcattcactgcacagggtcctgggcccagtctgtattgacgcagccgccctcagtgtctgcgccccaggacagaagtcaccatctcctgctctggagcagttccaatattggaattcttatgttcctggtaccagcacactccccaggacggtcgacccccaaatccctacaatactatagaagatagaataagcgaccgtcgagggtacttccgngaccgtaattctcgtgcctaccaagtctggcacgtccgccaccgtgggcagtccgaccggactccgagacgtcggggacgaggtccgttagttttacgnggacgaacagtggataccgagcctgcgtagtgggtggttcgggtttcgggacgggttacggaaccgtaaggttccgttcggttaccccgtcgtaaacgtccgacggcccgaacggtcccgttaacccggtccccccg

SEQ ID NO: 309027 - DNA, 649 bp, Homo sapiens
  misc_feature: GZ8MTXP01AQNAB.10.82.H05.1.454.CMB.2.raw
  modified_base (192)..(192): a, c, t, g, unknown or other
  misc_feature (192)..(192): n is a, c, g, or t
tcagcatagtagtgcacgaccggtgctcgatttagtcgagctctctcgcgggggcttcagctgtgagcgcagaaggcaggactcgggacaatcttcatcatgacctgcctcccctctcctcctcacccttctcattcactgcacagggtcctgggcccagtctgtattgacgcacgcccgccctcagtgtcngccgcccagacagaagtcacatctcctgctgtggagcacgttaccaatagttaggaattcttatcgttcctggtaccagcacacgtccccgaggacgtcccgacccccaaactcctacatatatagaagatagaatacgccgaccgtcgaggtacttccgagaccgtaattctcgtgacctacgagtctgggacctaccgtccgcccgaccgtcgggcacgtccgacccggtacctccgaacggtacggtacgggggaaccgtacgggtaccgttaaggttttaccgtcgggtaaccggaaacgtggtaacgggaccgtaccgtaacgtccgtcggaccgtaggttgggttcgggtttcggggtttcggggaccgggttacgggtaaccgaaggttccgttcggttacccgtaacgtaacggtcgaccggacccgacggtcccgttcccgtcccccg

SEQ ID NO: 309028 - DNA, 562 bp, Homo sapiens
  misc_feature: GZ8MTXP01EFH5Z.10.82.H05.1.454.CMB.2.raw
  modified_base (314)..(314): a, c, t, g, unknown or other
  misc_feature (314)..(314): n is a, c, g, or t
  modified_base (430)..(430): a, c, t, g, unknown or other
  misc_feature (430)..(430): n is a, c, g, or t
tcagcatagtagtgcacgaccggtgctcgatttagtcgagctctctcgcgggggcttcagctgtgagcgcagaaggcaggactcgggacaatcttcatcatgacctgctcccctctcctcctcacccttctcattcactgcacagggtcctgggcccagtctgtattgacgcagcccgccctcagtgtctgcggccccaggacagaagtcaccatctcctgctctggaggcagttccaacagttgggaattcttatgtttcctggtaccagcacatccccaggacgtcgcccccaaatccctacatatatgaanatagataagcgaccgtcagggtattccgtgaccgtaattctctgctaccagtctggcacgtcgccaccgtggcatcgccgactccgagcgtgggacgaggtccgttagttttacgnggtacggaactagtcgggacttaccgagcccgtgacgtagtcgggtggttcgggtttcgggcgggagggaccgtaacggcgttcggttacccgtaacctaagtcgacggacccaaggtccgttcgtcccccg

SEQ ID NO: 309029 - DNA, 691 bp, Homo sapiens
  misc_feature: GZ8MTXP01AHAE5.10.82.H05.1.454.CMB.2.raw
tcagcatagtagtgcacgaccggtgctcgatttagtcgagctctctcgcgggggcttcagctgtgagcgcagaaggcaggactcgggacaatcttcatcatgacctgctcccctctcctcctcacccttctcattcactgcacagggtcctgggcccagtctgtattgacgcagccgccctcagtgtctgccggccccaggacagaagtcaccatctcctgctctggagcagttccaactattgggaattcttatgtttcctggtaccagcacatccccgaggacggtccgaccccccaaactccctacaatactatagaaagatagataaacgccgaccgtcgagggtacttccgtagacccgtaatttcctcgtcggaccctaccgtaagtcctcgggacctacccggtccggaccccgaaccccggttcggggacctacgtcccggaccccggtaccttacccgaacggtaccggttacgggggaaccggtacgggtacccgttaacggttttttacgacgggtaccggtaaaccgtagttacgggaactacccgacgcccgtgacgtcggttgggtggttcgggttttcggggacgggttaacgggaccgtaacggttccgttcgttaccccggttccgtaaacgtcccgaccggacccgttacggtcccgttcccggtccccccgg

SEQ ID NO: 309030 - DNA, 590 bp, Homo sapiens
  misc_feature: GZ8MTXP01ETVPY.10.82.H05.1.454.CMB.2.raw
tcagcatagtagtgcacgaccggtgctcgatttagtcgagctctctcgcgggggcttcagctgtgagcgcagaaggcaggactcgggacaatcttcatcatgacctgcctcccctctcctcctcacccttctcattcactgcacagggtcctgggcccagtctgtattgacgcagcccgccctcagtgtctgccggccccaggacagaaggtcaccatctcctgctcgtggagcagttccaacattggaattcttatgttcctggtaccagcacactcccgaggacggtcgaccccctaaactcctacatatatagaaagatagataagcgaccgtcgagggtatccgtgtaccgaattcctcgtggacctaccgaagtccgtgggcctaccgtccggcccacccgtcgggcacgtccggaccggactccgacgacgtcggggacgacggccgttagttttacgtggtaccggaacgagtcgggactaccgacgccgtgcgtagtggtggttgggtttacggcgggttaggaccgaaggcgttcggacccgtaacgtagtccgacgcccgacggtccgttccgtcccccg

SEQ ID NO: 309031 - DNA, 640 bp, Homo sapiens
  misc_feature: GZ8MTXP01EMEG2.10.82.H05.1.454.CMB.2.raw
  modified_base (317)..(317): a, c, t, g, unknown or other
  misc_feature (317)..(317): n is a, c, g, or t
  modified_base (357)..(357): a, c, t, g, unknown or other
  misc_feature (357)..(357): n is a, c, g, or t
tcagcatagtagtgcacgaccggtgctcgatttagtcgagctctctcgcgggggcttcagctgtgagcgcagaaggcaggactcgggacaatcttcatcatgacctgcctcccctctcctcctcacccttctcattcactacacagggtcctgggcccagtctgtattgacgcagcccgccctcagtgtctcgccggccccaggacagaagtcaccatctcctgctcgtggagcagttccaaactagttggtaattcttatcgttcctggtaccagcacatcccgaggacgtcaccccaactcctacatatatgaanatagataacgcgacgtcgacggacttcagaccgtattccncttcggacctaccgaaacgttcgtacgggccaccggtcccggcccacccgtgggccagtcccggacccggtacctccgagaccggtacggggaaccgtacgggtaccgttagttttacggcggtacggaaacctaggtacggtaactaccgacgtaccgtgtacgtaggtgggttgggttcgggtttccggggcgggtaacgggaccgtaaacggtcgttacggccgttaaccgttaacggccgaacggacccgacggttccgtcccgttcccccgtaaccgg

SEQ ID NO: 309032 - DNA, 684 bp, Homo sapiens
  misc_feature: GZ8MTXP01AG12V.10.82.H05.1.454.CMB.2.raw
tcagcatagtagtgcacgaccggtgctcgatttagtcgagctctctcgcgggggcttcagctgtgagcgcagaaggcaggactcgggacaatcttcatcatgacctgcctcccctctcctcctcacccttctcattcactgcacagggtcctgggcccagtctgtattgacgcagcccgccctcagtgtctgccggccccaggacagaagtcaccatctcctgctcgtggagctagttccaactagttggaattcttatgttcctggtaccagcacactccccaggacgtccgaccccctaaactccctacatactatgaaagtatgaataacgccgaccgtcgagggtacttcccgtagacccgtaattcctcgtcggcctaccgaacgtcgtcggcctaccggtccgccctacccgtcgggcctacgtcccggacccggtacctcccgacggaccggtacgggggaaccggtacgggtacccggttaacggtttttaccgacgggtaaccggaaaccgtaacggttacggggaacttacccgaacggtccctggaccgtaaggttcgggttaaggttcgggttttcgggacggggttacgggaacccgtaaggttccgttcggttacccgttaaccgtaacgtccgaccggacccgaacggtcccgttcccggtccccccgg

SEQ ID NO: 309033 - DNA, 574 bp, Homo sapiens
  misc_feature: GZ8MTXP01DZI5S.10.82.H05.1.454.CMB.2.raw
  modified_base (354)..(354): a, c, t, g, unknown or other
  misc_feature (354)..(354): n is a, c, g, or t
tcagcatagtagtgcacgaccggtgctcgatttagtcgagctctctcgcgggggcttcagctgtgagcgcagaaggcaggactcgggacaatcttcatcatgacctgcctcccctctcctcctcacccttctcattcactgcacagggtcctgggcccagtctgtattgacgcagcccgccctcagtgtctgccggccccaggacagaagtcacatctcctgctctggagcagttaccaactattggaattcttatgtttcctggtaccagcacactcccaggacggtccgaccccctaaactccctacaatactatagaagatagataacgcgaccgtcgagggtacttccgngaccgtaattctcgtgcctaccgaagtcgtggcacgtccgccacccgtcgggcacgtccgacccggacctccgacgacgtacggggacgacgtaccgttagttttacgtgacgtaacgagtcggtactacgacgtctgctgtggtggttcggtttcgggcggacggaccgagttcgttcgttaccgtcctacgtcgacgcccgagtccgttccgtccccg

SEQ ID NO: 309034 - DNA, 681 bp, Homo sapiens
  misc_feature: GZ8MTXP01DCF1D.10.82.H05.1.454.CMB.2.raw
  modified_base (327)..(327): a, c, t, g, unknown or other
  misc_feature (327)..(327): n is a, c, g, or t
  modified_base (553)..(553): a, c, t, g, unknown or other
  misc_feature (553)..(553): n is a, c, g, or t
tcagcatagtagtgcacgaccggtgctcgatttagtcgagctctctcgcgggggcttcagctgtgagcgcagaaggcaggactcgggacaatcttcatcatgacctgcctcccctctcctcctcacccttctcattcactgcacagggtcctgggcccagtctgtattgacgcagccgccctcagtgtctgccggccccaggacagaagtcaccatctcctgctcgtggagcacgttaccaatgttgggtaatttcttatcgtttcctggtaccagcacactcccgaggacgtccgaccccctaaactcctacaatatatagaaagntagaataacggccgtacccgttacgaacgggtacttccgtacgacccgtaacttcctcgtacgggtcccttaaccgtaaacggtcccgtacgggacccgtacccgggtcccggtaccccgtacccggttcggggaccctaccggttcccggacccggtaccgtaccggaacggaccggtacggggaacgtacgggtaccgttaacgttttacgacggtacgaacgngtacggactaccgacgccgtgacgtgtgggttggttcgggttcgggacgggaggtaaccgtacggttccgttcgttacccgtaacgtaacgtccgaccggacccgacggtcccgttcccggtcccccg

SEQ ID NO: 309035 - DNA, 585 bp, Homo sapiens
  misc_feature: GZ8MTXP01DHDCY.10.82.H05.1.454.CMB.2.raw
  modified_base (401)..(401): a, c, t, g, unknown or other
  misc_feature (401)..(401): n is a, c, g, or t
  modified_base (443)..(443): a, c, t, g, unknown or other
  misc_feature (443)..(443): n is a, c, g, or t
  modified_base (453)..(453): a, c, t, g, unknown or other
  misc_feature (453)..(453): n is a, c, g, or t
  modified_base (478)..(478): a, c, t, g, unknown or other
  misc_feature (478)..(478): n is a, c, g, or t
  modified_base (500)..(500): a, c, t, g, unknown or other
  misc_feature (500)..(500): n is a, c, g, or t
tcagcatagtagtgcacgaccggtgctcgatttagtcgagctctctcgcgggggcttcagctgtgagcgcagaaggcaggactcgggacaatcttcatcatgacctgcctcccctctcctcctcacccttctcattcactgcacgagggtcctgggcccagtctgtattgacgcacgcccgccctcagtgtctcgccggccccagacagaagtcaccatctctgctcgtggagcagttaccaatattgggtaattcttatcgtttctggtaccagtcacactcccgaggacggtccgaccccctaaactcctacaattatatcgaaatagtgaataaacgcgaccggtcgaggggtacttccgtagacccgttaattcctcgtggccctaccgaagttccncgggtcaccggtccgccacccgtgggacacgtcgccggtacnccgaggacgnggggaacgagtccgtagttttacgnggtaccgacagttggactacgngcgtgcgtagtggtggttgggttcggacgggaggtaccagttcgcgaccgtcgtaacgcgacgaccgagtccgttccgtcccccg

SEQ ID NO: 309036 - DNA, 663 bp, Homo sapiens
  misc_feature: GZ8MTXP01BFACJ.10.82.H05.1.454.CMB.2.raw
  modified_base (192)..(192): a, c, t, g, unknown or other
  misc_feature (192)..(192): n is a, c, g, or t
  modified_base (213)..(213): a, c, t, g, unknown or other
  misc_feature (213)..(213): n is a, c, g, or t
  modified_base (219)..(219): a, c, t, g, unknown or other
  misc_feature (219)..(219): n is a, c, g, or t
tcagcatagtagtgcacgaccggtgctcgatttagtcgagctctctcgcgggggcttcagctgtgagcgcagaaggcaggactcgggacaatcttcatcatgacctgcctcccctctcctcctcacccttctcattcactgcacgagggtcctgggcccagtctgtattgacgcagcccgccctcagtgtcngccgcccaggacagagtcacntctccngctcgtggagcagttaccaactagttggtaattcttatcgttccgtggtaccagacacactcccgaggacgtccgaccccctaaactccctacaatatagtagaaagacttagaactaacgccgtaccgtacgagggtacttcccgagtacccgtaatttccctcgtcggtactaccgtaacgtcgtacgggactacccggtcccggacccctacccggcgggaccgaaccgttcccggacccggtacctccgacggacggtacggggaacggacggtaccgttaacgttttacgtacggtacggtaacgtacggtacggacgtaccgtacgtccgtcggactacggttgggttcggttacgggtttcgggacgggttacggaccgtaacgttcgttcggaccgtaacgtacgtaacgccgacgaccgtccgaacccgtccccg

SEQ ID NO: 309037 - DNA, 608 bp, Homo sapiens
  misc_feature: GZ8MTXP01A6EBP.10.82.H05.1.454.CMB.2.raw
tcagcatagtagtgcacgaccggtgctcgatttagtcgagctctctcgcgggggcttcagctgtgagcgcagaaggcaggactcgggacaatcttcatcatgacctgcctcccctctcctcctcacccttctcattcactgcacagggtcctgggcccagtctgtattgacgcagcccgccctcagtgtctgccggcccaggacagaagtcaccatctcctgctcgtggaggcagttaccaactagttgggaatttcttatgtttcctggtaccagcacactcccgaggacggtccgacccccaaactccctacaattactatagaaagatagaataacgcgaccgtcgaggggtacttccgtcgaccgtaattctctggcctacgaagtctggcaccgtcgcccacccgtcgggcacgtcggacccggacctccgacggacggtcggggacgtacgggtccgttaggttttacgtggtacggaacgtagtacgggactaccgacgtccgtagcgtagttgggtggttcgggtttcgggacgggttacgggacgtaggcgttcggaccgtaactacgtccgacgcccgacggtccgttccgtcccccg

SEQ ID NO: 309038 - DNA, 567 bp, Homo sapiens
  misc_feature: GZ8MTXP01EKPUX.10.82.H05.1.454.CMB.2.raw
tcagcatagtagtgcacgaccggtgctcgatttagtcgagctctctcgcgggggcttcagctgtgagcgcagaaggcaggactcgggacaatcttcatcatgacctgctcccctctcctcctcacccttctcattcactgcacagggtcctgggcccagtctgtattgacgcagccgccctcagtgtctgccggccccaggacagaaggtcaccatctcctgctctggagcagttccaacagttggaattcttatgtttcctgtaccagcacactaccaggacgtcgacccccaaactcctcaatatatagaagatagaataagcgaccgtcgacgggtacttccgtgacccgtaattctcgtcggtctaccaagtctcggcacgtccgcccacccgtgggcacgtcgaccggactccgacgacgtcggggacgacggccgttaacggttttacgtggacggtaacgagtcgggactaccgacgccgtgcagttcgggtgttcgggtttcgggcgggttaggaccgtaagcgttgactcgtctaagtcacgcccgtaagccgtcccg

SEQ ID NO: 309039 - DNA, 717 bp, Homo sapiens
  misc_feature: GZ8MTXP01BYM9S.10.82.H05.1.454.CMB.2.raw
tcagcatagtagtgcacgaccggtgctcgatttagtcgagctctctcgcgggggcttcagctgtgagcgcagaaggcaggactcgggacaatcttcatcatgacctgcctcccctctcctcctcacccttctcattcactgcacgagggtcctgggcccagtctgtattgacgcagcccgccctcagtgtctgccggcccaggacagagtcacatctcctgctcgtggagctagttaccaatagttaggtaattcttatcgtttcctggtaccagcacactccccgaggacggtccgacccccctaaactcctacaatatatagaaagatagaataacggccgaaccgtcgagggtacttcccgagtacccgtaattccctcgtcgggacctaccgtaacgttccgtacgggaccgtacccggtcccggcccgtacccggttcggggcctaccggtcccgggtaccccggtaccgtaccgaacgggtaccgggtacgggggaccggtaacgggtacccggtttaaggtttttaccggacggtaaccgggtaaacgtacggtacggggtaacctaacccgtacggtcccgtggtaccgtacgggttgggttcgggttacggggtttccggggacgggttaacgggaccgtaacggttccgttcggttacccgtaacgtaacgtccgaccggtaccgacggtcccgttcccgtcccccg

SEQ ID NO: 309040 - DNA, 638 bp, Homo sapiens
  misc_feature: GZ8MTXP01D48DP.10.82.H05.1.454.CMB.2.raw
tcagcatagtagtgcacgaccggtgctcgatttagtcgagctctctcgcgggggcttcagctgtgagcgcagaaggcaggactcgggacaatcttcatcatgacctgcctcccctctcctcctcacccttctcattcactgcacagggtcctgggcccagtctgtattgacgcagcccgccctcagtgtctgccggcccaggacagaagtcaccatctctgctcgtggagcacgttaccaactagttggtaattcttatcgttctggtaccagcacactcccgaggacggtccgaccccctaaactcctacatatatagaaagatagaataacggcgaccgtcgagggtacttccgtagacccgtaacttctcgtggtcctaccgtaagtcgtggacctaccggtccgcccgtaccggtcgggcctacgtcccgacccggtacctaccgacggacggtcggggacgtacgggtccgttacggttttacgtcggacggaacgtaggtacggactaccgacgtcgtgtacgtagtgggttcggttcgggtttccggggacgggttaacgggtaccgaacggttccgttcggacccgtaacgtaacgtccgacgacccggacggtcccgttccgtcccccg

SEQ ID NO: 309041 - DNA, 788 bp, Homo sapiens
  misc_feature: GZ8MTXP01A3CYM.10.82.H05.1.454.CMB.2.raw
  modified_base (262)..(262): a, c, t, g, unknown or other
  misc_feature (262)..(262): n is a, c, g, or t
tcagcatagtagtgcacgaccggtgctcgatttagtcgagctctctcgcgggggcttcagctgtgagcgcagaaggcaggactcgggacaatcttcatcatgacctgcctcccctctcctcctcacccttctcattcactgcacagggtcctgggcccagtctgtattgacgcagcccgccctcagtgtctgccggcccaggacagagtcaccatctctgctcgtggagcagttaccactagttggaattcttatgtttccngtaccagcacactcccgaggacgtccacccccaaatccctataatatatagaaagtataggtaataacggcgtaccgtaccgaacgggtacttcccgtagacccgtaacttcgtcgtcgggtacctacccgtaacgttcgtacgggacctaacccggtcccgggtacccgtaaccccggttcggggacccgtaccggtacccgggtacccccgggtacccgttaccccggaaacgggtacccgggttaccggggggaacccggtaacggggttacccccgttaacggggtttttttaacccggaccggggtaaccgggtaaaccgttaaccgggtacggggtaaccgttaaccccgtaaccggtcccggttacgggtaccgttaaccgggtttgggggttaacgggttttacggggttttaccgggggaccgggttaacggggtaacccgtaacgggttccgttaccggttacccgttaaccgtacggtaacgaccggtacccgacggtcccgttccgtcccccgg

SEQ ID NO: 309042 - DNA, 663 bp, Homo sapiens
  misc_feature: GZ8MTXP01CUVPG.10.82.H05.1.454.CMB.2.raw
tcagcatagtagtgcacgaccggtgctcgatttagtcgagctctctcgcgggggcttcagctgtgagcgcagaaggcaggactcgggacaatcttcatcatgacctgcctcccctctcctcctcacccttctcattcactgcacagggtcctgggcccagtctgtattgacgcagccgccctcagtgtctgccggccccaggacagaagtcaccatcctcctgctcgtggagctagttccaactagttgggaattcttatgtttcctggtaccagcacactcccaggacgtcgacccccaaatcctacatatatagaaagatgaataacgcgaccgtacgagggtacttccgacgtacccgtaatttccgtcgtcggtaccctaccgaagtccgtacgggcctaccggtcccggaccctaccccggtcggggacctacgtcccggaccggtacctaccgacggaccggttacgggggaaccgtacgggtacccgttaaggtttttacgcggtaaccggtaaactaggtacgggaaccttaccgacgtccctggccgtagtggggttggttcggggtttcggggacgggacgggtaaccgaagttccgttcggttaccgtaaccgtaacgtcgacggcccgaacggtcccgttccggtcccccg

SEQ ID NO: 309043 - DNA, 700 bp, Homo sapiens
  misc_feature: GZ8MTXP01AS5N0.10.82.H05.1.454.CMB.2.raw
tcagcatagtagtgcacgaccggtgctcgatttagtcgagctctctcgcgggggcttcagctgtgagcgcagaaggcaggactcgggacaatcttcatcatgacctgctcccctctcctcctcacccttctcattcactgcacagggtcctgggcccagtctgtattgacgcagccgccctcagtgtctgccggccccaggacagaacggtcaccatctcctgctctggaggcagttccaactagttagggtaatttcttatcgtttcctggtaccagcacactccccgaggacgtccgaccccctaaactccctacaattatatacgaaagatagaataacgccgaccgtcgaggggtacttccgtagacccgtattctcgtggcctacgagtctaggcctacgtccgcccaccgtcgggacacgtccggacccggaccgtaccgacgggtaccggtacgggggaaccggtacgggttaccccggttaaggttttttaacggacggtaccgggaaacgtacggtacggggtaacctacccgtacgtcccgtagaccgtaggttggggttcggtttcgggggttttacggggaccggggaacggggaaccgtaacgggttaccggttccggttaacccgttaacccggtaacgtccgacccgggaccccgttaacgggtcccgttcccggtcccccccgg

SEQ ID NO: 309044 - DNA, 562 bp, Homo sapiens
  misc_feature: GZ8MTXP01D5KV2.10.82.H05.1.454.CMB.2.raw
  modified_base (217)..(217): a, c, t, g, unknown or other
  misc_feature (217)..(217): n is a, c, g, or t
  modified_base (236)..(236): a, c, t, g, unknown or other
  misc_feature (236)..(236): n is a, c, g, or t
  modified_base (255)..(255): a, c, t, g, unknown or other
  misc_feature (255)..(255): n is a, c, g, or t
  modified_base (330)..(330): a, c, t, g, unknown or other
  misc_feature (330)..(330): n is a, c, g, or t
  modified_base (340)..(340): a, c, t, g, unknown or other
  misc_feature (340)..(340): n is a, c, g, or t
tcagcatagtagtgcacgaccggtgctcgatttagtcgagctctctcgcgggggcttcaactgtgagcgcagaaggcaggactcgggacaatcttcatcatgacctgctcccctctcctcctcacccttctcattcactgcacagggtcctgggcccagtctgtattgacgcagccgccctcagtgtctgcgcccaggacagaagtcaccatctccngctctggagcagttccaanattggaattctatgttccnggtaccagcacatcccgaggacgtcgacccccaaactcctcatatatgaagatgataagcgacgtcacggcttcngacctattcnctgctcgaagtctggcacgtccgccaccgtggcacgtcgccgactccgagacgtgggacgacggtaccgtattttacggaggacggtaacagtcggactaccgagtcctgtcgtagtgggtcggttgggtttcggacgggtacggaccgtaaggtccttacggttacccgttaccgtaacgtccgaacgccccgaggttccctcccggttcccccgttccgg

SEQ ID NO: 309045 - DNA, 715 bp, Homo sapiens
  misc_feature: GZ8MTXP01AR3RF.10.82.H05.1.454.CMB.2.raw
  modified_base (185)..(185): a, c, t, g, unknown or other
  misc_feature (185)..(185): n is a, c, g, or t
tcagcatagtagtgcacgaccggtgctcgatttagtcgagctctctcgcgggggcttcagctgtgagcgcagaaggcaggactcgggacaatcttcatcatgacctgcctcccctctcctcctcacccttctcattcactgcacgagggtcctgggcccagtctgtattgacgcacgccgccctnagtcgtctcgccggcccaggaccaggaacgtcaccatcctcctgctcgtggagcacgttaccaacagttaggtaattcttatcgtttcctaggtaccagcacactcccgaggacgtcccgacccccaaatcctacgaattatatagaagtactagtaagtaacggcgtaccgtccgaacggggtacttcccgtacgaccgttaacgtttccgtccgttgggtaccctacggtaagttccgtacgggaccgtacccggtcccggacccgaacccggtcggggacctaccggtacccggacccggtaccgaccgacgggtaccgggttacggggaaccggtacgggtaccgttacggttttaacgacggtacggaacgacgtaggaccgtaccgacgtcgtagtcgtaggttcgggttgggttcgggtttacgggacgggttaacgggaaccgtaacggttcgttaccggttaacccgttaaccgtaacggtaaccgaccgacccggaccggtcccgttaaccgtcccccgg

SEQ ID NO: 309046 - DNA, 668 bp, Homo sapiens
  misc_feature: GZ8MTXP01ADWFL.10.82.H05.1.454.CMB.2.raw
  modified_base (192)..(192): a, c, t, g, unknown or other
  misc_feature (192)..(192): n is a, c, g, or t
  modified_base (308)..(308): a, c, t, g, unknown or other
  misc_feature (308)..(308): n is a, c, g, or t
tcagcatagtagtgcacgaccggtgctcgatttagtcgagctctctcgcgggggcttcagctgtgagcgcagaaggcaggactcgggacaatcttcatcatgacctgcctcccctctcctcctcacccttctcattcactgcacgagggtcctgggcccagtctgtattgacgcacgccgccctcagtgtcncgcgcccaggacagagtcacatctcctgctcgtggacgctacgttccaactagttaggtaattcttatcgtttcctggtaccagcacactccgaggacgtccacccccaactcctnatatatagaagatagataacgcgacgtcgaggtactccgtagaccgtaacttcctcgtcgggtcctaccgtaacggttccgtacggccgtaccggtcccgcccgtaccccgtcgggccacggtacccggaccccggtactacccgaacgggtaccggtacgggggaaccgtaccgggtaccgttaacggtttttcgacgggtaccgtaaacgtacggtacggaccgtaccgtacgtcccgtgaccgtaggttgggttcgggtttcggggtttaccggggacgggttacgggtaaccgtaaggttcgttacggttacccgtaacgtacgcgaccgacccgacggtccgttcccggtccccg

SEQ ID NO: 309047 - DNA, 625 bp, Homo sapiens
  misc_feature: GZ8MTXP01C0IKY.10.82.H05.1.454.CMB.2.raw
tcagcatagtagtgcacgaccggtgctcgatttagtcgagctctctcgcgggggcttcagctgtgagcgcagaaggcaggactcgggacaatcttcatcatgacctgcctcccctctcctcctcacccttctcattcactgcacagggtcctgggcccagtctgtattgacgcagcccgccctcagtgtctgccggcccaggacagaagtcaccatctctgctcgtggagcagttccaactagttagggaattcttatcgtttcctggtaccagcacactcccgaggacgtcgacccccaaatccctacatatatagaagatagaataacgcgaccgtcgagggtacttccgtgacccgtaattctcgtcggtcctacccgaagtccgtcggaccacccggtccgacccgacccgtcgggaccacgtccggaccgacctaccgacgacggtgggacgtacggtaccgttacgttttacgcggtacgaacgtagtacggactaccgacgtcctgtctaggttgggttggttcgggtttcgggacgggacgggtaaccgaggttccgttcgttacccgttaaccgtaacggtccgacggacccgacggtcccgttcccgtcccccgg

SEQ ID NO: 309048 - DNA, 793 bp, Homo sapiens
  misc_feature: GZ8MTXP01AGCMB.10.82.H05.1.454.CMB.2.raw
  modified_base (309)..(309): a, c, t, g, unknown or other
  misc_feature (309)..(309): n is a, c, g, or t
tcagcatagtagtgcacgaccggtgctcgatttagtcgagctctctcgcgggggcttcagctgtgagcgcagaaggcaggactcgggacaatcttcatcatgacctgcctcccctctcctcctcacccttctcattcactgcacagggtcctgggcccagtctgtattgacgcagccgccctcagtgtctgccggccccaggacagaagtcaccatctcctgctcgtggagcagttccaactagttgggaattcttatcgtttcctggtaccagcacactcccaggacgtccgacccccaaatccctanatatatagaagatagaataagcgaccgtcgaagggtacttcccgtagaccgtaatttcctcgtcgggtaccctaccgtaaacggttccgtacggggtacccaacccgggttcccgggtaccccgtaccccggttacggggacccgtaaccggttcccgggaccccgggtacccgttacccgaaccggggtaaccgggttaccggggggaacccggtacggggttaccccggtttaacgggttttttaaccggtaccggggtaaccgggtaaacccgtaagggttacgggggtaaaccttaacccggaccggtacccgttacgggtacccgtaaggtttcgggggtttaacgggtttcgggggtttttcccgggggacggggttaacggggtaacccgtaaacgggttccgttaccggttacccggttaaccgtaacggtccgaaccgggacccgttaacgggtcccgttcccggttccccccgg

SEQ ID NO: 309049 - DNA, 668 bp, Homo sapiens
  misc_feature: GZ8MTXP01DM751.10.82.H05.1.454.CMB.2.raw
  modified_base (315)..(315): a, c, t, g, unknown or other
  misc_feature (315)..(315): n is a, c, g, or t
tcagcatagtagtgcacgaccggtgctcgatttagtcgagctctctcgcggggcttcagctgtgagcgcagaaggcaggactcgggacaatcttcatcatgacctgcctcccctctcctcctcacccttctcattcactgcacagggtcctgggcccagtctgtattgacgcagccgccctcagtgtctgcggccccaggacagaagtcaccatctcctgctcgtggagcagttccaactattgggaattcttatgtttcctggtaccagcacactcccaggacgtcgacccccaaatcctacatatatgaaagntagaataacgcgaccgtgaggtacttccgtcgaccgtattcgtcgtgggtcctcgtaaagtcgtcgggccgtaccgtccggtcccgtacccgtcgggactacgtccggacccgggacctccgacgacgtacggggaacgtacggtccgttaagtttttacgtaggtaccggaacgtacggtagggtaactacccgaacgtccgtacggtaccgtggttgggtttcggtttcggggtttttccggggacgggttaaaccggggtaacccgaaggttccgttcggttaacccgggttaacccttaaacggtccgaaccgggtacccgaaacggtcccgttcccggttcccccccg

SEQ ID NO: 309050 - DNA, 664 bp, Homo sapiens
  misc_feature: GZ8MTXP01BGV3Y.10.82.H05.1.454.CMB.2.raw
tcagcatagtagtgcacgaccggtgctcgatttagtcgagctctctcgcgggggcttcagctgtgagcgcagaaggcaggactcgggacaatcttcatcatgacctgcctcccctctcctcctcacccttctcattcactgcacagggtcctgggcccagtctgtattgacgcagcccgccctcagtgtcgtgccggcccaggacagaacgtcacatcctctgctcgtggagtctacgttaccaacgtagttagggtaatttcttatcgtttacctcggtaccagcctactacgtccccgagggtaccgtccgacccccctaaacgtccctactaataatagtacgaagtagtagaagtaacggcgtaccgtacgagggtacttccgtacgacctaattcctcgtcggtacctaccgtaacggtcgtcggaccgtaccggtccgacccgtaccggtcggaccgacgtcccggaccggtacctaccgaacggtaccggtacggggacgtacggtaccgtttaggttttacgacggtacgaacgtacggtacggactaccgacgtctcgacgtagttgggtggttcgggttcgggacgggttacggacgtaacgttcgttcgttaccgtaacgtagtccgacgaccgacgtccgttcccgtccccg

SEQ ID NO: 309051 - DNA, 721 bp, Homo sapiens
  misc_feature: GZ8MTXP01EZXN8.10.82.H05.1.454.CMB.2.raw
  modified_base (272)..(272): a, c, t, g, unknown or other
  misc_feature (272)..(272): n is a, c, g, or t
tcagcatagtagtgcacgaccggtgctcgatttagtcgagctctctcgcgggggcttcagctgtgagcgcagaaggcaggactcgggacaatcttcatcatgacctgcctccctctcctcctcacccttctcattcactgcacagggtcctgggcccagtctgtattgacgcacgcccgccctcagtgtctcgccggccccaggacagaacgtcaccatctcctgctcgtggaggctagttccaactagttgggaatttcttatcgtttccnggtaccagccaacactccccgaggtacggtaccgacccccaaactcctactaacttaatactaggaaagtactagaaactaaacggccgtaaccggtaccgaaggggtacttacccgtagaacccgtaactttcgtcgtcgggacccttaccgaagttccgtacgggacctacccggtcccggccccgtacccgtcgggaccgtaccgtcccggtacccggaccgtacccggaacggtaccgggttacggggaaccggtacgggtaccgttacggttttaccgtacgggtacgaacgtaggtacgggtactaccgacgtcctgtacgtaggtgggttcggtttcgggtttccgggacgggttaacgggtaaccgaacgggttacgttccggacccgttaaccgtaacgtcgtaccggacccgttaacggtcccgttcccggtcccccgg

SEQ ID NO: 309052 - DNA, 668 bp, Homo sapiens
  misc_feature: GZ8MTXP01BUEU1.10.82.H05.1.454.CMB.2.raw
  modified_base (528)..(528): a, c, t, g, unknown or other
  misc_feature (528)..(528): n is a, c, g, or t
tcagcatagtagtgcacgaccggtgctcgatttagtcgagctctctcgcgggggcttcagctgtgagcgcagaaggcaggactcgggacaatcttcatcatgacctgctcccctctcctcctcacccttctcattcactgcacagggtcctgggcccagtctgtattgacgcagcccgcctcagtgtctgccggcccaggacagagtcacatctctgctcgtggagctagttccaactattggattcttatgttcctggtaccagcactactcccaggacgtcgaccccccaaactccctacgaatatagtagaaagtatagaataaaggccgaaccgtccgaagggtacttcccgtaggaacccggttaattccctcgtcgggtacctaccctaaagtcgtcgggaccgtaaccggttccgggaccctaacccggtggggaccctacggtcccggaccccgggtactcccgaacggaccggttacgggggaaccgtacggggtaccccgttaaggtttttaaccggngggtaaccggaaacgtagtacggggtactaccgaacggtcctaggacctggtggtgggtttcggtttcgggacggttaaggggacccagttacgttcgaccgtaacctagaaccacggcccaaggtccgttcgtcccccg

SEQ ID NO: 309053 - DNA, 658 bp, Homo sapiens
  misc_feature: GZ8MTXP01DIWAG.10.82.H05.1.454.CMB.2.raw
  modified_base (334)..(334): a, c, t, g, unknown or other
  misc_feature (334)..(334): n is a, c, g, or t
tcagcatagtagtgcacgaccggtgctcgatttagtcgagctctctcgcgggggcttcagctgtgagcgcagaaggcaggactcgggacaatcttcatcatgacctgcctcccctctcctcctcacccttctcattcactgcacgagggtcctgggcccagtctgtattgacgcacgcccgccctgagtgtctggccggaccccaggacagaacgtccactatctctgctcgtggagctagttaccaactagttaggtaatttcttatcgtttcctaggtaccagacactactccgaggacgtcccaccccctaatcctacatatatagaaatnagaagtaacgccgaccgtacggacggtactttccgacgtacccgtaattccgtcggtacggtacccttaacccggtaacgttcccggtacgggacccgtaacccgggtcccggacccgtacccggtcgggacctacggtacccggaccggtacctaccggacggtacgggtacgggacgtacggtaccgttagtttcgacggtacgtaacgaggtacgactacgacgcgtgtacgtaggtcggtaaggttcgggttcgggacgggttacgacgtacgcgttcgaccgtaacgagtcgacgtaccgacggtccgttccgtccccg

SEQ ID NO: 309054 - DNA, 721 bp, Homo sapiens
  misc_feature: GZ8MTXP01BKMR8.10.82.H05.1.454.CMB.2.raw
  modified_base (385)..(385): a, c, t, g, unknown or other
  misc_feature (385)..(385): n is a, c, g, or t
tcagcatagtagtgcacgaccggtgctcgatttagtcgagctctctcgcgggggcttcagctgtgagcgcagaaggcaggactcgggacaatcttcatcatgacctgctcccctctcctcctcacccttctcattcactgcacgagggtcctgggcccagtctgtattgacgcagcccgccctcagtgtctgccggccccaggacagagtcacatctctgctgtggagctacgttaccaatagttgggtaatttcttagtcgtttccgtcggtaccagcacacgtcccgagggacggtccgacccccctaaacgtcctacatagtatagaagtatagaataacggcgtacccggtcgacgggtacttccgagtacctaactttcncgtcggtacctaccgtacggtccgtaggccgtaacccgggtccggaccccgtacccggtcgggcctaacggtcccggacccggtaaccgtcccgaacgggtaccgggtacggggtaacggaccgggttacctttacgggttttacgtacgggaccgaaccgtgtacgggtaacctaccggaccgtccgtgtaccgtaagggttcggggttcgggtttcggggtttaccgggggacggggttaccggaacccggtaaggttacccgttcggttacccgttaaccgttaaccggccgaaccggtcccgaacggtcccgttccccggttaaccccccgg

SEQ ID NO: 309055 - DNA, 555 bp, Homo sapiens
  misc_feature: GZ8MTXP01ERYNO.10.82.H05.1.454.CMB.2.raw
  modified_base (429)..(429): a, c, t, g, unknown or other
  misc_feature (429)..(429): n is a, c, g, or t
  modified_base (439)..(439): a, c, t, g, unknown or other
  misc_feature (439)..(439): n is a, c, g, or t
tcagcatagtagtgcacgaccggtgctcgatttagtcgagctctctcgcggggcttcagctgtgagcgcagaaggcaggactcgggacaatcttcatcatgacctgctcccctctcctcctcacccttctcattcactgcacagggtcctgggcccagtctgtattgacgcagcccgccctcagtgtctgccggccccaggacagaaggtcaccatctcctgctctggagcagttccaacattgggaattcttatgtttcctggtaccagcacatcccaggagtcgcccccaaatccctcaatatatgaaagatgataagcgaccgtcagggattcctgacccgtaattctctggctccaagtctggcacgtcggccaccgtgggcagtcgcccgactccaggactggggacaggcccgtagttttacnggacggaacngttcgggactaccagcctgactagtgggtgttgggttttcgggcgggttagggacccgtaagccgttggacccgtccgaaagttccacggccccaaggtcccgttccggtcccccg

SEQ ID NO: 309056 - DNA, 881 bp, Homo sapiens
  misc_feature: GZ8MTXP01AGTFB.10.82.H05.1.454.CMB.2.raw
  modified_base (356)..(356): a, c, t, g, unknown or other
  misc_feature (356)..(356): n is a, c, g, or t
tcagcatagtagtgcacgaccggtgctcgatttagtcgagctctctcgcgggggcttcagctgtgagcgcagaaggcaggactcgggacaatcttcatcatgacctgcctcccctctcctcctcacccttctcattcactgcacgagggtcctgggcccagtctgtattgacgcacgcccgccctcagtgtctcgccggccccaggacagaagtcaccatcctctgctcgtgggagctacgttaccaaacgtagtttaggggtaaatttcttaagtcggttttaccgtcggttaacccacgccaactacgtaccccgaaggggaccggtcccgacccccccaaaacgttcccctanaacttatagtagaaagtatagtaaagtaacggcgtaacccggtacgacggggtactttaccgtacggacccgttaactttcccgtcgttaccgggtacccttacccgtaaggttccgtaccggggacccgtacccgggtccccggtaccccgtaccccgggttacgggaccctacggtccccggtacccgggtacccgttacccggaacgggtacccgggttacggggggaacccggtaaccggggttaccggtttaaacggtttttaccggtacgggtaccggtaaaccgttaacgggtacggggtaaacctacccggtaaccgtcccgtacggtaccgttacgggttcggggtttaacgggttttcgggggttttaccgggggaccgggggttaaaccggggtaacccggtaacgggttacccggttaccgggttaaccccggttaaccggttaaccgggttaacccgacccgggtaccccggttaacccgggtccccgttaacccccgggttcccccccggg

SEQ ID NO: 309057 - DNA, 874 bp, Homo sapiens
  misc_feature: GZ8MTXP01C5T92.10.82.H05.1.454.CMB.2.raw
tcagcatagtagtgcacgaccggtgctcgatttagtcgagctctctcgcgggggcttcagctgtgagcgcagaaggcaggactcgggacaatcttcatcatgacctgcctcccctctcctcctcacccttctcattcactgcacagggtcctgggcccagtctgtattgacgcagccgccctcagtgtctgcggccccaggacagaagtcaccatctcctgctcgtggagcagttaccaactagttgggaatttcttagtgtttcctaggtaccagcacactcccgaggacggtcgaccccccaaagtcccctactaatatacgtagaaagtatagtaataacggccgtaaccccggtcgaacggggtaacttttcccgtagggtaaccccgtaaatttttcccgtccgttcgggtacccttaacccgtaaagggttcccgttcggggccctaaacccgggttcccgggaccccgtaacccccggttacgggggacccgtaccgttaccccgggacccggggtaacccttacccgaacgggtaaccggttacggggggaaccggtaaacgggggttaccccggtttaaacgggttttttttaacccggacggggtaaccgggtaaacccgtaaggttaccgggggtaaacctttaaccccggaaaccggtcccgtttacggggacccgtaagggtttcgggggtttaacgggttttacgggggtttttacccgggggacgggggttaaaccgggggttaaccccgaagggttccccgttacggggttaacccccggtttaacccggtaaaacggttcccgaaccggtaccccggttaaaccggggtcccgttccccggggttaaccccccccgg

SEQ ID NO: 309058 - DNA, 549 bp, Homo sapiens
  misc_feature: GZ8MTXP02HIUIK.10.82.H05.1.454.CMB.2.raw
  modified_base (391)..(391): a, c, t, g, unknown or other
  misc_feature (391)..(391): n is a, c, g, or t
  modified_base (419)..(419): a, c, t, g, unknown or other
  misc_feature (419)..(419): n is a, c, g, or t
tcagcatagtagtgcacgaccggtgctcgatttagtcgagctctctcgcgggggcttcagctgtgagcgcagaaggcaggactcgggacaatcttcatcatgacctgctcccctctcctcctcacccttctcattcactgcacagggtcctgggcccagtctgtattgacgcagccgccctcagtgtctgcggccccaggacagaaggtcaccatctcctgctctggaggcagttccaacattgggaattcttatgtttcctggtaccagcacatccccaggacgtgcccccaaatcctcatactatagaagatgaataagccgacgtccagggattcctgaccgattctctggctccagtctggcacgtcgcacccgtggcatcgcgacncagactggggacaggccgtattttacgngcggaactagtgggactacgagcctagctagtggtgtcgggttttcggcggtacgggacccaaggtcctacggaacccgtccgtaaacggttccgacggaccccgaaacggtccgtaccggtcccccccg

SEQ ID NO: 309059 - DNA, 531 bp, Homo sapiens
  misc_feature: GZ8MTXP02IMGV2.10.82.H05.1.454.CMB.2.raw
  modified_base (261)..(261): a, c, t, g, unknown or other
  misc_feature (261)..(261): n is a, c, g, or t
  modified_base (340)..(340): a, c, t, g, unknown or other
  misc_feature (340)..(340): n is a, c, g, or t
tcagcatagtagtgcacgaccggtgctcgatttagtcgagctctctcgcgggggcttcagctgtgagcgcagaaggcaggactcgggacaatcttcatcatgacctgctcccctctcctcctcacccttctcattcactgcacagggtcctgggcccagtctgtattgacgcagccgccctcagtgtctgcggccccaggacagaaggtcaccatctcctgctctggaggcagttccaacattgggaattctatgtttccnggtaccagcacatccccaggagtcgcccccaaactcctcatatatgaaagatgaataagcgaccgtccagggacttccngaccgattctctggctccaagtctggcacgtcgcacctggcatcgccgactccagacgtggggacgaggtccgtattttacgtgacggaacagtggactaccagcctgcagtcggtgtcggtttcggcggtacgggacaacgcgtcggaccgtaacgtaacgtcgacgacccgaacggtcctcgtcccccg

SEQ ID NO: 309060 - DNA, 565 bp, Homo sapiens
  misc_feature: GZ8MTXP02IBKRA.10.82.H05.1.454.CMB.2.raw
  modified_base (314)..(314): a, c, t, g, unknown or other
  misc_feature (314)..(314): n is a, c, g, or t
  modified_base (344)..(344): a, c, t, g, unknown or other
  misc_feature (344)..(344): n is a, c, g, or t
tcagcatagtagtgcacgaccggtgctcgatttagtcgagctctctcgcgggggcttcagctgtgagcgcagaaggcaggactcgggacaatcttcatcatgacctgctccccctctcctcctcacccttctcattcactgcacagggtcctgggcccagtctgtattgacgcagccgccctcagtgtctgtggccccaggacagaaggtcaccatctcctgctctggaggcagttccaacattgggaattcttatgttcctggtaccagcacatccccaggacgtcgcccccaaactcctcatactatgaaanatgaataagcgacgtccgagggtacttccngaccgtattctctggctccagtctgcacgtcgccacctgggcagtccgccggactccgagaccgtggggaccgaggtccgtacgtttttacgcgtacggtaactagtggactaccagccttagccgtagtggttcggtcggttttcgggacggtacggggtaccaaggccgtacgaccgtaaccgtacgtacgacggacccgaacggccgttcgcccccgg

SEQ ID NO: 309061 - DNA, 544 bp, Homo sapiens
  misc_feature: GZ8MTXP02IZ0UW.10.82.H05.1.454.CMB.2.raw
  modified_base (340)..(340): a, c, t, g, unknown or other
  misc_feature (340)..(340): n is a, c, g, or t
  modified_base (418)..(418): a, c, t, g, unknown or other
  misc_feature (418)..(418): n is a, c, g, or t
  modified_base (425)..(425): a, c, t, g, unknown or other
  misc_feature (425)..(425): n is a, c, g, or t
tcagcatagtagtgcacgaccggtgctcgatttagtcgagctctctcgcgggggcttcagctgtgagcgcagaaggcaggactcgggacaatcttcatcatgacctgctcccctctcctcctcacccttctcattcactgcacagggtcctgggcccagtctgtattgacgcagccgccctcagtgtctgcggccccaggacagaaggtcaccatctcctgctctggaggcagttccaacattgggaattcttatgtttcctggtaccagcacatccccaggacggtcgacccccaaactccctcatatatgaagatgataagcgaccgtcagggattcngaccgattctctgctccagtctggcacgtcgccaccctggcatcgccgctcagacgtgggcgaggccgtattttacgngcggaanagtgggactaccagctgacagttcggtggttgggtttcgggcgggtacgggaccgaacgtccgtacggacccgaacccgtaaacggtccaacggccccgaaaggccgtaccgtcccccg

SEQ ID NO: 309062 - DNA, 538 bp, Homo sapiens
  misc_feature: GZ8MTXP02I9KAP.10.82.H05.1.454.CMB.2.raw
  modified_base (221)..(221): a, c, t, g, unknown or other
  misc_feature (221)..(221): n is a, c, g, or t
tcagcatagtagtgcacgaccggtgctcgatttagtcgagctctctcgcgggggcttcaactgtgagcgcagaaggcaggactcgggacaatcttcatcatgacctgctcccctctcctcctcacccttctcattcactgcacagggtcctgggcccagtctgtattgacgcagccgccctcagtgtctgccggccccaggacagaaggtcaccatctccngctctggagcagttccaacattgggaattcttatgtttcctggtaccagcacatccccaggacggtcgacccccaaactcctacatatatgaagatgataagcgaccgtcagggacttccgtagaccgattcctctggctccaagtctggcacgtcgccacctggcatcgccgactccagacgtggggacaggccgtattttacgcggacggaacagtaggactaccgagtcctgcagtggtgttcggtttcggcggacgggtaccaaggcgtacgaccgtacgtaacgtcgacgacccgaaggcctcgcccctcgg

SEQ ID NO: 309063 - DNA, 530 bp, Homo sapiens
  misc_feature: GZ8MTXP02HVT1N.10.82.H05.1.454.CMB.2.raw
  modified_base (241)..(241): a, c, t, g, unknown or other
  misc_feature (241)..(241): n is a, c, g, or t
  modified_base (339)..(339): a, c, t, g, unknown or other
  misc_feature (339)..(339): n is a, c, g, or t
  modified_base (349)..(349): a, c, t, g, unknown or other
  misc_feature (349)..(349): n is a, c, g, or t
  modified_base (422)..(422): a, c, t, g, unknown or other
  misc_feature (422)..(422): n is a, c, g, or t
tcagcatagtagtgcacgaccggtgctcgatttagtcgagctctctcgcgggggcttcagctttgagcgcagaaggcaggactcgggacaatcttcatcatgacctgctcccctctcctcctcacccttctcattcactgcacagggtcctgggcccagtctgtattgacgcagccgccctcagtgtctgcggccccaggacagaaggtcaccatctcctgctctggaggcagttccaacnttgggaattcttatgtttcctggtaccagcacatccccaggacggtgaccccccaaatccctcatatatgaagatgataagcgacgtcagggattccngaccgattcnctggctcaagtctggcacgtcgccaccctggcatcgccgactccagacgtggggacgaggccgtatttttacnggtcggaacagtagggactaccgagcctgccagtggtgtgggttttcggcggtacgggaccgaagccgtgaacccgtctaagtcacgcccaaggcctcgccccctcgg

SEQ ID NO: 309064 - DNA, 540 bp, Homo sapiens
  misc_feature: GZ8MTXP02F0KEM.10.82.H05.1.454.CMB.2.raw
  modified_base (311)..(311): a, c, t, g, unknown or other
  misc_feature (311)..(311): n is a, c, g, or t
  modified_base (424)..(424): a, c, t, g, unknown or other
  misc_feature (424)..(424): n is a, c, g, or t
  modified_base (447)..(447): a, c, t, g, unknown or other
  misc_feature (447)..(447): n is a, c, g, or t
tcagcatagtagtgcacgaccggtgctcgatttagtcgagctctctcgcgggggcttcagctgtgagcgcagaaggcaggactcgggacaatcttcatcatgacctgctcccctctcctcctcacccttctcattcactgcacagggtcctgggcccagtctgtattgacgcagccgccctcagtgtctgccggccccaggacagaaggtcaccatctcctgctctggagcagttccaacattgggaattcttatgtttcctggtaccagcacatccccaggagtcgcccccaaatcctcatatatgaagntgataagcgaccgtcagggacttcctgaccgattctctggctccaagtctggcacgtcgccacccgtggcagtcgccggactccagacgtggggacgaggccgtattttacgngcggaacagtcggataccagccngcagtcggtgttgggttttcggcgggtacggtaccgaacgcgtcgtaaccgtccgtaaacggtccacggaccccgtaaggccctcgtcccccg

SEQ ID NO: 309065 - DNA, 608 bp, Homo sapiens
  misc_feature: GZ8MTXP02IEHZE.10.82.H05.1.454.CMB.2.raw
  modified_base (355)..(355): a, c, t, g, unknown or other
  misc_feature (355)..(355): n is a, c, g, or t
tcagcatagtagtgcacgaccggtgctcgatttagtcgagctctctcgcgggggcttcagctgtgagcgcagaaggcaggactcgggacaatcttcatcatgacctgcctcccctctcctcctcacccttctcattcactgcacagggtcctgggcccagtctgtattgacgcagcccgccctcagtgtctgcggccccaggacagaagtcaccatctcctgctcgtggagcagttccaacattggattcttattgttcctggtaccagcacactaccccgaggacggtccgacccccaaactccctacataatatagaaagatagaataacgcgaccgtcgacgggtacttccngaaccgtacttcctcgtcggctacccgtaagtcctgggccaccgtcccgcccacccgtggcacgtccgacccgtaccgtccgacgacgtacggggacgaacggtccgttacgttttacgtacgacggtaacgagtacgggactaccgacgtccgtgacgtggttggttggttcgggtttacgggacggtacgggaccgaacgccgttacgaccgtaaccgttaacgcgacgaccgacggtcctccgtcccccg

SEQ ID NO: 309066 - DNA, 557 bp, Homo sapiens
  misc_feature: GZ8MTXP02I21PB.10.82.H05.1.454.CMB.2.raw
  modified_base (442)..(442): a, c, t, g, unknown or other
  misc_feature (442)..(442): n is a, c, g, or t
tcagcatagtagtgcacgaccggtgctcgatttagtcgagctctctcgcgggggcttcagctgtgagcgcagaaggcaggactcgggacaatcttcatcatgacctgctcccctctcctcctcacccttctcattcactgcacagggtcctgggcccagtctgtattgacgcagccgccctcagtgtctgcggccccaggacagaaggtcaccatctcctgctctggagcagttccaacattggaattcttatgtttcctggtaccagcacatccccgaggacgtcgacccccaaactcctacatatatagaagatgataagcgaccgtcgaggtattccgtgaccgtattctcgtcgctaccgaagtctggcacgtccgccacccgtgggcactccgccggacctccgagacgtacggggacgacggccgtatttttacgngaccggaacagtgggactaccgagcctgactagtggttcggttgggtttcggacgggtaggaccgaagccgtcgaccgtccgtaacgtcgacgaccgaacggccgtcgtcccccg

SEQ ID NO: 309067 - DNA, 608 bp, Homo sapiens
  misc_feature: GZ8MTXP02FO5FV.10.82.H05.1.454.CMB.2.raw
  modified_base (475)..(475): a, c, t, g, unknown or other
  misc_feature (475)..(475): n is a, c, g, or t
  modified_base (508)..(508): a, c, t, g, unknown or other
  misc_feature (508)..(508): n is a, c, g, or t
tcagcatagtagtgcacgaccggtgctcgatttagtcgagctctctcgcgggggcttcagctgtgagcgcagaaggcaggactcgggacaatcttcatcatgacctgcctcccctctcctcctcacccttctcattcactgcacagggtcctgggcccagtctgtattgacgcagcccgccctcagtgtctgccggccccaggacagaaggtcaccatctcctgctctggaggcagttccaacattggaattcttatgtttcctggtaccagcacatccccaggagtcgacccccaaactcctcatatatgaagatgataagccgaccgtcgagggtacttccgtagacccgtatttcctcgtggcctaccgaagttccgtggccaccgtccggccctaccccgtcgggcacgtccgcccggaccctccgaacggaccgtacgggggacgacgggtcccggttactttttaccgnggtaccggaacgagtacgggactaccgagtccngcagtggtcggttcgggtttcggcgggtaacgggaccgaacgtcgtacggtaccggtaaccgtaacgtccgacgacccgaacggtccgtccgtcccccgg

SEQ ID NO: 309068 - DNA, 526 bp, Homo sapiens
  misc_feature: GZ8MTXP02GEZ2F.10.82.H05.1.454.CMB.2.raw
  modified_base (328)..(328): a, c, t, g, unknown or other
  misc_feature (328)..(328): n is a, c, g, or t
  modified_base (333)..(333): a, c, t, g, unknown or other
  misc_feature (333)..(333): n is a, c, g, or t
  modified_base (416)..(416): a, c, t, g, unknown or other
  misc_feature (416)..(416): n is a, c, g, or t
tcagcatagtagtgcacgaccggtgctcgatttagtcgagctctctcgcgggggcttcagctgtgagcgcagaaggcaggactcgggacaatcttcatcatgacctgctcccctctcctcctcacccttctcattcactgcacagggtcctgggcccagtctgtattgacgcagccgccctcagtgtctgcggccccaggacagaaggtcaccatctcctgctctggaggcagttccaacattggaattctatgttcctggtaccagcacatccccaggagtcgcccccaaactcctcatatatgaagatgataagcgacgtcagggnttccngaccgtattctctggctccaagtctggcacgtcgccacctggcatcgccgactcagacgtgggacgaaggccgatttttacgngacggtaacatagggactacgagcctgacagtggtgtgggtttcggcggaacggggacaacgtcgtcgtaacccgtcgtaacgtcgacgccgaacggcctacgccccccg

SEQ ID NO: 309069 - DNA, 698 bp, Homo sapiens
  misc_feature: GZ8MTXP02JQL1S.10.82.H05.1.454.CMB.2.raw
tcagcatagtagtgcacgaccggtgctcgatttagtcgagctctctcgcgggggcttcagctgtgagcgcagaaggcaggactcgggacaatcttcatcatgacctgcctcccctctcctcctcacccttctcattcactgcacagggtcctgggcccagtctgtattgacgcagccgccctcagtgtctgccggccccaggacagagtcaccatctcctgctctggagcagttccaactagttggaattcttattcgtttcctggtaccagcacactcccgaggacgtccgacccccctaaatccctacatactaatacgaaagattagaataaacggccgtaccgtccgaacggggtacttccgtacggaacctagtttccgtcgtcgggtaccttacccgaaagttccgtacggggcctaacccgggttcccgggacccctacccggtcggggacctaccgttccccgggacccggtaaccctcccggaacggtaccggttacgggggaaccgtacggggtacccgtttaagtttttaccgcgggtaaccggaacgtaggtacgggtactaacccgcgtccgtagtcgtagtgggttggttcggggtttccgggacggggtaacggaccgaacggtccgttcggaacccgtaacgtaacggtaccgaccgaccgtacggccgtccggtccccccg

SEQ ID NO: 309070 - DNA, 720 bp, Homo sapiens
  misc_feature: GZ8MTXP02HLOJ1.10.82.H05.1.454.CMB.2.raw
tcagcatagtagtgcacgaccggtgctcgatttagtcgagctctctcgcgggggcttcagctgtgagcgcagaaggcaggactcgggacaatcttcatcatgacctgctcccctctcctcctcacccttctcattcactgcacagggtcctgggcccagtctgtattgacgcagccgccctcagtgtctgccggccccaggacagaaggtcaccatctcctgctctggagcagttccaactagttgggaattcttattcgttcctggtaccagcacactccccgaggacggtcgacccccaaactcctacatatactagaaagatagaataacgcgtaccgtcgagggtacttccgtagaccgtattctcgttcggcctaccgaagttccgtcggcctacccggtccgcccaccccgtcgggccacgtcccgacccggtaccgtcccgaacggtaccggtacgggggaccggaacgggtaccccgttaagtttttaaccgtcggaccgggtaaaccgtaaggtacggggtaacgttaacccgacgtacccgtgtaccgtagttcgggtttacgggtttcgggggtttttccgggggaccgggttaacgggggaaacccgtaacgggtacccgttaccgggtaaccccggttaacccgttaaacggtacccgtaaccggtaccccggaaaccgggtccccgttaacccggtccccccccgg

SEQ ID NO: 309071 - DNA, 535 bp, Homo sapiens
  misc_feature: GZ8MTXP02JV6TG.10.82.H05.1.454.CMB.2.raw
  modified_base (432)..(432): a, c, t, g, unknown or other
  misc_feature (432)..(432): n is a, c, g, or t
  modified_base (526)..(526): a, c, t, g, unknown or other
  misc_feature (526)..(526): n is a, c, g, or t
tcagcatagtagtgcacgaccggtgctcgatttagtcgagctctctcgcggggcttcagctgtgagcgcagaaggcaggactcgggacaatcttcatcatgacctgctcccctctcctcctcacccttctcattcactgcacagggtcctgggcccagtctgtattgacgcagccgcctcagtgtctgcgccccaggacagaaggtcaccatctcctgctctggaggcagttccaacattgggaattcttatgtttcctggtaccagcacatccccaggacggtcgaccccccaaactcctacatatatgaagatgaataagcgaccgtcagggattcctgaccgattctcgtggctccgaagtctaggcacgtccgccacccgtgggcactcgccggactccgagacgtggggacaggccgtattttacgngacggaacgagtggactaccgacgcctgcagtggtcgttcggtttcggcggtacggacaacgcgtgaccgtcgtaacgtcacgcccaaggtccncgtcccccg

SEQ ID NO: 309072 - DNA, 579 bp, Homo sapiens
  misc_feature: GZ8MTXP02I26Q6.10.82.H05.1.454.CMB.2.raw
  modified_base (262)..(262): a, c, t, g, unknown or other
  misc_feature (262)..(262): n is a, c, g, or t
  modified_base (339)..(339): a, c, t, g, unknown or other
  misc_feature (339)..(339): n is a, c, g, or t
  modified_base (430)..(430): a, c, t, g, unknown or other
  misc_feature (430)..(430): n is a, c, g, or t
  modified_base (455)..(455): a, c, t, g, unknown or other
  misc_feature (455)..(455): n is a, c, g, or t
tcagcatagtagtgcacgaccggtgctcgatttagtcgagctctctcgcgggggcttcagctgtgagcgcagaaggcaggactcgggacaatcttcatcatgacctgctcccctctcctcctcacccttctcattcactgcacagggtcctgggcccagtctgtattgacgcagccgccctcagtgtctgcggccccaggacagaaggtcaccatctcctgctctggaggcagttccaacattgggaattcttatgtttccnggtaccagcacatccccaggacggtcgcccccaaactcctcatatatgaagatgataagcgaccgtcagggattccngaccgattctctggctccaagtctggccacgtcgccacccgtgggcagtcgccggctccgagacgtggggacgaggccgtatttttaccgngtacggaacagtcgggacttaccgngaccctgaccgagttggtcggttgggttttcgggcggggtaacggggaccctaaaggccgttacggacccgttaaccgtaaacggtcccgaacggcccccgaaaggcccgtaccgtccccccgg

SEQ ID NO: 309073 - DNA, 621 bp, Homo sapiens
  misc_feature: GZ8MTXP02FSC7F.10.82.H05.1.454.CMB.2.raw
  modified_base (466)..(466): a, c, t, g, unknown or other
  misc_feature (466)..(466): n is a, c, g, or t
tcagcatagtagtgcacgaccggtgctcgatttagtcgagctctctcgcgggggcttcagctgtgagcgcagaaggcaggactcgggacaatcttcatcatgacctgctcccctctcctcctcacccttctcattcactgcacagggtcctgggcccagtctgtattgacgcagccgccctcagtgtctgcgcccaggacagaagtcacatctcctgctctggaggcagttccaacagttgggaattcttatgtttcctggtaccagcacatccccaggacgtcgacccccaaactcctacatactatagaagatagaataagcgaccgtcgagggacttccgtagtacccgattcgtcgtggccttacccgaaagttcctggacctacgtccgggcccacccgtcgggacacgtccgaccggacctccgacgaccgtaggggacgtacggccgtagtttttacgnggtaccggaaactacgtacggggactaccgacggtacctgacctagtgggttggttcgggttttacgggcgggaacgggtaccgaacggtccgtacggtacccgttaaccgtaacggtaccgacggacccgaaacggtccctaccggtccccccg

SEQ ID NO: 309074 - DNA, 538 bp, Homo sapiens
  misc_feature: GZ8MTXP02JBXPO.10.82.H05.1.454.CMB.2.raw
  modified_base (429)..(429): a, c, t, g, unknown or other
  misc_feature (429)..(429): n is a, c, g, or t
  modified_base (453)..(453): a, c, t, g, unknown or other
  misc_feature (453)..(453): n is a, c, g, or t
tcagcatagtagtgcacgaccggtgctcgatttagtcgagctctctcgcggggcttcagctgtgagcgcagaaggcaggactcgggacaatcttcatcatgacctgctcccctctcctcctcacccttctcattcactgcacagggtcctgggcccagtctgtattgacgcagccgccctcagtgtctgcggccccaggacagaaggtcaccatctcctgctctggagcagttccaacattggaattctatgttcctggtaccagcacatccccaggacgtcgacccccaaactcctacatatatgaagatagataacgcgaccgtcgagggtacttccgacgaccgtattctcgtgctccaagtctgcacgtcgccaccgtgggcagtccgccgactcgacgtcgagggacgacggccgtattttcgngacgacagtcggactaccgagtcngctagtggtcgttgggtttcggcggtacggaccagtacgtcgaccgtccgtaacgtacgaccgaccgacggtcctccgtcccccg

SEQ ID NO: 309075 - DNA, 616 bp, Homo sapiens
  misc_feature: GZ8MTXP02JA4IG.10.82.H05.1.454.CMB.2.raw
tcagcatagtagtgcacgaccggtgctcgatttagtcgagctctctcgcgggggcttcagctgtgagcgcagaaggcaggactcgggacaatcttcatcatgacctgcctcccctctcctcctcacccttctcattcactgcacgagggtcctgggcccagtctgtattgacgcagcccgccctcagtgtctcgccggccccaggacagaacggtcaccatctcctgctcgtggaggctagttaccaactagttagggaattcttattcgttcctggtaccagcacactcccgaggacgtccgacccccaaatcctacatactagtagaaagtatagaagtaacgcgtaccgtacgacgggtacttccgtacgaccgtacttcgtcgtcggtcctaccgaagtcgtcggctaccgtccgcccgacccgtcggcacgtccgaccgaccgtaccgacggacggtacgggacggacggtaccgttacgtttacgtacgacgaacgacgtacggacgtacgacgcgtcgcgtagtggtcggttgggttcgggacgggtttacggacgacgtacgtacgtaccgtaacgtacgtacgacgaccgacgccgtccgtaccccg

SEQ ID NO: 309076 - DNA, 580 bp, Homo sapiens
  misc_feature: GZ8MTXP02I859T.10.82.H05.1.454.CMB.2.raw
  modified_base (261)..(261): a, c, t, g, unknown or other
  misc_feature (261)..(261): n is a, c, g, or t
tcagcatagtagtgcacgaccggtgctcgatttagtcgagctctctcgcgggggcttcagctgtgagcgcagaaggcaggactcgggacaatcttcatcatgacctgctcccctctcctcctcacccttctcattcactgcacagggtcctgggcccagtctgtattgacgcagccgccctcagtgtctgcgcccaggacagagtcacatctctgctcgtggaggcagttccaactagttgggaattcttattcgtttccnggtaccagtccacactccccgagggtacggtccgacccccctaaactcccgtacaagttacgtataggaagtatgaataacggcgtaccgtcgacgggtattccgtagaccgtattctcgtgctaccaagtctagctacgtcgcccacccgtggcacgtccgccgacctcacgacgtacggggacgtaggaccgttagttttacgagacggtacagtacggactaccgagtcctgctagtggtcggttcgggtttcggacgggaggtaccgtagcgtcgtaccgtcgaacgtacgacgacccgtacggctccgtccccg

SEQ ID NO: 309077 - DNA, 594 bp, Homo sapiens
  misc_feature: GZ8MTXP02IN8MO.10.82.H05.1.454.CMB.2.raw
tcagcatagtagtgcacgaccggtgctcgatttagtcgagctctctcgcgggggcttcagctgtgagcgcagaaggcaggactcgggacaatcttcatcatgacctgctcccctctcctcctcacccttctcattcactgcacagggtcctgggcccagtctgtattgacgcagcccgccctcagtgtctgcggccccaggacagaaggtcaccatctcctgctctggaggcagttccaacagttgggtaattcttatgtttcctggtaccagcacatccccaggaggtcgacccccaaactccctacatatatagaagatgaataagccgaccgtcgagggacttcctgacgattctctgctaccagtcgtgcacgtcgcccacccgtgggcactccgccgtactccgagcgtggggacgaggtaccgttattttacgtgaccggaacagtaggactaccgagcgtgcgagttgggttggttggggttttaccgggcggggtaaacgggacccgtaaggtcccgttacggtacccggttaaccgtaacggtacccgacggaccccgtaaccggccgttcccggtcccccccgg

SEQ ID NO: 309078 - DNA, 521 bp, Homo sapiens
  misc_feature: GZ8MTXP02FJIT6.10.82.H05.1.454.CMB.2.raw
  modified_base (340)..(340): a, c, t, g, unknown or other
  misc_feature (340)..(340): n is a, c, g, or t
  modified_base (412)..(412): a, c, t, g, unknown or other
  misc_feature (412)..(412): n is a, c, g, or t
tcagcatagtagtgcacgaccggtgctcgatttagtcgagctctctcgcgggggcttcagctgtgagcgcagaaggcaggactcgggacaatcttcatcatgacctgctcccctctcctcctcacccttctcattcactgcacagggtcctgggcccagtctgtattgacgcagccgcctcagtgtctgcggcccaggacagaaggtcaccatctcctgctctggagcagttccaacattgggaattcttatgtttcctggtacccagcacatcccaggagtgcccccaaatcctcatatatgaagatgatagcgacgtcagggatctgaccgattctcnggctccagtctggcacgtcgccaccctggcatcgccgactccgagacgtgggacgaggccgtatttttacgngcggaacagtgggataccgagcctagctagtggtgtcgggtttcggcggtaggacccgaagtccgtcgaccgtccgtaacgtcgacgacccgaacggcgtcgtcccccg

SEQ ID NO: 309079 - DNA, 508 bp, Homo sapiens
  misc_feature: GZ8MTXP02FGWC9.10.82.H05.1.454.CMB.2.raw
  modified_base (262)..(262): a, c, t, g, unknown or other
  misc_feature (262)..(262): n is a, c, g, or t
  modified_base (420)..(420): a, c, t, g, unknown or other
  misc_feature (420)..(420): n is a, c, g, or t
  modified_base (426)..(426): a, c, t, g, unknown or other
  misc_feature (426)..(426): n is a, c, g, or t
  modified_base (432)..(432): a, c, t, g, unknown or other
  misc_feature (432)..(432): n is a, c, g, or t
  modified_base (435)..(435): a, c, t, g, unknown or other
  misc_feature (435)..(435): n is a, c, g, or t
  modified_base (438)..(438): a, c, t, g, unknown or other
  misc_feature (438)..(438): n is a, c, g, or t
  modified_base (440)..(441): a, c, t, g, unknown or other
  misc_feature (440)..(441): n is a, c, g, or t
tcagcatagtagtgcacgaccggtgctcgatttagtcgagctctctcgcgggggcttcagctgtgagcgcagaaggcaggactcgggacaatcttcatcatgacctgctcccctctcctcctcacccttctcattcactgcacagggtcctgggcccagtctgtattgacgcagccgccctcagtgtctgcggccccaggacagaaggtcaccatctcctgctctggaggcagttccaacattgggaattcttatgtttccnggtaccagcacatcccaggagtgccccccaaactcctcatatatgaagatgataagcgaccgtccagggatcctgaccgattctctggctccaagtctggcacgtcgccaccctgggcatcgccgactccagactggggacgaggccgatttttacgngacganagtganacngcngnngtgtgttggttcggtcggacggacgacgcgcgaccgtaacgtacgtacgacgaccgacgcgcgcccg

SEQ ID NO: 309080 - DNA, 532 bp, Homo sapiens
  misc_feature: GZ8MTXP02IFG1J.10.82.H05.1.454.CMB.2.raw
  modified_base (344)..(344): a, c, t, g, unknown or other
  misc_feature (344)..(344): n is a, c, g, or t
  modified_base (436)..(436): a, c, t, g, unknown or other
  misc_feature (436)..(436): n is a, c, g, or t
  modified_base (523)..(523): a, c, t, g, unknown or other
  misc_feature (523)..(523): n is a, c, g, or t
tcagcatagtagtgcacgaccggtgctcgatttagtcgagctctctcgcgggggcttcagctgtgagcgcagaaggcaggactcgggacaatcttcatcatgacctgctcccctctcctcctcacccttctcattcactgcacagggtcctgggcccagtctgtattgacgcagccgccctcagtgtctgcggccctaggacagaaggtcaccatctcctgctctggaggcagttccaacattggaattctatgttcctggtaccagcacatccccaggacgtcgaccccccaaatccctacatatatagaaagatgaataagcgtaccgtcaaggggcttccngacccgtattctctggctccaagtctggcacgtccgccaccctggcatcgccggactccgagacgtcgggacgacggtccgtatttttacgngtcggaacagtgggactaccgagcctgcagtggtgttggtttcggcggtacggacacgctcgacgtcgtaagtcacgaccgacgtcncgtcccccg

SEQ ID NO: 309081 - DNA, 587 bp, Homo sapiens
  misc_feature: GZ8MTXP02JOEEK.10.82.H05.1.454.CMB.2.raw
  modified_base (182)..(182): a, c, t, g, unknown or other
  misc_feature (182)..(182): n is a, c, g, or t
  modified_base (238)..(238): a, c, t, g, unknown or other
  misc_feature (238)..(238): n is a, c, g, or t
  modified_base (258)..(258): a, c, t, g, unknown or other
  misc_feature (258)..(258): n is a, c, g, or t
  modified_base (269)..(269): a, c, t, g, unknown or other
  misc_feature (269)..(269): n is a, c, g, or t
  modified_base (310)..(310): a, c, t, g, unknown or other
  misc_feature (310)..(310): n is a, c, g, or t
  modified_base (445)..(445): a, c, t, g, unknown or other
  misc_feature (445)..(445): n is a, c, g, or t
tcagcatagtagtgcacgaccggtgctcgatttagtcgagctctctcgcgggggcttcagctgtgagcgcagaaggcaggactcgggacaatcttcatcatgacctgctcccctctcctcctcacccttctcattcactgcacagggtcctgggcccagtctgtattgacgcagccgccctnagtgtctgccggccccaggacagaagtcacatctcctgctctggagcagttccaanagtggaattcttatgttccngtaccagcacntccccgaggagtccgacccccaaatcctacatatactgaanatgaatacgcgacgtcaggtacttcctgaccgtattcctcgtgccttccgaagtcgtggcctaccgtcgcccacccgtggccagtccgaccgtacctccgagacgtacggggacacgggtcgttaagttttacgnggacgaacgtagtagggactaccgcgcctaggacgtagttgggttcggttggggtttccgggacgggtacggtaaccgacggtccgtacgtaacccgtccgtaacgtccgacgacccgtaacggtcccgtccgtacccccgg

SEQ ID NO: 309082 - DNA, 566 bp, Homo sapiens
  misc_feature: GZ8MTXP02GUB68.10.82.H05.1.454.CMB.2.raw
  modified_base (342)..(342): a, c, t, g, unknown or other
  misc_feature (342)..(342): n is a, c, g, or t
  modified_base (353)..(353): a, c, t, g, unknown or other
  misc_feature (353)..(353): n is a, c, g, or t
  modified_base (460)..(460): a, c, t, g, unknown or other
  misc_feature (460)..(460): n is a, c, g, or t
tcagcatagtagtgcacgaccggtgctcgatttagtcgagctctctcgcgggggcttcagctgtgagcgcagaaggcaggactcgggacaatcttcatcatgacctgctcccctctcctcctcacccttctcattcactgcacagggtcctgggcccagtctgtattgacgcagccgccctcagtgtctgcggccccaggacagaaggtcaccatctcctgctcgtggagcagttccaactattgggaattcttatgtttcctggtaccagcacactcccgaggacgtcgacccccaaactcctacatatatgaagatgaataagcgaccgtcaggtatccngaccgtattcnctggctcgagtctgacacgtcgccacccgtggcagtccgccgcctcgacgacgtcgggacgacggccgtagtttacgtagcggaacagtcggaactaccgacgtcgngcgtagttggttcggttcgggtttcggacggggtacggaaccgaagccgtacggtacccgtaaccgtaacggtccgaccgacccgaacggtccgtaccgtcccccg

SEQ ID NO: 309083 - DNA, 600 bp, Homo sapiens
  misc_feature: GZ8MTXP02H44KW.10.82.H05.1.454.CMB.2.raw
tcagcatagtagtgcacgaccggtgctcgatttagtcgagctctctcgcgggggcttcagctgtgagcgcagaaggcaggactcgggacaatcttcatcatgacctgctcccctctcctcctcacccttctcattcactgcacagggtcctgggcccagtctgtattgacgcagccgccctcagtgtctgcggccccaggacagaaggtcaccatctcctgctctggagcagttccaacatggaattcttatgtttcctggtaccagcacactccccgaggacgtcgcccccaaactccctacatatatagaagatagataacgcgaccgtcgagggtacttccgtacgaccgtattcctcgtcggcttacccgaagtccgtcggcctaccgtccggaccctacccgtgggccacgtccggacccgtacctccgacgaaccgtggggacgacgggtccgttattttacgtgacggaactagtggactacagcctgcgagtggttggttgggttttacgggcggtacgggaccgtaacggcgtacggtacccgtccgttaacgaccgtacgaccccgaacggtcccgtaccggtccccccg

SEQ ID NO: 309084 - DNA, 636 bp, Homo sapiens
  misc_feature: GZ8MTXP02FQ2U0.10.82.H05.1.454.CMB.2.raw
tcagcatagtagtgcacgaccggtgctcgatttagtcgagctctctcgcgggggcttcagctgtgagcgcagaaggcaggactcgggacaatcttcatcatgacctgcctcccctctcctcctcacccttctcattcactgcacagggtcctgggcccagtctgtattgacgcagcccgccctcagtgtctgccggccccaggacagaagtcaccatctcctgctcgtggaggcacgttaccaactagttgggaaattcttatcgtttcctggtacccagccacatccccaggacgtcgaccccccaaactcctacatatatagaagatagaatagcgaccgtcgagggtacttccgtagacccgtattctcgtcggcctccgaagtccgtaggccacggtccgccctacccggtgggccacgtccgccgacctccgacgacgtacggggacgacgggccgttaagttttcgacgtaccggtaaactagtacgggactacccgagtacccgtggactacggttgggttacggtttcggggtttaccgggacggggtaacgggaacccgacggtaccgtacgtacccgttaacgtaacggtacgacggtacccgaacggtccgtacccgtcccccgg

SEQ ID NO: 309085 - DNA, 737 bp, Homo sapiens
  misc_feature: GZ8MTXP02H2U9S.10.82.H05.1.454.CMB.2.raw
  modified_base (223)..(223): a, c, t, g, unknown or other
  misc_feature (223)..(223): n is a, c, g, or t
  modified_base (300)..(300): a, c, t, g, unknown or other
  misc_feature (300)..(300): n is a, c, g, or t
tcagcatagtagtgcacgaccggtgctcgatttagtcgagctctctcgcgggggcttcagctgtgagcgcagaaggcaggactcgggacaatcttcatcatgacctgctcccctctcctcctcacccttctcattcactgcacagggtcctgggcccagtctgtattgacgcagccgccctcagtgtctgccggccccaggacagaagtcaccatctctgctntggagcagtccaacatgggaattcttatgttcctggtaccagcacactcccaggacgtccgacccccaaactcctanactaatatagaaagatgaataacgcgaccgtccgagggtacttccgtagaccgattctcgtcggacctaccgtaagtccgtcggaccgtaaccggtcccgacccgtaacccccgtggggaccaacgttcccggacccggtaaccctacccgaacggaaacccgggttcgggggaacccggtaacggggtaccccgtttaagttttttaacccggtagggaaccggtaaaacggtaaccgttagggggaaaccttaaaccccgaacggcccccgttaagcccgtaaaggttccggggtttaggtttcgggggtttttaccgggggacggggtaacggggaaacccgaaacggtacccgttacggaaccccggttaaccgtaaacgttaccgaaacccggtaccccgaaaccggggtcccttaccccggtcccccccgg

SEQ ID NO: 309086 - DNA, 663 bp, Homo sapiens
  misc_feature: GZ8MTXP02F9WOS.10.82.H05.1.454.CMB.2.raw
  modified_base (265)..(265): a, c, t, g, unknown or other
  misc_feature (265)..(265): n is a, c, g, or t
  modified_base (372)..(372): a, c, t, g, unknown or other
  misc_feature (372)..(372): n is a, c, g, or t
  modified_base (428)..(428): a, c, t, g, unknown or other
  misc_feature (428)..(428): n is a, c, g, or t
tcagcatagtagtgcacgaccggtgctcgatttagtcgagctctctcgcgggggcttcagctgtgagcgcagaaggcaggactcgggacaatcttcatcatgacctgcctcccctctcctcctcacccttctcattcactgcacagggtcctgggcccagtctgtattgacgcagcccgccctcagtgtctgccgccccaggacagaagtcaccatctcctgctcgtggagcagttccaactagttggaattcttatcgtttccnggtaccagcacactcccgaggacgtccgacccccaaattcctacatatactagaagatgaataacgccgtaccgtcgaagggtacttccgtacgacccgtatttccncgttcggacccttacgtacgtccgtagccgtaccggtcccgacccgtccggcgacnccgtccgacccgtactacgacggtacgggacgggacgtaccggttaccgtttagtttaccggacggaacccgtaaagtggtaaccggtaccaccgtacgtccgtcgaacggttggttcgggttagggtttccgggttacggggacggggtaaaccgtaaccgcggttaaccgtccggttaaacccgtaacgtacgaccggacccgaaccggtaccgcccgttcccgtacccccgg

SEQ ID NO: 309087 - DNA, 768 bp, Homo sapiens
  misc_feature: GZ8MTXP02I7K98.10.82.H05.1.454.CMB.2.raw
  modified_base (263)..(263): a, c, t, g, unknown or other
  misc_feature (263)..(263): n is a, c, g, or t
  modified_base (326)..(326): a, c, t, g, unknown or other
  misc_feature (326)..(326): n is a, c, g, or t
tcagcatagtagtgcacgaccggtgctcgatttagtcgagctctctcgcgggggcttcagctgtgagcgcagaaggcaggactcgggacaatcttcatcatgacctgctcccctctcctcctcacccttctcattcactgcacagggtcctgggcccagtctgtattgacgcagcccgccctcagtgtctgccggccccaggacagaaggtcaccatctcctgctctggaggcagttccaactattggaattctatgtttccnggtaccagccacactccccgaggacggtccgacccccaaactccctactactataactgaaanatagaataaggccgaccgtcgagggtacttcccgtagtaccgtactttccgtcgtcgggtcctaccgtaaagttcctagggcctaccggttcccgggaccccgtaccccggtggggaccctaacggtcccggacccggtaaccctccgaacgggtaccggtacgggggaaccggtaccggggtacccgtttaacgtttttaccgtacggtaaccgggaaaccgtaacgtacggggtaacctaccgaaccgtcccgttacggaccgtacgttgggggtttcgggtttacgggggtttttaccggggaccgggggtaaaccggggtaacccggtaaaacggtcccggtttaccggtaaaccccgggttaaccgttaaaaccgggttacccggtaaaccggacccccgtaaaaccgggtccccgttaccccggttacccccccgg

SEQ ID NO: 309088 - DNA, 704 bp, Homo sapiens
  misc_feature: GZ8MTXP02GCZIK.10.82.H05.1.454.CMB.2.raw
tcagcatagtagtgcacgaccggtgctcgatttagtcgagctctctcgcgggggcttcagctgtgagcgcagaaggcaggactcgggacaatcttcatcatgacctgctcccctctcctcctcacccttctcattcactgcacagggtcctgggcccagtctgtattgacgcagcccgccctcagtgtctgccggccccaggacagaaggtcaccatctcctgctcgtggaggcagttccaacagttggaattcttatcgtttcctggtaccagcacactcccgaggacgtccgaccccctaaactcctacatatatagaagatagaataagccgtaccgtcgagggtacttccgtagtaccgtattctcgtcggcctaccgtaagtccgtacggccacggtccggacccacccggtgggctacgtcccggacccggacctaccgacgaccgggtacggggacggtaacgggtaccgttaacgtttttacgacgggtaccggtaaaccgtaaggtacggggaacttaccgacggtaccgtcggaccgttacggtgggttacgggtttcggggttttaccggggaccgggggtaaacgggtaaacccggtaacggtaccgttaccgggtaaccccggttaaccggtaaacggttaccgaaccggaccccggtaaacgggtccccgttacccggttacccccccgg

SEQ ID NO: 309089 - DNA, 598 bp, Homo sapiens
  misc_feature: GZ8MTXP02GL6M5.10.82.H05.1.454.CMB.2.raw
  modified_base (264)..(264): a, c, t, g, unknown or other
  misc_feature (264)..(264): n is a, c, g, or t
tcagcatagtagtgcacgaccggtgctcgatttagtcgagctctctcgcgggggcttcagctgtgagcgcagaaggcaggactcgggacaatcttcatcatgacctgctcccctctcctcctcacccttctcattcactgcacagggtcctgggcccagtctgtattgacgcagcccgccctcagtgtctgccggccccaggacagaaggtcaccatctcctgctctggaggcagttccaacattgggaattcttatgtttccnggtaccagcacatccccgaggacgtcgacccccaaactcctacatactatgaaagatagaataagccgaccgtacgagggtacttcctagaccgtattctcgtggctaccgaagtctggaccacgtcgccacccgtgggcacgtccgaccggacctccgacgacgtcggggaacgtacggtaccgttattttacgcgacggtaacgtagtcgggaactaccgagccctagctagtgggtaggttgggttttcggacggggtaacgggaccgaacgtacgtcggtaaccgtccgttaacgacgacggtcccgaacggtcccgtaccgtcccccgg

SEQ ID NO: 309090 - DNA, 657 bp, Homo sapiens
  misc_feature: GZ8MTXP02FQFK1.10.82.H05.1.454.CMB.2.raw
tcagcatagtagtgcacgaccggtgctcgatttagtcgagctctctcgcgggggcttcagctgtgagcgcagaaggcaggactcgggacaatcttcatcatgacctgcctcccctctcctcctcacccttctcattcactgcacagggtcctgggcccagtctgtattgacgcagcccgccctcagtgtctgcggcccaggacagaagtcaccatctcctgctctggagcagttccaacattggaattcttatgtttcctggtaccagcacactccccgaggacggtcgaccccccaaactcctcatatatagaagatagaataagccgtaccgtcgaggggtacttccgtagaccgtattctcgtcggcctaccgagtcgtacggcaccgtccgcccacccgtgggaccacgtcccgacccggacctaccgacggtacggtacgggggacgtacgggtaccgttagtttttacgcggtacggaaacctaggtacggaaacgttaccgacggtccgtacgtacgtaggttcgggtttgggtttcggggttttccggggaccggggtaacggggaaccgtaacgggtacctaccggtacccgtaaccgttaaacggaccgaccggacccgtaaacggtcccgtcccggtaccccccgg

SEQ ID NO: 309091 - DNA, 609 bp, Homo sapiens
  misc_feature: GZ8MTXP02JSHD5.10.82.H05.1.454.CMB.2.raw
tcagcatagtagtgcacgaccggtgctcgatttagtcgagctctctcgcgggggcttcagctgtgagcgcagaaggcaggactcgggacaatcttcatcatgacctgctcccctctcctcctcacccttctcattcactgcacagggtcctgggcccagtctgtattgacgcagccgccctcagtgtctgcggccccaggacagaaggtcaccatctcctgctctggagcagttccaactattgggaattcttatgttcctggtaccagcacatccccgaggagtcgcccccaaatcctacatatatgaagatagataagcgaccgtcgaggtacttcgagacgtattctcgtggcctaccgaagtctggccaccggtcgcccacccgtgggaccacgtccggcccgacctccgaacggtacgtcgggggaaccgtacggtccgttattttacgcggacggtaacgtaggtcgggaacttaccgacggtccgtagacctaggtgggtttcgggttcgggttttccggggacgggtaccgggaccaacggtcgtacggacccgttaaccgtaacgtccgacgaccccgaaggtcccgtccgtccccccgg

SEQ ID NO: 309092 - DNA, 581 bp, Homo sapiens
  misc_feature: GZ8MTXP02F9T5U.10.82.H05.1.454.CMB.2.raw
  modified_base (312)..(312): a, c, t, g, unknown or other
  misc_feature (312)..(312): n is a, c, g, or t
tcagcatagtagtgcacgaccggtgctcgatttagtcgagctctctcgcgggggcttcagctgtgagcgcagaaggcaggactcgggacaatcttcatcatgacctgctcccctctcctcctcacccttctcattcactgcacagggtcctgggcccagtctgtattgacgcagccgccctcagtgtctgccgccccaggacagaagtcaccatctcctgctctggaggcagttccaacattgggaattcttatgtttcctggtaccagcacatcccaggagtcgacccccaaactccctcatatatgaaanatgaataagcgaccgtcgagggtacttcctgacccgatttcctcttggcctccaagtccttagggccacgtccggcccacccgtgggacacgtccgcccggacctccgacgacgtaggggacgacggccgtattttacgtgacggtaacagtggatacccagtccctgaccgagttcggttgttcggggttttacgggcgggtacgggacctaacggccgtaggaccccgtaacgtaaacgtcacgacccgaacggccgtcgtcccccg

SEQ ID NO: 309093 - DNA, 571 bp, Homo sapiens
  misc_feature: GZ8MTXP02HBR5T.10.82.H05.1.454.CMB.2.raw
  modified_base (483)..(483): a, c, t, g, unknown or other
  misc_feature (483)..(483): n is a, c, g, or t
tcagcatagtagtgcacgaccggtgctcgatttagtcgagctctctcgcgggggcttcagctgtgagcgcagaaggcaggactcgggacaatcttcatcatgacctgctcccctctcctcctcacccttctcattcactgcacagggtcctgggcccagtctcgccctgactcagcctgactccgtgtcgtgggtctccgtggacagtcgatcactatctctgcactgcaccagcagtgacataggtgtacttaataactatcgtcctccgtacggtaaccaacaaccacccgacggcccaccggcccccagacctcactctactttctgtatgtcctagtcgtacgtccggttccgtttggtactttctacttcgtcctttctctcgcctactagtctcggacaacgcgtcccttccgacacctacgtcccgtccggccttacccgacgtcgtaggacggacgacggtctactattactcgngcgacgtctactaactacctaccgaccgagggtcctacgttcgtcgtagtaacgtacggtcgggacgggacgtcgtcgggcctaccgg

SEQ ID NO: 309094 - DNA, 697 bp, Homo sapiens
  misc_feature: GZ8MTXP02JH2PQ.10.82.H05.1.454.CMB.2.raw
  modified_base (260)..(260): a, c, t, g, unknown or other
  misc_feature (260)..(260): n is a, c, g, or t
tcagcatagtagtgcacgaccggtgctcgatttagtcgagctctctcgcgggggcttcagctgtgagcgcagaaggcaggactcgggacaatcttcatcatgacctgctcccctctcctcctcacccttctcattcactgcacagggtcctgggcccagtctgtattgacgcagccgccctcagtgtctgccggccccaggacagaaggtcacatctcctgctctggagcagttccaacattggaattcttatgtttccnggtaccagcacatccccaggacggtcgacccccaaactccctcatactaatacggaaagtatagaataacgcgtaaccgtccgagggtacttccgtagacccgtattctcgtcggcctaccaagtctggtccacgtccggccctaacccgtggggaccactcccgacccggtacctaccgacggacgtacgggggacggacgggtcccggttaatttttacgtcggtaccggtaaaccgtaggtacggggtaactacccgaacggtccccgtaggaccgtaagttcgggggttacggtttcgggggtttttaccgggggaccgggggttaaacggggaccccggtaaaacggtcccggtaccggtaacccggttaaccgtaaacggtaccgtaacccggtcccgaaaacgggtccccgtaccggttacccccccggg

SEQ ID NO: 309095 - DNA, 652 bp, Homo sapiens
  misc_feature: GZ8MTXP02GRXL5.10.82.H05.1.454.CMB.2.raw
  modified_base (183)..(183): a, c, t, g, unknown or other
  misc_feature (183)..(183): n is a, c, g, or t
  modified_base (352)..(352): a, c, t, g, unknown or other
  misc_feature (352)..(352): n is a, c, g, or t
tcagcatagtagtgcacgaccggtgctcgatttagtcgagctctctcgcgggggcttcagctgtgagcgcagaaggcaggactcgggacaatcttcatcatgacctgctcccctctcctcctcacccttctcattcactgcacgagggtcctgggcccagtctgtattgacgcagccgccctnagtgtctgccggccccaggacagagtcacatctcctgctctggagctagtccatagttggaattcttatcgtttcctggtaccctagcactactccccgtggacgtccgaccccctaaactcctactatactatagaatattgaatagccgacgtccgaggtacttcgngtacctattctcgtacggtcctaccgtaagtccgtggtaccgtaaccgggtcccgtacccgacccggtcggggacctaacgtcccgggacccgtaccgtcccgacgtacggtcggggaccgacggtcccgttagttttacggcgacgtaacgttagacggtacgtaccgacgtcccgtagtccgtagttcgggttggttcggggttttcgggacgggtaacggtaccgtaaccggtcgtaccggtaccgtaaccggtaacgtaccgaccgtacccggaacgtccgtaccccgtcccccgg

SEQ ID NO: 309096 - DNA, 688 bp, Homo sapiens
  misc_feature: GZ8MTXP02HRCDH.10.82.H05.1.454.CMB.2.raw
tcagcatagtagtgcacgaccggtgctcgatttagtcgagctctctcgcgggggcttcagctgtgagcgcagaaggcaggactcgggacaatcttcatcatgacctgcctcccctctcctcctcacccttctcattcactgcacagggtcctgggcccagtctgtattgacgcagcccgccctcagttgtctcggccggccccaggacagaaggtcaccatctcctgctcgtggagcagttaccaatagttggaattcttattcgtttccgagtaccagacactactcccgaggacgtaccgaccccccaaatccctactataatactagaaagatagaagtaaacgccgtaaccgtcgacgggtactttccgagtacctactttctccgtcgacctaccgtacgttcgcggaccaccggtcccgcccgtacccggtcgggactacgtcccggacccggtaccgtacgaacggtaccggtacggggaccgtacgggtaccgtttagttttaccgaggtaccggtaacgtacggtacgggtacctaaccgtacggtcccgtaggcgtacggttcgggttcgggtttcggggtttaccgggacgggtaacgggaaccgtacggtaccgttaccggacccgttaaccgtacgtacgaccggtacccgaaccggtccgtaccccggtccccg

SEQ ID NO: 309097 - DNA, 741 bp, Homo sapiens
  misc_feature: GZ8MTXP02G25G3.10.82.H05.1.454.CMB.2.raw
tcagcatagtagtgcacgaccggtgctcgatttagtcgagctctctcgcgggggcttcagctgtgagcgcagaaggcaggactcgggacaatcttcatcatgacctgctcccctctcctcctcacccttctcattcactgcacagggtcctgggcccagtctgtattgacgcagcccgccctcagtgtctggccggccccaggacagaacggtcaccatctcctgctcgtggaggctagttaccaactagttgggtaattcttattcgtttccgtcggtaccagcacactacccgaggacggtccgacccccaaactccctacatatatagaaagatagaaataacggaccgtaccgtaccgaacggggtacttacccgtacgtaacccgtatttccgtcgtcgggtaccttacccgtaaagttccgtacggtaccgtacccggtacccgggccccgtaacccggtcgggaccgacgttcccggacccggtacccctacccgaacgggacccgggttacgggggaaccgtaccggggtacccgtttaaacgtttttaccggtacggaaccggaaacgtaggtacgggtaactaccgacgccgttaggacgtagttcgggttcgggtttacgggggtttccggacgggggtaacggtaaaccgtacggtaccgttaccggaacccgttaaccgtaaacgtacccgaacggacccccgaacggtcccgtcccggtacccccgg

SEQ ID NO: 309098 - DNA, 664 bp, Homo sapiens
  misc_feature: GZ8MTXP02I04ML.10.82.H05.1.454.CMB.2.raw
  modified_base (314)..(314): a, c, t, g, unknown or other
  misc_feature (314)..(314): n is a, c, g, or t
tcagcatagtagtgcacgaccggtgctcgatttagtcgagctctctcgcgggggcttcagctgtgagcgcagaaggcaggactcgggacaatcttcatcatgacctgctcccctctcctcctcacccttctcattcactgcacagggtcctgggcccagtctgtattgacgcagcccgccctcagtgtctgccggccccaggacagaagtcacatctcctgctcgtggagcagttccaacagttggaattcttatgttcctggtaccagcacactcccgaggacgtcgacccccaaactccacatatatagaanatagaataacgcgtaaccgtcgagggtacttcccgtagaccgtacttctcgtcggtacctaccgtaagtccgtcggaccaccggtcccggaccctacccggtcggggacctaacggtcccggacccggtacccgttccgaacggtaccgggtacggggaacgtaccgggtacccgtttacgttttaccgtggtaacggaactaggtacgggactaaccgcgaccgtacggactaggttcgggttacggtttcggggtttacggggaccgggtaaagggtacccgaaggtccgtacggtaacccgtccgtaagtccgaccggacccgaacggtcccgtcccggtacccccg

SEQ ID NO: 309099 - DNA, 801 bp, Homo sapiens
  misc_feature: GZ8MTXP02G25KF.10.82.H05.1.454.CMB.2.raw
  modified_base (182)..(182): a, c, t, g, unknown or other
  misc_feature (182)..(182): n is a, c, g, or t
tcagcatagtagtgcacgaccggtgctcgatttagtcgagctctctcgcgggggcttcagctgtgagcgcagaaggcaggactcgggacaatcttcatcatgacctgctcccctctcctcctcacccttctcattcactgcacagggtcctgggcccagtctgtattgacgcagccgccctnagtgtctgcggccccaggacagaaggtcacatctcctgctctggaggcagttccaacattggaattcttatgtttcctggtaccagcacactccccgaggacgtcgacccccaaactcctacatactatagaaacgtatagaactaagaccggtaaccgtaccgagggtactttccgtacggacccgtagtttcctcgttcgggtacctacccgtaaaggttccttacggggacctaaacccgggttcccgggaccccgtaaacccccggttcgggggaaccctaccgttaccccgggaccccggtaacccgttaccccggaaacgggtaacccgggttacggggggaacccggtaaaccggggtacccggtttaaacgttttttacccggtacgggtacccgggtaaaacggtacggttacgggggtaaaccttaacccggaacggtcccgttaggtacccgtaaagggtttggggtttcgggttttaccgggggtttttcgggggaccggggttaacgggaaacccggtaaacgtccggttaacgtaaccccggttaaccgtaaacggtacccgtaaccggaccccgtaaacgggtccgtaccccggttccccccgg

SEQ ID NO: 309100 - DNA, 707 bp, Homo sapiens
  misc_feature: GZ8MTXP02F3TX7.10.82.H05.1.454.CMB.2.raw
  modified_base (184)..(184): a, c, t, g, unknown or other
  misc_feature (184)..(184): n is a, c, g, or t
  modified_base (254)..(254): a, c, t, g, unknown or other
  misc_feature (254)..(254): n is a, c, g, or t
  modified_base (265)..(265): a, c, t, g, unknown or other
  misc_feature (265)..(265): n is a, c, g, or t
tcagcatagtagtgcacgaccggtgctcgatttagtcgagctctctcgcgggggcttcagctgtgagcgcagaaggcaggactcgggacaatcttcatcatgacctgcctcccctctcctcctcacccttctcattcactgcacagggtcctgggcccagtctgtattgacgcacgccgccctnagtgtctgccggcccaggacagacgtcacatctctgctcgtggagctagttccaacgtagttggtaattnttatgtttccnggtaccagcacactccgaggcgtcgacccccaactcctacagtatagtacgaagatacgaaataggtacccggtaccgtacgaacggggttactttaccgtacggtaaccctacttccgttcgcgggtacccttaccgtaacgttccgtacggacccgtacccgggtaccggacccccgtaacccggttggggaccctacgttcccgggaccccggtaccttcccgaacggtaccggtacgggggaccgtacgggaccgtttaacgttttacgacggtacggtaaccgtaggtaccgggacttacccgacgtccgttgaccgtagggttggttacgggtttacgggtttcgggaccgggtaacggaaccgacgtacgtccggtaacccgttaacgtaaccgtaccgaccggacccgtaacggtcccctccggttacccccgg

SEQ ID NO: 309101 - DNA, 661 bp, Homo sapiens
  misc_feature: GZ8MTXP02I7HV5.10.82.H05.1.454.CMB.2.raw
  modified_base (225)..(225): a, c, t, g, unknown or other
  misc_feature (225)..(225): n is a, c, g, or t
tcagcatagtagtgcacgaccggtgctcgatttagtcgagctctctcgcgggggcttcagctgtgagcgcagaaggcaggactcgggacaatcttcatcatgacctgcctcccctctcctcctcacccttctcattcactgcacagggtcctcgggcccagtctgtattgacgcacgccgccctcagtgtctcgccggccccaggacagagtccaccatctcctnctcgtggacgcacgttccaactagtggtaatttcttattcgtttccgtggtaccagccactactcccgaggacgtcgaccccctaactcctacatatagtacgaagtacgtagactaaacggcgtacccggtagacgggtacttcccgtacgtacgtacttcgtcgtcgtactaccgtaagtcgtacggacgccggtccgacccgtcccgtcgggacacgtcccgccgtccgaccgtaagaccgggtaggggaccgacggttaccgttacgtttttacgacggtaccggaaacgtacggtaggtaacgaccgtacgacgtcgtacgtaggttgggtttcggttcgggtttaccggggacgggtaacgggacccgtaacggtaccgtcggtaccgtaacgtaacgtcgacggaccgaacgtccgtcccgtaccccgg

SEQ ID NO: 309102 - DNA, 645 bp, Homo sapiens
  misc_feature: GZ8MTXP02FQZV2.10.82.H05.1.454.CMB.2.raw
  modified_base (334)..(334): a, c, t, g, unknown or other
  misc_feature (334)..(334): n is a, c, g, or t
tcagcatagtagtgcacgaccggtgctcgatttagtcgagctctctcgcgggggcttcagctgtgagcgcagaaggcaggactcgggacaatcttcatcatgacctgcctcccctctcctcctcacccttctcattcactgcacagggtcctgggcccagtctgtattgacgcagcccgccctcagtgtctgccggccccaggacagagtcaccatctcctgctcgtggacggctacgttaccaacgtagttgggtaatttcgttattcgtttcctaggtaccagtacacactcccgaggtacgtccgacccccaaactctacatatatagaantataatacgccgacgtcgaggtactccgagtacctattctcgtgcctaccgagtcctacggccacgtccgacccacccggtgaccgacgtccgacccgacctaccgacggacggtacggggaccgtaccgggtaccgttagttttaccgcgggaccgtaacgtaggtacggtaacgtaccgacggtccgtgacgtagttcgggttcgggttcgggtttaccgggccgggtaacggaaccggtacgtaccgtacggtacccgtaaccgtaacgtcccgacgaccccgtaacggtcccgtccccggtcccccg

SEQ ID NO: 309103 - DNA, 514 bp, Homo sapiens
  misc_feature: GZ8MTXP01BZV3V.10.40.D07.1.454.CMB.2.raw
  modified_base (357)..(357): a, c, t, g, unknown or other
  misc_feature (357)..(357): n is a, c, g, or t
  modified_base (504)..(514): a, c, t, g, unknown or other
  misc_feature (504)..(514): n is a, c, g, or t
tcagcatagtagtgcacgaccggtgctcgatttagtgatagagcgtaacaacagagggtccagggcccaatatgttctgacacagccgccctcagtgtccggggcccccgggcagcgggtcaccatctcctgcactgggaacaacttcaacatcggggcagcttacgatgtccactggtatcgccaacttccaggcatagcccccaaaatcgtcttctatggtgacttcaatcggccctcaggggtccctgaccgcttctctggcttcaagtctggcacgtatgacacgtcccatttcctggccatcaatgggctccaggctgaagatgaggctgattacactgcagtcgtatgacnccaaagctagaaactttggggtcttcgggcggtacgggacaggctcgaccgtcctaacgtcacgcccaaggctcgccccctcggtccacttcctcgttccccacccctcctccactactctgctgcgcgggcttcggcaggcgcagnnnnnnnnnnn

SEQ ID NO: 309104 - DNA, 518 bp, Homo sapiens
  misc_feature: GZ8MTXP01EW5BF.10.40.D07.1.454.CMB.2.raw
  modified_base (356)..(356): a, c, t, g, unknown or other
  misc_feature (356)..(356): n is a, c, g, or t
  modified_base (509)..(518): a, c, t, g, unknown or other
  misc_feature (509)..(518): n is a, c, g, or t
tcagcatagtagtgcacgaccggtgctcgatttagtgatagagcgtaacaacagagggtccagggcccaatatgttctgacacagccgccctcagtgtccggggcccccgggcagcgggtcaccatctcctgcactgggaacaacttcaacatcggggcagcttacgatgtccactggtatcgccaacttccaggcatagcccccaaaatcgtcttctatggtgacttcaatcggccctcaggggtccctgaccgcttctctggcttcaagtctggcacgtatgacacgtcccatttcctggccatcaatgggctccaggctgagatgagctgattactacctgcagtctatgacnccaagctagtaaactttggggtcttcgggcggagggaccaggctgaccgtcctacgtcagcccaggcctcgcccctcggtcgactctcgttccccaccctccctccacctactatcgcctggaggcgggcgttcgggcaaggccgacgattgnnnnnnnnnn

SEQ ID NO: 309105 - DNA, 545 bp, Homo sapiens
  misc_feature: GZ8MTXP01BVT15.25.6.A06.1.454.CMB.2.raw
  modified_base (338)..(338): a, c, t, g, unknown or other
  misc_feature (338)..(338): n is a, c, g, or t
  modified_base (423)..(423): a, c, t, g, unknown or other
  misc_feature (423)..(423): n is a, c, g, or t
  modified_base (428)..(428): a, c, t, g, unknown or other
  misc_feature (428)..(428): n is a, c, g, or t
tcagactgtacagtcacgaccggtgctcgatttagatctactgacaggggagctgcgggtagagaagacaggactcaggacaatctccagcatggcctggtcccctctcttcctcaccctcatcactcactgtgcagggtcctgggcccagtctgtgctgactcagccaccctcggtgtctgaagcccccaggcagaggtcaccatctcctgttctggaagcagctccaacgtcggagataatgctagtaaactggtacagcaggtcccagggagctacccaaactcctcatctattatgatgatctgctgccctgaggggtctcctgaccgtattcnctcggctccaagtctggcacctcacgccctccctgccatcagtgggcctccgagtctgagatgaggctagtatttattacgtgtncgagngagtggtagtgacgaacgtccgttggtaagttgggttggggttgggttcggggttcgggacggggtaaccggaacggtaacggtcggtaccggttaccgtaacggttcgtaacccgg

SEQ ID NO: 309106 - DNA, 514 bp, Homo sapiens
  misc_feature: GZ8MTXP01BSGGY.25.6.A06.1.454.CMB.2.raw
  modified_base (220)..(220): a, c, t, g, unknown or other
  misc_feature (220)..(220): n is a, c, g, or t
  modified_base (296)..(296): a, c, t, g, unknown or other
  misc_feature (296)..(296): n is a, c, g, or t
  modified_base (339)..(339): a, c, t, g, unknown or other
  misc_feature (339)..(339): n is a, c, g, or t
  modified_base (386)..(386): a, c, t, g, unknown or other
  misc_feature (386)..(386): n is a, c, g, or t
  modified_base (402)..(402): a, c, t, g, unknown or other
  misc_feature (402)..(402): n is a, c, g, or t
  modified_base (404)..(404): a, c, t, g, unknown or other
  misc_feature (404)..(404): n is a, c, g, or t
  modified_base (406)..(406): a, c, t, g, unknown or other
  misc_feature (406)..(406): n is a, c, g, or t
  modified_base (408)..(408): a, c, t, g, unknown or other
  misc_feature (408)..(408): n is a, c, g, or t
  modified_base (411)..(411): a, c, t, g, unknown or other
  misc_feature (411)..(411): n is a, c, g, or t
  modified_base (423)..(423): a, c, t, g, unknown or other
  misc_feature (423)..(423): n is a, c, g, or t
  modified_base (429)..(429): a, c, t, g, unknown or other
  misc_feature (429)..(429): n is a, c, g, or t
tcagactgtacagtcacgaccggtgctcgatttagatctactgacaggggagctgcgggtagagaagacaggactcaggacaatctccagcatggcctggtcccctctcttcctcaccctcatcactcactgtgcagggtcctgggcccagtctgtgctgactcagccaccctcggtgtctgaacgcccccagcagaggtcaccatctctgttctggaancagctaccaacgtcgagataatgctagtaaactggtaccagcaggtcccgaagggaacgcctacccaaactcctanatctatatgatgatctgctgccctgaggggtctccgtggactnttctcgtggctccagtctcggcctacctcacgccctcctgccatcgngtcgctcagtgagagngngngngtntatatagtgtgngagagngtgagtgagcgtcgttagtagttggttgggtggttcgggttcgggacggaacgacgtcgtcgtacgttacgtaacgttcgtaacg

SEQ ID NO: 309107 - DNA, 567 bp, Homo sapiens
  misc_feature: GZ8MTXP01ET5RB.25.6.A06.1.454.CMB.2.raw
  modified_base (301)..(301): a, c, t, g, unknown or other
  misc_feature (301)..(301): n is a, c, g, or t
  modified_base (345)..(345): a, c, t, g, unknown or other
  misc_feature (345)..(345): n is a, c, g, or t
  modified_base (458)..(458): a, c, t, g, unknown or other
  misc_feature (458)..(458): n is a, c, g, or t
tcagactgtacagtcacgaccggtgctcgatttagatctactgacaggggagctgcgggtagagaagacaggactcaggacaatctccagcatggcctggtcccctctcttcctcaccctcatcactcactgtgcagggtcctgggcccagtctgtgctgactcagcccaccctcggtgtctgaacgcccccaggcagaggtcaccatctcctgttctggaagcagctaccaacgtcggagataatgctagtaaactggtaccagcgaggtcccgaagggaacgcctacccaaactcctanatctattatgatgatctgctcgccctgaggggtctcctgacgtnttctcgtcgctcgaagtctcgccacctcacgtccctcccgtcggcctagtcgaggtcgggcctccgtagtcgtggagtagtgaggtctaggttaatttattacgtgtcgcagnaggtggatcgacgaagtccgttaggtaaggttggggttggggtggttacggggcgggaacgggaaccgaggtccgtcggtaccggttccgtaacggttccgaacccggg

SEQ ID NO: 309108 - DNA, 559 bp, Homo sapiens
  misc_feature: GZ8MTXP01DYYJY.25.6.A06.1.454.CMB.2.raw
  modified_base (220)..(220): a, c, t, g, unknown or other
  misc_feature (220)..(220): n is a, c, g, or t
  modified_base (242)..(242): a, c, t, g, unknown or other
  misc_feature (242)..(242): n is a, c, g, or t
  modified_base (299)..(299): a, c, t, g, unknown or other
  misc_feature (299)..(299): n is a, c, g, or t
  modified_base (453)..(453): a, c, t, g, unknown or other
  misc_feature (453)..(453): n is a, c, g, or t
tcagactgtacagtcacgaccggtgctcgatttagatctactgacaggggagctgcgggtagagaagacaggactcaggacaatctccagcatggcctggtcccctctcttcctcaccctcatcactcactgtgcagggtcctgggcccagtctgtgctgactcagcccaccctcggtgtctgaacgcccccaggcagaggtcacatctctgtctggaancagctaccaagtcggagataangctagtaaactggtaaccagcacggtacccgaagggaacgcctacccaaactcctanatctattatgatgatctgctcgcccgtgagggtctccgtcggtactattcctacgtcggctccgagtcctcggcctacctcacgccctccgtagcctagtcgaggtcggtcctcgagtcgtagagtgtgaggtcttagtatttacgttacgtgngcgtagacgaggttgggactggactaaggtcttaggtaggtttgggtaggtcgggttcgggacgggaggtaaccgagcggttccgaccgttcgtaacggcgaaccg

SEQ ID NO: 309109 - DNA, 636 bp, Homo sapiens
  misc_feature: GZ8MTXP01B9NPG.25.6.A06.1.454.CMB.2.raw
  modified_base (240)..(240): a, c, t, g, unknown or other
  misc_feature (240)..(240): n is a, c, g, or t
  modified_base (304)..(305): a, c, t, g, unknown or other
  misc_feature (304)..(305): n is a, c, g, or t
  modified_base (333)..(333): a, c, t, g, unknown or other
  misc_feature (333)..(333): n is a, c, g, or t
tcagactgtacagtcacgaccggtgctcgatttagatctactgacaggggagctgcgggtagagaagacaggactcaggacaatctccagcatggcctggtcccctctcttcctcaccctcatcactcactgtgcagggtcctgggcccagtctgtgctgactcagccaccctcggtgtctgaacgccccccaggcagaggtcaccatctcctgttctggaagcagctccaacgtcgganataatgactgtaaactggtaccagcaggtcccgagggaacgcctccaaactcctcatctattannatgatctgctcgcctcgaggggtctccngaccgtattccgtcgtcgggccttccgaagttcccgtgggcctacccctcgacgtccccttcccgtggcccagtccgaggttcgggacctccgtaggtcgtggaggtatgggaacggtcttaggttaatttaacgtttaccgttggtgtccgagtaccgtagtacggggtattacggaactaagggtcccgttaggtaagggtttggggttacgggggtttcggttaccgggggccgggttaacggggaaccgaacgggtccgtacgggaccccggttcggtaaccgggttcgaaccccgggg

SEQ ID NO: 309110 - DNA, 561 bp, Homo sapiens
  misc_feature: GZ8MTXP01APS79.25.6.A06.1.454.CMB.2.raw
  modified_base (221)..(221): a, c, t, g, unknown or other
  misc_feature (221)..(221): n is a, c, g, or t
tcagactgtacagtcacgaccggtgctcgatttagatctactgacaggggagctgcgggtagagaagacaggactcaggacaatctccagcatggcctggtcccctctcttcctcaccctcatcactcactgtgcagggtcctgggcccagtctgtgctgactcagcccaccctcggtgtctgaacgcccccaggcagaggtcacatctcctgtctggaancagctccaacgtcggagataatgctagtaaactggtaccagcaggtcccgagggaacgcctcccaaactcctacatctattatgatgatctgctcgccctgaggggtctcgtcgacgtattcctcgtggcctccgaaagtcctcggcctacctcacgtccctcccgtcggccctagtcgaggtcgggctccgagtcgtgagatgaggtctagtaattagttacgtgtgctagcgtagtgggatcgcaagtccgttaggtaagttgggttacggggtggttcggggcgggttagggaacccgtaagtcgtacggtacccgttccgtaacggccgaacccgg

SEQ ID NO: 309111 - DNA, 693 bp, Homo sapiens
  misc_feature: GZ8MTXP01C4077.25.6.A06.1.454.CMB.2.raw
  modified_base (107)..(107): a, c, t, g, unknown or other
  misc_feature (107)..(107): n is a, c, g, or t
  modified_base (196)..(196): a, c, t, g, unknown or other
  misc_feature (196)..(196): n is a, c, g, or t
  modified_base (265)..(265): a, c, t, g, unknown or other
  misc_feature (265)..(265): n is a, c, g, or t
  modified_base (282)..(282): a, c, t, g, unknown or other
  misc_feature (282)..(282): n is a, c, g, or t
  modified_base (288)..(288): a, c, t, g, unknown or other
  misc_feature (288)..(288): n is a, c, g, or t
tcagactgtacagtcacgaccggtgctcgatttagatctactgacaggggagctgcgggtagagaagacaggactcaggacaatctccagcatggcctggtcccctntcttcctcaccctcctcactcactgtgcagggtcctgggcccagtctgtgctgtctcagccaccctcagtgtcgtcggggccccccggnaggagggtcacatctcttgttctggaatcgctccaagtcggcaagtatagtgtaagctggacagcaacncccaggacccgccccanctcctnatgtatggaatgactcgacgcccgcccctaggacggggtcccctagacccgtattcctccgtccgccctccgtacgtcgtcggacccaccctcgacgtcccctcccgtacgaccctacgtcccgggtcgggtacccttaccgaaattcggtaggacggtaagttacgggaacggttccgttaattttagttacgttggtacgccgaagggggtcgggttaggggaattacgggaacgtaaagggtaagttaaccggtttagtcggttaccgttacgggtaaacgttcgggaaacgtaacggttccctaacccggttcgttacggaacccaccggaccccgaaaccgggtaacccccaaacccgtcgttccggtaccttacccttcccggttcccgttaacccccc

SEQ ID NO: 309112 - DNA, 530 bp, Homo sapiens
  misc_feature: GZ8MTXP01DJFG0.25.6.A06.1.454.CMB.2.raw
  modified_base (296)..(296): a, c, t, g, unknown or other
  misc_feature (296)..(296): n is a, c, g, or t
  modified_base (411)..(411): a, c, t, g, unknown or other
  misc_feature (411)..(411): n is a, c, g, or t
tcagactgtacagtcacgaccggtgctcgatttagatctactgacaggggagctgcgggtagagaagacaggactcaggacaatctccagcatggcctggtcccctctcttcctcaccctcatcactcactgtgcagggtcctgggcccagtctgtgctgactcagccacctcggtgtctgaagcccccaggcagaggtcacatctcctgtctgaagcagctccaacgtcggagataatgctgtaaactggtaccagcaggtcccgaggaacgctacccaaatcctcatctattangatgatctgctgccctgagggttctccgtgacgtattctctgctccaagtctggccacctcacgccctccctggcccatcagtggctccgagtctgagatgaaggcttgaatttntacgtgtgctagcagtgggaatgaataagtccttaggtaagttgggttcgggtggtttacgggcgggacgggaacaacgggtctaccggaccggttacctaacggggttccaacccggg

SEQ ID NO: 309113 - DNA, 555 bp, Homo sapiens
  misc_feature: GZ8MTXP01AV8GK.25.6.A06.1.454.CMB.2.raw
  modified_base (419)..(419): a, c, t, g, unknown or other
  misc_feature (419)..(419): n is a, c, g, or t
tcagactgtacagtcacgaccggtgctcgatttagatctactgacaggggagctgcgggtagagaagacaggactcaggacaatctccagcatggcctggtcccctctcttcctcaccctcatcactcactgtgcagggtcctgggcccagtctgtgctgactcagccaccctcggtgtctgaagcccccaggcagaggtcaccatctcctgttctggaagcagctccaaacgtcggagataatgctgtaaactggtaaccagcaggtccccgaagggaacggcctaccccaaaactcctacatctaattatgatgatctgctgcccctgaggggtctcgtgaccgtattctcgtggcctccaaagtcctggccaacctcacgcccctccctcgcccaatcgagtcgggctccagtccngagatgaggctagtattattactgtgcagtcagttgggaatgaacaagtccttagtaaagttgggtttagggtggtttcgggcgggaacggaaccgaaaggtctacggtacccgttccgttaacggcgaacccggg

SEQ ID NO: 309114 - DNA, 602 bp, Homo sapiens
  misc_feature: GZ8MTXP01DHFLB.25.6.A06.1.454.CMB.2.raw
  modified_base (223)..(223): a, c, t, g, unknown or other
  misc_feature (223)..(223): n is a, c, g, or t
  modified_base (242)..(242): a, c, t, g, unknown or other
  misc_feature (242)..(242): n is a, c, g, or t
  modified_base (347)..(347): a, c, t, g, unknown or other
  misc_feature (347)..(347): n is a, c, g, or t
tcagactgtacagtcacgaccggtgctcgatttagatctactgacaggggagctgcgggtagagaagacaggactcaggacaatctccagcatggcctggtcccctctcttcctcaccctcatcactcactgtgcagggtcctgggcccagtctgtgctgactcagcccaccctcggtgtctgaacgcccccaggcaggaggtcaccatctctgttctggaancagctaccgaacgtcgganataatgctagtaaactggtacagcaggtcccgaagggaacgcctaccccaaactcctacatctattatgatgatctgctcgccctcgagggtctccgtcgacgtnttcctcgtcgctcgaagtctcggccacctcacgtccctcccgtcggcctacgtcgaggtcgggctcgtagtcgtaggacgagtagacggtcgttaggttatttaacgttacgtggtcgcgagacgtagtgggatgaaccgtggtccgttagggtaacggttgggggtttacgggttcgggttccgggggacgggaaccggggaacctaacgggtccgtacgggtacccggttacggttaacggccgtaacccggg

SEQ ID NO: 309115 - DNA, 628 bp, Homo sapiens
  misc_feature: GZ8MTXP01DUV5X.25.6.A06.1.454.CMB.2.raw
tcagactgtacagtcacgaccggtgctcgatttagatctactgacaggggagctgcgggtagagaagacaggactcaggacaatctccagcatggcctggtcccctctcttcctcaccctcatcactcactgtgcagggtcctgggcccagtctgtgctgactcagcccaccctcggtgtctgaacgcccccaggccagaggtcaccatctcctgttctggaagcagctccaacgtcggagataatgactgtaaactggtaccagcaggtcccaagggagctccccaaactcctcatctattatgatgatctgctgccctgagggtcctctcgacgtatttcctctaacgggccctccgaagtccctgggccctaccctcgacgtccccttccccgtggcccctattccgaagggttcggggtcccttaccgtacgggtcctagggaggaagttggaaccggggtttcgttaaggttaacttttacgttacggtgttacgttgtttagggtttacgggtcgttccgtccgtagttcgtgggtacggttcgggtaccggttcgggttcggtcggggacgggacgggacgaacggtccgtcggtaccgtcggttacgtccgaaccgtccg

SEQ ID NO: 309116 - DNA, 639 bp, Homo sapiens
  misc_feature: GZ8MTXP01CAO36.25.6.A06.1.454.CMB.2.raw
  modified_base (223)..(223): a, c, t, g, unknown or other
  misc_feature (223)..(223): n is a, c, g, or t
  modified_base (291)..(291): a, c, t, g, unknown or other
  misc_feature (291)..(291): n is a, c, g, or t
  modified_base (398)..(398): a, c, t, g, unknown or other
  misc_feature (398)..(398): n is a, c, g, or t
tcagactgtacagtcacgaccggtgctcgatttagatctactgacaggggagctgcgggtagagaagacaggactcaggacaatctccagcatggcctggtcccctctcttcctcaccctcatcactcactgtgcagggtcctgggcccagtctgtgctgactcagcccaccctcggtgtctgaacgcccccaggcagaggtcaccatctcctgttctggaancagctccaacgtcgagtataatgctagtaaactggtacagcacggtccgagggacgctacccaactcncatctattatgatgactctgctcgccctgacgggtctccgtgaccgtattcctcgtacggtccctccgaaagttccgtcggccacccttcgaccgtccccttcccgnggtacccctaagtccgtaaggtcgggtaccccttacgtacgttcgaggtacggtaagtcgggacgttacgttaggtaatttttaacgttaccggtgttacgacgtagtaccgtagtaggggtaactcggtaacgtcggtacgttagggtagggtttgggggttacggggtcgggttacggggacggttacgggaaccgtacggtcggtaccggtacccgttacggtaaccggccgtaaccg

SEQ ID NO: 309117 - DNA, 661 bp, Homo sapiens
  misc_feature: GZ8MTXP01DHWG4.25.6.A06.1.454.CMB.2.raw
  modified_base (221)..(221): a, c, t, g, unknown or other
  misc_feature (221)..(221): n is a, c, g, or t
  modified_base (240)..(240): a, c, t, g, unknown or other
  misc_feature (240)..(240): n is a, c, g, or t
  modified_base (345)..(345): a, c, t, g, unknown or other
  misc_feature (345)..(345): n is a, c, g, or t
  modified_base (349)..(349): a, c, t, g, unknown or other
  misc_feature (349)..(349): n is a, c, g, or t
tcagactgtacagtcacgaccggtgctcgatttagatctactgacaggggagctgcgggtagagaagacaggactcaggacaatctccagcatggcctggtcccctctcttcctcaccctcatcactcactgtgcagggtcctgggcccagtctgtgctgactcagcccacctcggtgtctgaacgcccccaggcagaggtcaccatctctgttctggaancagctaccgaacgtcgganataatgactagtaactggtaccagcacggtccaagggacgcctacccaaactccacatctattactgaatgatcgtgcctgccctgacgggtctccgtcgacgtnttcncgtacggcttccgagtcctcggacctacctcgacgtcccttcccgtcggaccctagtccgtacgggttccgggtaccctaccggttacggtaccgttaggggaacggtacgttaagggtaccgggttacggtttaagggtttaaaacttttaaacggtttaccgttgggtaccgtacgtaacggtaccgttaggtcgggtaacgttcgaacgtaacggtcgttagggtacggtttgggttggggttcggttacggggcggttaacgggaaccgagtcgtcggtaccgttacgtaacggttaaccgaacccgg

SEQ ID NO: 309118 - DNA, 509 bp, Homo sapiens
  misc_feature: GZ8MTXP02HHTQZ.25.6.A06.1.454.CMB.2.raw
  modified_base (314)..(314): a, c, t, g, unknown or other
  misc_feature (314)..(314): n is a, c, g, or t
  modified_base (419)..(419): a, c, t, g, unknown or other
  misc_feature (419)..(419): n is a, c, g, or t
  modified_base (428)..(428): a, c, t, g, unknown or other
  misc_feature (428)..(428): n is a, c, g, or t
tcagactgtacagtcacgaccggtgctcgatttagatctactgacaggggagctgcgggtagagaagacaggactcaggacaatctccagcatggcctggtcccctctcttcctcaccctcatcactcactgtgcagggtcctgggcccagtctgtgctgactcagccaccctcggtgtctgaagcccccaggcagagggtcaccatctcctgttctggaagcagctccaacgtcggagataatgctgtaaactggtaccagcaggtcccaggaagctccaaactcctcatctatatgatgatctgctgccctnaggggtctcctgaccgtattctctggctccaagtctggcacctcagccctccctgcccatcagtggctccagtctgaggatgaggctgtattattactgtgcagngagtggagngacgacgacgtagtagtggttgggtcggtcgggtacgggacggaacggacgacgtacgtaccgtaccgtacggtacgtacg

SEQ ID NO: 309119 - DNA, 341 bp, Homo sapiens
  misc_feature: GZ8MTXP02IY6OM.25.6.A06.1.454.CMB.2.raw
  modified_base (330)..(341): a, c, t, g, unknown or other
  misc_feature (330)..(341): n is a, c, g, or t
tcagactgtacagtcacgaccggtgctcgatttagatctactgacaacgacacaagggcactgactttatggtgcaactaaaaacactcttggacccctgcccggttctcaggctccctccttggggcaaagctgccctgacactgtcagatgtgcagcctgaggtacgaggctgactaccactgcctgctctcctctgggtggtgcttgggtgttcggcggagggaccaaactgaccgtcctgggtcagcccaagggcctcgccccctcggtcactctgttccccgcctcctcactgtacagtctgagcgggctggcaaggcgcatagnnnnnnnnnnnn

SEQ ID NO: 309120 - DNA, 485 bp, Homo sapiens
  misc_feature: GZ8MTXP02JLYSM.25.6.A06.1.454.CMB.2.raw
tcagactgtacagtcacgaccggtgctcgatttagatctactgacaggggagctgcgggtagagaagacaggactcaggacaatctccagcatggcctggtcccctctcttcctcaccctcatcactcactgtgcagggtcctgggcccagtctgtgctgactcagccaccctcggtgtctgaagcccccaggcagaggtcaccatctcctgttctggaagcagctccaacgtcggagataatgctgtaaactggtaccagcaggtcccagggaagctcccaaactcctcatctatatgatgatctgctgccctcgaggggtctaccgtgaccgtattctctggctccaagtctggccactcacgcctccctgccatcagtcggctccagtctgagatggagctgtattattactgtgcagcagtgggatgacagctagatgggtggtgtcggcggaggaaccaagctcgaccgtcgtaggcacg

SEQ ID NO: 309121 - DNA, 495 bp, Homo sapiens
  misc_feature: GZ8MTXP02H5J1J.25.6.A06.1.454.CMB.2.raw
  modified_base (394)..(394): a, c, t, g, unknown or other
  misc_feature (394)..(394): n is a, c, g, or t
tcagactgtacagtcacgaccggtgctcgatttagatctactgacaggggagctgcgggtagagaagacaggactcaggacaatctccagcatggcctggtcccctctcttcctcaccctcatcactcactgtgcagggtcctgggcccagtctgtgctgactcagcccaccctcggtgtctgaagccccccaggcagagggtcaccatctcctgttctggaagcagctccaacgtcggagataatgctgtaaactggtaccagcaggtcccaggaaggctcccaaactcctcatctatatgatgatctgctgccctcgaggggtctcctgaccgattctctggctcaagtctggcacctcacgccctccctgccatcagtggctccagtctgngatgaggctgtattatactgtgcagcagtgggatgacagctgagttggtgggttcgttcggcggagggaaccgaagcgtacgaccgtccgtacggtcacgg

SEQ ID NO: 309122 - DNA, 553 bp, Homo sapiens
  misc_feature: GZ8MTXP02ISLNU.25.6.A06.1.454.CMB.2.raw
  modified_base (361)..(361): a, c, t, g, unknown or other
  misc_feature (361)..(361): n is a, c, g, or t
tcagactgtacagtcacgaccggtgctcgatttagatctactgacaggggagctgcgggtagagaagacaggactcaggacaatctccagcatggcctggtcccctctcttcctcaccctcatcactcactgtgcagggtcctgggcccagtctgtgctgactcagccaccctcggtgtctgaacgccccaggcagaggtcaccatctcctgttctggaagcagctccaacgtcggagataatgctagtaaactggaccagcaggtcccaggaagctccaaatctcatctatatgatgatctgctgcctcacgggtcgtcctgaccgactctctcggctccaacgtctcggcaccctcacncctccctcgcactacgacggtcggtcgtacgtcgtagagagtagtaggtcgtcgtacttattacgtcgtcgcgacgacgtagtaggtagtagacgacgtacgtagtaggttaggttggttcgggtttacggggtacgggtaacgggaacggaacggtacgtacggtaccggtaccgtacggtacgacgaccg

SEQ ID NO: 309123 - DNA, 532 bp, Homo sapiens
  misc_feature: GZ8MTXP02I88U7.25.6.A06.1.454.CMB.2.raw
  modified_base (415)..(415): a, c, t, g, unknown or other
  misc_feature (415)..(415): n is a, c, g, or t
tcagactgtacagtcacgaccggtgctcgatttagatctactgacaggggagctgcgggtagagaagacaggactcaggacaatctccagcatggcctggtcccctctcttcctcaccctcatcactcactgtgcagggtcctgggcccagtctgtgctgactcagccaccctcggtgtctgaagcccccaggcagagggtcaccatctcctgttctggaagcagctccaacgtcggagataatgctgtaaactggtaccagcaggtccccagggaacggcctaccccaaactcctcatctattatgatgatctgctcgccctcaggggtctctcgaccgtattctcttcggctccgaagtctggcctacctcacgccctcccgtcgcccatcaggtcgggcctcgagtctgagntgaggtctgtattatactgtgcagctagtggatgacacgcgtagtagttgggttgggtcgttcgggcgggacggggaaccgaaagcgtacggacccgtaccgtacggtacgaaccgg

SEQ ID NO: 309124 - DNA, 666 bp, Homo sapiens
  misc_feature: GZ8MTXP02JB2WR.25.6.A06.1.454.CMB.2.raw
tcagactgtacagtcacgaccggtgctcgatttagatctactgacaggggagctgcgggtagagaagacaggactcaggacaatctccagcatggcctggtcccctctcttcctcaccctcatcactcactgtgcagggtcctgggcccagtctgtgctgactcagccaccctcggtgtctgaacgccccccaggcagaggtcaccatctcctgttctggaagcagctaccgaacgtcggagataatgctagtaaactgtaccagcacggtcccagggacgctacccaaactcctcatctatatgatgatctgcctcgcccctcgaggggtcctccgtagacccgtattcctcgtcggtcctccgaagtcctcggacccacccgttcaccgtccccctccccgttcggccctaacgtccgtacggtcggggtacccttcccgtaaggttccgtagggacgggtagtacgggtacgggtacttaaggtaattttacgtttaaccgttggttaacgccgaaggtcgtaaaggtgggggtaacttaggaacccgtaggtacccgttaaggtaaacggtttgggggtttggggtttacggttccgggggacgggtaacgggaaccgtaaacgtccgtacggtacccgtaccgtacggtaccgaaacccgg

SEQ ID NO: 309125 - DNA, 612 bp, Homo sapiens
  misc_feature: GZ8MTXP02JEPW7.25.6.A06.1.454.CMB.2.raw
  modified_base (224)..(224): a, c, t, g, unknown or other
  misc_feature (224)..(224): n is a, c, g, or t
tcagactgtacagtcacgaccggtgctcgatttagatctactgacaggggagctgcgggtagagaagacaggactcaggacaatctccagcatggccggcctccctctcctcctcaccctcctcactcactgtgcagggtcctgggcccagtctgtgctgactcagccaccctcagtgtctcgggacccccgggcagagggtcctccatctcttgttctgggancagctccgacgtcggaaattagtttgtctactggtacagcacgctccacgaaaccggacccccaacgcctcctcactctataggaatgatcacgcggcccgtagacccccccccgggataccgtacgaccgtacttctccgtcgtcgtacgaacgtcgtcggtcctccgtccggcctcccgtcgccactcgtaggtcggccgtcccggtccggaggagtgaggcgtagtaatattacgtgtgtcgtaggttagggtagtgccgtagtcgtggtacggtcggtcggtacgggttcgggtcgggacgggacgggacgacggcgtacgtaccgtaccgtacggtcgaccggccgaacggccgtcccgtccccgtccggtcctacgttcccg

SEQ ID NO: 309126 - DNA, 616 bp, Homo sapiens
  misc_feature: GZ8MTXP02ISRDU.25.6.A06.1.454.CMB.2.raw
tcagactgtacagtcacgaccggtgctcgatttagatctactgacaggggagctgcgggtagagaagacaggactcaggacaatctccagcatggcctggtcccctctcttcctcaccctcatcactcactgtgcagggtcctgggcccagtctgtgctgactcagcccaccctcggtgtctgaacgcccccaggcagagggtcaccatctcctgttctggaagcagctccaacgtcggagataatgctgtaaactggtaccagcaggtcccgagggaacggcctaccccaaactcctcatctattatgatgatctgctcgccctcgaggggtctccgtgaccgtattctcgtgctcgacgtctggcctccgtcggccctcccgtcggcccatcgaggtcggggccgtcccgggtccgagggtactggaggtctaggaattattacgtgtgcgtaggtttggatcggccgtagttcgtaggtcgttcgggttaccggtacggggttggtttccgggggacggggtaaacggggacccgaaaggtcccgttaggtaaccccggttaccgttacgggttaccgaaaccgggcccccgaaacggggtcccgtcccccgg

SEQ ID NO: 309127 - DNA, 604 bp, Homo sapiens
  misc_feature: GZ8MTXP02G0DBR.25.6.A06.1.454.CMB.2.raw
  modified_base (216)..(216): a, c, t, g, unknown or other
  misc_feature (216)..(216): n is a, c, g, or t
  modified_base (290)..(290): a, c, t, g, unknown or other
  misc_feature (290)..(290): n is a, c, g, or t
  modified_base (337)..(337): a, c, t, g, unknown or other
  misc_feature (337)..(337): n is a, c, g, or t
  modified_base (420)..(420): a, c, t, g, unknown or other
  misc_feature (420)..(420): n is a, c, g, or t
  modified_base (430)..(430): a, c, t, g, unknown or other
  misc_feature (430)..(430): n is a, c, g, or t
tcagactgtacagtcacgaccggtgctcgatttagatctactgacaggggagctgcgggtagagaagacaggactcaggacaatctccagcatggcctggtcccctctcttcctcaccctcatcactcactgtgcagggtcctgggcccagtctgtgctgactcagcccaccctcggtgtctgaacgcccccaggcagaggtcacatctctgttcnggagcagctccaacgtcggagataatgctagtaaactggtaccagcaggtcccagggacgcctaccaaactccncatctatatgatgatctgtctcgcctgaggggtctccgtcgaccgtnttctcgtcggctccgagtctcggccacctcaccgtccctcccgtcgcccagtcgaggtcgggcctcccgagtcgtaggacggngtggacggtnttagtaatttagttacgtgtgacgtagtcgtaggttggagtcggaacgtacggtaccggttaaggtacggtttcgggggttagggggttcgggttaccgggggacggggtaacgggaaccgtaaacggtccggtacgggtaacccggttccggtaacgggtaccgaaccccggg

SEQ ID NO: 309128 - DNA, 540 bp, Homo sapiens
  misc_feature: GZ8MTXP02G5OIU.25.6.A06.1.454.CMB.2.raw
  modified_base (230)..(230): a, c, t, g, unknown or other
  misc_feature (230)..(230): n is a, c, g, or t
tcagactgtacagtcacgaccggtgctcgatttagatctactgacaggggcagcttcagctgcgggtagagaagacaggactcaggacaatctccagcatggcctggtcccctctcttcctcaccctcatcactcactgtgcagggtcctgggcccagtctgtgctgactcagccaccctcggtgtctgaagccccccaggcagagggtcaccatctcctgttctggaancagctccaagtcggagataatgctagtaaactggtaccagcaggtccccgaagggacggcctccaaactcctcatctattatgatgatctgtctcgtccccctgacggggtctcgtgacccgtattcctcgtcggctccaagtctggcctacctcacgtccctcctcggccctatccgagttcgggctcccgagtcgtggaggagtagcggactagtattacttgtgtcgcagcgagtagggatcgacacgcctagaagttgggttgggtggtttcggacgggtacggaccgtaaggctacggtacccgg

SEQ ID NO: 309129 - DNA, 633 bp, Homo sapiens
  misc_feature: GZ8MTXP02HPGMT.25.6.A06.1.454.CMB.2.raw
  modified_base (246)..(246): a, c, t, g, unknown or other
  misc_feature (246)..(246): n is a, c, g, or t
  modified_base (352)..(352): a, c, t, g, unknown or other
  misc_feature (352)..(352): n is a, c, g, or t
  modified_base (412)..(412): a, c, t, g, unknown or other
  misc_feature (412)..(412): n is a, c, g, or t
  modified_base (440)..(440): a, c, t, g, unknown or other
  misc_feature (440)..(440): n is a, c, g, or t
tcagactgtacagtcacgaccggtgctcgatttagatctactgacaggggagctgcgggtagagaagacaggactcaggacaatctccagcatggcctggtcccctctcttcctcaccctcatcactcactgtgcagggtcctgggcccagtctgtgctgactcagcccaccctcggtgtctgaacgcccccaggcagaggtcaccatctcctgttctggaagcagctccaacggtcggagataangactagtaaactggtaccagcacggtccccgagggaacgcctaccccaaaactcctacattctattatgatgatctgctcgccctgacggggtctcctcgaccgtnttcctgtcggctccgtaagtctcggcctacccgtcacgtcccctccgtcgcctactacgnggtcggtctcccgagttctaggagtagnggtaggtctagttattaagttacgtggttcagagacgtaggttaggggacttagaaccgtaggtacccggttaaggtaacggtttgggggttaggggttacggggtcgggggttaaccggggaacgggggtaaacccgtaggaccggtttacccggaaccggtttcccggaaacgggttccgaaaccccgggg

SEQ ID NO: 309130 - DNA, 597 bp, Homo sapiens
  misc_feature: GZ8MTXP02GIGZ5.25.6.A06.1.454.CMB.2.raw
  modified_base (245)..(245): a, c, t, g, unknown or other
  misc_feature (245)..(245): n is a, c, g, or t
  modified_base (467)..(467): a, c, t, g, unknown or other
  misc_feature (467)..(467): n is a, c, g, or t
tcagactgtacagtcacgaccggtgctcgatttagatctactgacaggggagctgcgggtagagaagacaggactcaggacaatctccagcatggcctggtcccctctcttcctcaccctcatcactcactgtgcagggtcctgggcccagtctgtgctgactcacgcccacccgtcggtgtctgaacgcccccaggcaggaggtcaccatcctctgttctggagcagctccaacgtcgagatangactgtaaactggtaccagcgacggtccccgaggaacgcctccccgtaaactcctcatctatatgatgatctgctcgtccctgacggggtctcgtcgaccgtattcctcgtgtcctccgtaagtccgtcggacctccgtcacggtccccttcccgtcggccctagttccgaggtcggtcctccgtagtcgaggagtgtcggagtctagtatttagtacgtgngacagtgaagtggagtgaacgtcgtcgttaggtacgggttgggttgggggtcggttacccggggagggtaacggggaaccgtaacggtaccggtaccggtacccgttcggtaaccggttcgaaccccggg

SEQ ID NO: 309131 - DNA, 579 bp, Homo sapiens
  misc_feature: GZ8MTXP02JI9CO.25.6.A06.1.454.CMB.2.raw
  modified_base (416)..(416): a, c, t, g, unknown or other
  misc_feature (416)..(416): n is a, c, g, or t
  modified_base (425)..(425): a, c, t, g, unknown or other
  misc_feature (425)..(425): n is a, c, g, or t
  modified_base (442)..(442): a, c, t, g, unknown or other
  misc_feature (442)..(442): n is a, c, g, or t
tcagactgtacagtcacgaccggtgctcgatttagatctactgacaggggagctgcgggtagagaagacaggactcaggacaatctccagcatggcctggtcccctctcttcctcaccctcatcactcactgtgcagggtcctgggcccagtctgtgctgactcagccaccctcggtgtctgaagcccccaggcagagggtcaccatctcctgttctggaagcagctccaacgtcgagataatgctgtaaactggtaccagcaggtcccagggtaaggctcccaaactcctcatctatactgatgatctgctgccctcgaggggtctcgtgaccgtattcctcgtggcctccgtaagtcctcggccacctcacgccctcccgtggaccctagtcaggtggcctccgagtctgaggntggacggtntagtattacttacgtgngacgagacgtaggtaggatcggaactacggtaccgtaggttacggttggggttacggggttacggtaccggggtacgggtaacgggaaccgtaacgtccggttaccggtacccggttaccggtacggtaccgaccgg

SEQ ID NO: 309132 - DNA, 583 bp, Homo sapiens
  misc_feature: GZ8MTXP02HRU76.25.6.A06.1.454.CMB.2.raw
  modified_base (219)..(219): a, c, t, g, unknown or other
  misc_feature (219)..(219): n is a, c, g, or t
  modified_base (301)..(301): a, c, t, g, unknown or other
  misc_feature (301)..(301): n is a, c, g, or t
  modified_base (310)..(310): a, c, t, g, unknown or other
  misc_feature (310)..(310): n is a, c, g, or t
  modified_base (366)..(366): a, c, t, g, unknown or other
  misc_feature (366)..(366): n is a, c, g, or t
  modified_base (378)..(378): a, c, t, g, unknown or other
  misc_feature (378)..(378): n is a, c, g, or t
tcagactgtacagtcacgaccggtgctcgatttagatctactgacaggggagctgcgggtagagaagacaggactcaggacaatctccagcatggcctggtcccctctcttcctcaccctcatcactcactgtgcagggtcctgggcccagtctgtgctgactcagcccaccctcggtgtctgaacgcccccaggcaggaggtcaccatctcctgttcnggaagcagctaccaacgtcggagataatgctagtaaactggtaccagcacggtacccgaggaacgcctacccaaactcctanatctattangatgatctgctcgcctgcgggtctccgtcgaccgtatcgtctcggctccgagttcncgccacctcacnccctccgtcgcctatacgcggtcggcctccgagtcgtgagagtgagtctagttattattgtgtgacgtacgagtgtaggagtacgacgtaacgtccgttaggtacggtttggggtttaggggttcgggttcgggggtacggggacggggtaaccggacggaccggttacggtacccgttaccggtacggttaccggaaccccggg

SEQ ID NO: 309133 - DNA, 575 bp, Homo sapiens
  misc_feature: GZ8MTXP02IRBDA.25.6.A06.1.454.CMB.2.raw
  modified_base (222)..(222): a, c, t, g, unknown or other
  misc_feature (222)..(222): n is a, c, g, or t
  modified_base (423)..(423): a, c, t, g, unknown or other
  misc_feature (423)..(423): n is a, c, g, or t
  modified_base (450)..(450): a, c, t, g, unknown or other
  misc_feature (450)..(450): n is a, c, g, or t
  modified_base (485)..(485): a, c, t, g, unknown or other
  misc_feature (485)..(485): n is a, c, g, or t
tcagactgtacagtcacgaccggtgctcgatttagatctactgacaggggagctgcgggtagagaagacaggactcaggacaatctccagcatggcctggtcccctctcttcctcaccctcatcactcactgtgcagggtcctgggcccagtctgtgctgactcagcccaccctcggtgtctgaacgcccccaggcagaggtcaccatctctgttctggaancagctaccaacgtcggagataatgctagtaaactggtaccagtccgacggtcccgagggaacggcctaccccgaaaacctccctacattccgtaatttacgtagtatgattctacggctcgtcccgtacgaggggttcctccgtcgaccgtattcctcgtacgctccgtagtcctggccaccgtcacgtccctccgtgccntcgagtcggctccgagttcgacgtagngttagacggttgtattagttattacgtgcgcaagngtaagtggatcgactaggctaggtagtggggttcggtacggttcggagggtacgaacgaaggctacggtacgttacgtacggaccaccgg

SEQ ID NO: 309134 - DNA, 622 bp, Homo sapiens
  misc_feature: GZ8MTXP02GFQCS.25.6.A06.1.454.CMB.2.raw
  modified_base (358)..(358): a, c, t, g, unknown or other
  misc_feature (358)..(358): n is a, c, g, or t
tcagactgtacagtcacgaccggtgctcgatttagatctactgacaggggagctgcgggtagagaagacaggactcaggacaatctccagcatggcctggtccccctctcttcctcaccctcatcactcactgtgcagggtcctgggcccagtctgtgctgactcagcccaccctcggtgtctgaacgccccccaggcagaggtcaccatctcctgttctggaagcagctccaacgtcggagtataatgactagtaaactcggtaccagcgacggtacccgaagggaacgcctaccccaaacctcctactattactattatgatgatctgctcgcctgacgggtctccgtcgaccgtnttctcgtcgtctcgacgtcgtcgccaccgtcaccgtccctcccgtcgcctacgtcgagtcgcctccgagtcgtagagtgtaggaggtacttaggttatttaacgttacgttggacgtacgagtacgtaaggttagggaactaggaaccgtaggtacgtttaggtaacggtttacgggggttggggttcgggttaccgggggacgggaacgggtaaccgaacggttccgtaacgggtcccggttacggtaacggtccgaacccgg

SEQ ID NO: 309135 - DNA, 666 bp, Homo sapiens
  misc_feature: GZ8MTXP02H8KD7.25.6.A06.1.454.CMB.2.raw
  modified_base (225)..(225): a, c, t, g, unknown or other
  misc_feature (225)..(225): n is a, c, g, or t
  modified_base (227)..(228): a, c, t, g, unknown or other
  misc_feature (227)..(228): n is a, c, g, or t
  modified_base (241)..(241): a, c, t, g, unknown or other
  misc_feature (241)..(241): n is a, c, g, or t
  modified_base (368)..(368): a, c, t, g, unknown or other
  misc_feature (368)..(368): n is a, c, g, or t
tcagactgtacagtcacgaccggtgctcgatttagatctactgacaggggagctgcgggtagagaagacaggactcaggacaatctccagcatggcctggtcccctctcttcctcaccctcatcactcactgtgcagggtcctgggcccagtctgtgctgactcagcccaccctcggtgtctgaacgccccccaggcaggaggtcaccatctcctgttctggaancnnctccaagtcgganataatgactgtaaactggtacagcacggtcccgagggtaacggctaccccaaactcctactatctattagagtatgattaccgtcgtcttccgccccttcggtacggggtctacccgtacgaccgtntttccgtacttcgccttaccgagttctcggacccacccgtctaccggtcccttacccgtcggcccctagtaccggtacggtccgggtcctacccgtaacgtccgttagggaaggtcgtagggagggtaccttaggttaacttttaacggttaccgtaggttcggaccgtaggttaccgaggtacgggtaatacggaacgtcgaaccgttggtagggtttgggtcgggttcgggtacggggacgggaaccggtaacgaacggccgtacggtaccggtaccggtacggtaccgaacccgg

SEQ ID NO: 309136 - DNA, 639 bp, Homo sapiens
  misc_feature: GZ8MTXP02FP6WB.25.6.A06.1.454.CMB.2.raw
  modified_base (222)..(222): a, c, t, g, unknown or other
  misc_feature (222)..(222): n is a, c, g, or t
  modified_base (242)..(242): a, c, t, g, unknown or other
  misc_feature (242)..(242): n is a, c, g, or t
  modified_base (260)..(260): a, c, t, g, unknown or other
  misc_feature (260)..(260): n is a, c, g, or t
tcagactgtacagtcacgaccggtgctcgatttagatctactgacaggggagctgcgggtagagaagacaggactcaggacaatctccagcatggcctggtcccctctcttcctcaccctcatcactcactgtgcagggtcctgggcccagtctgtgctgactcagccaccctcggtgtctgaacgcccccaggcagaggtcaccatctcctgttctggaancagctccaagtcggagatangtatagtaacgtcgtacngcgtacggaccggaggacgtcctaacctaacctcctactatacttattagtagtatagtactcgtcgtccgtccgtaccgtacggtacggttcctacgtaccgacgttcttccgtcggtaccgtacctacgtacgtcgtaccgaccctacctacgcccggtccctccgtacgacctacgtcgtacggtccgtcctacgtcttcggagaaggtgacggtagtgtattacgtttacgtacgttgagaccgacgtcgttaggaggtacgtacgaacgtcgtacgttaaggtcgggtttggggttcggggttaccggtacggggcggttaaaccggaacgaacggtcggtaccggttaccgtacgtacgggacctaacccggg

SEQ ID NO: 309137 - DNA, 600 bp, Homo sapiens
  misc_feature: GZ8MTXP02I1LA8.25.6.A06.1.454.CMB.2.raw
  modified_base (219)..(219): a, c, t, g, unknown or other
  misc_feature (219)..(219): n is a, c, g, or t
  modified_base (237)..(237): a, c, t, g, unknown or other
  misc_feature (237)..(237): n is a, c, g, or t
  modified_base (252)..(252): a, c, t, g, unknown or other
  misc_feature (252)..(252): n is a, c, g, or t
  modified_base (257)..(257): a, c, t, g, unknown or other
  misc_feature (257)..(257): n is a, c, g, or t
  modified_base (282)..(282): a, c, t, g, unknown or other
  misc_feature (282)..(282): n is a, c, g, or t
  modified_base (291)..(292): a, c, t, g, unknown or other
  misc_feature (291)..(292): n is a, c, g, or t
tcagactgtacagtcacgaccggtgctcgatttagatctactgacaggggagctgcgggtagagaagacaggactcaggacaatctccagcatggcctggtcccctctcttcctcaccctcatcactcactgtgcagggtcctgggcccagtctgtgctgactcagccaccctcggtgtctgaacgcccccaggcagaggtcacatctctgtctggaancagctaccaacgtcgganataatgctagtaacngtacngcaggccaggacgctacccaactcnatctattannatgatctgctcgcctcgagggtctccgtcgaccgtattctctcggctccgtagtccgtgcctacctcacgtcccctccgtcgcctacgtcgacggtcgggcctccgtcggttcgaggtacggtagtagggacggttcgttaggttatttacgttaccgttgtacgacgtacggagtaaggtgggtatacgaacgtacggtaccgttaaggttaacggttggggttgggtttcgggttacggggacggggtacggtaaccggtaggtaccggtaccggtacccggttaccgtacggttaccgaacccgg

SEQ ID NO: 309138 - DNA, 506 bp, Homo sapiens
  misc_feature: GZ8MTXP01D6PNT.25.86.H09.1.454.CMB.2.raw
  modified_base (500)..(500): a, c, t, g, unknown or other
  misc_feature (500)..(500): n is a, c, g, or t
tcagactgtacagtcacgaccggtgctcgatttagtgctatagacttgggtttggggagtcagacccactcaggacacagcatggacatgagggtccccgctcagctcctggggcttctgctgctctggctcccaggtgccaaatgtgccatccagttgacccagtctccatcctccctgtctgcctctgttcgagacatagtcaccatcacttgtcgggctagtcgggtcattggcagtgctttagcctggtatcagcagaaaccaggggaagctcctaagctcctgatctttgatgcctccagtttggaaagtggagtcccatcaaggttcagcggcagtgggatcgtgggacagatttcatcctcaccatcagcagccctgcagcctagacgattctgcaacttattattagtacaaactaatttaaggactttaccctcttctccgttcggcggtaggaccaaaggttggagattcgaaacgaactgtgctgcacnttctcg

SEQ ID NO: 309139 - DNA, 472 bp, Homo sapiens
  misc_feature: GZ8MTXP01ECOT9.25.86.H09.1.454.CMB.2.raw
  modified_base (358)..(358): a, c, t, g, unknown or other
  misc_feature (358)..(358): n is a, c, g, or t
  modified_base (382)..(382): a, c, t, g, unknown or other
  misc_feature (382)..(382): n is a, c, g, or t
  modified_base (387)..(387): a, c, t, g, unknown or other
  misc_feature (387)..(387): n is a, c, g, or t
  modified_base (401)..(401): a, c, t, g, unknown or other
  misc_feature (401)..(401): n is a, c, g, or t
  modified_base (442)..(442): a, c, t, g, unknown or other
  misc_feature (442)..(442): n is a, c, g, or t
  modified_base (447)..(447): a, c, t, g, unknown or other
  misc_feature (447)..(447): n is a, c, g, or t
  modified_base (458)..(458): a, c, t, g, unknown or other
  misc_feature (458)..(458): n is a, c, g, or t
  modified_base (461)..(461): a, c, t, g, unknown or other
  misc_feature (461)..(461): n is a, c, g, or t
  modified_base (472)..(472): a, c, t, g, unknown or other
  misc_feature (472)..(472): n is a, c, g, or t
tcagactgtacagtcacgaccggtgctcgatttagtgctatagacttgggtttgggggagtcagacccactcaggacacagcatggacatgagggtcccgctcagctcctggggcttctgctgctctggctcccaggtgccaaatgtgccatccagttgacccagtctccatcctccctgtctgcctctgttcgagacatagtcaccatcacttgtcgggctagtcgggtcattggcagtgctttagcctggtatcagcagaaaccaggggaagctcctaagctcctgatctttgatgctcagtttgaagtgatccatcaaggtcagcggcagtgatcgtgggacagatttcatcctnaccatcagcagcctgcagcctganattcnactaacttattatnacaataattagacttcctctctccgtcggcggaggacaggngaganacgaaagatgngcngcactcttgtn

SEQ ID NO: 309140 - DNA, 611 bp, Homo sapiens
  misc_feature: GZ8MTXP01DGDM4.25.86.H09.1.454.CMB.2.raw
  modified_base (274)..(274): a, c, t, g, unknown or other
  misc_feature (274)..(274): n is a, c, g, or t
  modified_base (286)..(286): a, c, t, g, unknown or other
  misc_feature (286)..(286): n is a, c, g, or t
tcagactgtacagtcacgaccggtgctcgattagtgctatagacttgggtttggggagtcagacccactcaggacacagcatggacatgagggtccccgctcagctcctggggcttctgctgctctggctcccaggtgccaaatgtgccatccagttgacccagtctccatcctccctgtctgcctctgttcgagacatagtcaccatcacttgtcgggctagtcgggtcattggcagtgctttagcctggtatcagcagaaaccaggggaacnctactagctctntattcttgatcgcctcgtaggtttaggaagtggacgtccatacgtaacggtcaggcggcaggtggtatcgtagggactaagtacttacactcctacactagtacacgacacgccgtacgcacgtaccgtagtaagtacttactacgtacgtaaaccttaactttaactttacgttaactaaacttaaacgtttaaacgttaacttacccttccttaccgttccgttcgggtaacgggtaacgggaacggtaacgggttaggtaacgtaacgttaacgttaaacgttaacgtaaggtacggtcgtcgacttacctaacgttcgtcg

SEQ ID NO: 309141 - DNA, 503 bp, Homo sapiens
  misc_feature: GZ8MTXP01EWU21.25.86.H09.1.454.CMB.2.raw
  modified_base (275)..(275): a, c, t, g, unknown or other
  misc_feature (275)..(275): n is a, c, g, or t
  modified_base (336)..(336): a, c, t, g, unknown or other
  misc_feature (336)..(336): n is a, c, g, or t
  modified_base (497)..(497): a, c, t, g, unknown or other
  misc_feature (497)..(497): n is a, c, g, or t
  modified_base (503)..(503): a, c, t, g, unknown or other
  misc_feature (503)..(503): n is a, c, g, or t
tcagactgtacagtcacgaccggtgctcgatttagtgctatagacttgggtttgggggagtcagacccactcaggacacagcatggacatgagggtccccgctcagctcctggggcttctgctgctctggctcccaggtgccaaatgtgccatccagttgacccagtctccatcctccctgtctgcctctgttcgagacatagtcaccatcacttgtcgggctagtcgggtcattggcagtgctttagcctggtatcagcagaaaccaggggaanctctaagctctgatctttgatgcctcagtttggaaagtgagtcccatcaaggttcagcggnagtggatcgtgggacagatttcatcctcaccatcagcagcctgcagcctgaacattctgacctaaccttattattgtacaaactaatttaaggactttaccctctctccgttcggcggtagggaccaagggttgaagattacgaaagactgtgctgcactnttcgtn

SEQ ID NO: 309142 - DNA, 568 bp, Homo sapiens
  misc_feature: GZ8MTXP01CLDHY.25.86.H09.1.454.CMB.2.raw
  modified_base (277)..(277): a, c, t, g, unknown or other
  misc_feature (277)..(277): n is a, c, g, or t
  modified_base (348)..(348): a, c, t, g, unknown or other
  misc_feature (348)..(348): n is a, c, g, or t
  modified_base (384)..(384): a, c, t, g, unknown or other
  misc_feature (384)..(384): n is a, c, g, or t
tcagactgtacagtcacgaccggtgctcgatttagtgctatagacttgggtttgggggagtcagacccactcaggacacagcatggacatgagggtccccgctcagctcctggggcttctgctgctctggctcccaggtgccaaatgtgccatccagttgacccagtctccatcctccctgtctgcctctgttcgagacatagtcaccatcacttgtcgggctagtcgggtcattggcagtgctttagcctggtatcagcagaaaccgaggggaacnctactaagctctgtattcttgatcgtcctacgtaggtttaggaagtggactccatcgtaacggtcaggcgnagtggatcgtagggactagtacttcactcctacacntcacgcacgctcgcacgactagagtatactactacgtaacttaactttattacgtactaaactaaagttaacgttaacttaccttcctccgtccgtcggtaacgggaacgggacggtaacggttaggtaagtaacgttaacgaacgttaacgtaaggtacggtcgtcgacactaacgttcgtcg

SEQ ID NO: 309143 - DNA, 442 bp, Homo sapiens
  misc_feature: GZ8MTXP01C5REI.25.86.H09.1.454.CMB.2.raw
  modified_base (434)..(434): a, c, t, g, unknown or other
  misc_feature (434)..(434): n is a, c, g, or t
  modified_base (436)..(436): a, c, t, g, unknown or other
  misc_feature (436)..(436): n is a, c, g, or t
  modified_base (438)..(442): a, c, t, g, unknown or other
  misc_feature (438)..(442): n is a, c, g, or t
tcagactgtacagtcacgaccggtgctcgatttagtgctatagacttgggtttgggagaagaacctactatgcagactctgtgaagggtcgattcaccacctccagagacaacatcaagaactccctgtatctgcaaatggacagtctgacacctgatgacaccgccttgtattattgtgtgaaaggcggtgttgaggtgaatgcctggaacccccgcggtcagcactacttctacagtgggcgtcgtgggggcaaaaggggactacggtcatcgtctcctcacgcctccaaccaaacgggccccatccggtccttcccccctggccgcccctgcctccaggacgccacctccgagagcacacgccggcctggggcctgccctggtcaaggcctacttccactgtacagtctgaggcgggctggacaaggcganangnnnnn

SEQ ID NO: 309144 - DNA, 530 bp, Homo sapiens
  misc_feature: GZ8MTXP01EQI72.25.86.H09.1.454.CMB.2.raw
  modified_base (280)..(280): a, c, t, g, unknown or other
  misc_feature (280)..(280): n is a, c, g, or t
  modified_base (364)..(364): a, c, t, g, unknown or other
  misc_feature (364)..(364): n is a, c, g, or t
  modified_base (498)..(498): a, c, t, g, unknown or other
  misc_feature (498)..(498): n is a, c, g, or t
tcagactgtacagtcacgaccggtgctcgatttagtgctatagacttgggtttgggggcaggagtcagacccactcaggacacagcatggacatgagggtccccgctcagctcctggggcttctgctgctctggctcccaggtgccaaatgtgccatccagttgacccagtctccatcctccctgtctgcctctgttcgagacatagtcaccatcacttgtcgggctagtcgggtcattggcagtgctttagcctggatcagcaagaaaccgaggggaanctactaagctcctgatctttgatgcctcgtagtttggaaagtggagtccatcaaggtcagcggacagtggatcgtgggacagtnttcactcctcaccatcagcacgcctgcagcctagaatcttctacgtactaacctatttatactactaaactaaatttacgaactttaccctcgttcttccgttcggagggacgggttaaccgagggtgaagttnttacaaacgatggtacggcttgcttaacgtaa

SEQ ID NO: 309145 - DNA, 516 bp, Homo sapiens
  misc_feature: GZ8MTXP01DCN16.25.86.H09.1.454.CMB.2.raw
  modified_base (277)..(277): a, c, t, g, unknown or other
  misc_feature (277)..(277): n is a, c, g, or t
  modified_base (334)..(334): a, c, t, g, unknown or other
  misc_feature (334)..(334): n is a, c, g, or t
  modified_base (360)..(360): a, c, t, g, unknown or other
  misc_feature (360)..(360): n is a, c, g, or t
  modified_base (376)..(376): a, c, t, g, unknown or other
  misc_feature (376)..(376): n is a, c, g, or t
tcagactgtacagtcacgaccggtgctcgatttagtgctatagacttgggtttggggcaggagtcagacccactcaggacacagcatggacatgagggtccccgctcagctcctggggcttctgctgctctggctcccaggtgccaaatgtgccatccagttgacccagtctccatcctccctgtctgcctctgttcgagacatagtcaccatcacttgtcgggctagtcgggtcattggcagtgctttagcctggatcagcagaaaccaggggaanctcctaagctcctgatcttgatgcctcagtttgaaatgatccatcaggttcagcggnagtggatctgggacagattcatcctnaccatcagcagcccgnagcctgaagattctgggctaaaccttattattgtacaaactaattttaaacggatttaacccctcttccttcccgtttcgggcggttaggggacccaaagggtggaagattcaaacgaactgtggctgcaaccgaattcc

SEQ ID NO: 309146 - DNA, 429 bp, Homo sapiens
  misc_feature: GZ8MTXP01AOL7O.25.86.H09.1.454.CMB.2.raw
  modified_base (218)..(218): a, c, t, g, unknown or other
  misc_feature (218)..(218): n is a, c, g, or t
  modified_base (275)..(275): a, c, t, g, unknown or other
  misc_feature (275)..(275): n is a, c, g, or t
  modified_base (394)..(394): a, c, t, g, unknown or other
  misc_feature (394)..(394): n is a, c, g, or t
  modified_base (422)..(429): a, c, t, g, unknown or other
  misc_feature (422)..(429): n is a, c, g, or t
tcagactgtacagtcacgaccggtgctcgatttagtgctatagacttgggtttgggagaagaacctactatgcagactctgtgaagggtcgattcaccacctccagagacaacatcaagaactccctgtatctgcaaatggacagtctgacacctgatgacaccgccttgtattattgtgtgaaaggcggtgttgaggtgaatgcctggaacccccgnggtcagcactacttctacatgggcgtcgtgggggcaaaggggctacggtcatcgtcncctcagcctccaccaagggccccatccggtccttccccctggccgccctgctccaggacgccacctccgagagcacacgccggcctgggctgccctggtcaaggctacttccatgtacngtctgagcgggctggcaaggcgcatagnnnnnnnn

SEQ ID NO: 309147 - DNA, 497 bp, Homo sapiens
  misc_feature: GZ8MTXP01DQBSO.25.86.H09.1.454.CMB.2.raw
  modified_base (393)..(393): a, c, t, g, unknown or other
  misc_feature (393)..(393): n is a, c, g, or t
  modified_base (398)..(398): a, c, t, g, unknown or other
  misc_feature (398)..(398): n is a, c, g, or t
  modified_base (472)..(472): a, c, t, g, unknown or other
  misc_feature (472)..(472): n is a, c, g, or t
  modified_base (490)..(490): a, c, t, g, unknown or other
  misc_feature (490)..(490): n is a, c, g, or t
  modified_base (492)..(492): a, c, t, g, unknown or other
  misc_feature (492)..(492): n is a, c, g, or t
tcagactgtacagtcacgaccggtgctcgatttagtgctatagacttgggtttgggggcaggagtcagacccactcaggacacagcatggacatgagggtccccgctcagctcctggggcttctgctgctctggctcccaggtgccaaatgtgccatccagttgacccagtctccatcctccctgtctgcctctgttcgagacatagtcaccatcacttgtcgggctagtcgggtcattggcagtgctttagcctggtatcagcaagaaccaggggaagctcctaaagctcctgatctttgatgcctcagtttggaaatgagtccatcaaggttcagcggcagtggatctgggacagatttcatcctcaccatcagcagcctgcagcctgaanattcngctaaacctattatgtacaaactaaatttagattaccctctctaaccttcggcggagggttaccaaggtggagnttacaaacgatgtgcttncnctaac

SEQ ID NO: 309148 - DNA, 424 bp, Homo sapiens
  misc_feature: GZ8MTXP01BM75M.25.86.H09.1.454.CMB.2.raw
  modified_base (412)..(412): a, c, t, g, unknown or other
  misc_feature (412)..(412): n is a, c, g, or t
  modified_base (414)..(414): a, c, t, g, unknown or other
  misc_feature (414)..(414): n is a, c, g, or t
  modified_base (417)..(424): a, c, t, g, unknown or other
  misc_feature (417)..(424): n is a, c, g, or t
tcagactgtacagtcacgaccggtgctcgatttagtgctatagacttgggtttgggagaagaacctactatgcagactctgtgaagggtcgattcaccacctccagagacaacatcaagaactccctgtatctgcaaatggacagtctgacacctgatgacaccgccttgtattattgtgtgaaaggcggtgttgaggtgaatgcctggaacccccgcggtcagcactacttctacatgggcgtctgggggcaaaggggctacggtcatcgtctcctcagcctccaccaagggcccatcggtctccccctggcgccctgctccaggagcacctccgagagcacacgcggcctgggctgccctggtcaagggactacttccactgtacagtctgagcgggctggcaaggccgnanagnnnnnnnn

SEQ ID NO: 309149 - DNA, 518 bp, Homo sapiens
  misc_feature: GZ8MTXP01AZODK.25.86.H09.1.454.CMB.2.raw
  modified_base (275)..(275): a, c, t, g, unknown or other
  misc_feature (275)..(275): n is a, c, g, or t
  modified_base (445)..(445): a, c, t, g, unknown or other
  misc_feature (445)..(445): n is a, c, g, or t
tcagactgtacagtcacgaccggtgctcgatttagtgctatagacttgggtttgggggagtcagacccactcaggacacagcatggacatgagggtccccgctcagctcctggggcttctgctgctctggctcccaggtgccaaatgtgccatccagttgacccagtctccatcctccctgtctgcctctgttcgagacatagtcaccatcacttgtcgggctagtcgggtcattggcagtgctttagcctggtatcagcagaaaccaggggaanctctaagctcctgatcttgatgcctcagtttgaagtgatccatcaacggtcagcggcagtggatcgtgggacagtactttcatcctacaccatcagcagcctgcagcctagaatcttcgagctaaacttattacttcgtaactaaacgtaatttaacggactttaccctntccttccgttcgggaacggtagggacctaagggttgaagtattacgaaacgacgtgagctgcactgttcgtcg

SEQ ID NO: 309150 - DNA, 585 bp, Homo sapiens
  misc_feature: GZ8MTXP01DCBAX.25.86.H09.1.454.CMB.2.raw
  modified_base (281)..(281): a, c, t, g, unknown or other
  misc_feature (281)..(281): n is a, c, g, or t
  modified_base (413)..(413): a, c, t, g, unknown or other
  misc_feature (413)..(413): n is a, c, g, or t
tcagactgtacagtcacgaccggtgctcgatttagtgctatagacttgggtttgggggcaggagtcagacccactcaggacacagcatggacatgagggtccccgctcagctcctggggcttctgctgctctggctcccaggtgccaaatgtgccatccagttgacccagtctccatcctccctgtctgcctctgttcgagacatagtcaccatcacttgtcgggctagtcgggtcattggcagtgctttagcctggtatcagcaagaaaccgaggggaanctcctaagctctgatctttgatgcctcaggtttaggaaagtggacgtcccatcgaaggttcagcggcagtggatcgtggggactagtatttcactcctcaccatcagcagcctgcagcctagagtattcgtntactaaccttattattgtacctaaattaaatttaacggtacctttacccctcttcccgttccgttcggggacgggtaaacggggaacccgtaaagggggttgggaagttacttaaccgaaaacggtaaccgttgggttaacgggccttacggaacccgttaacccgttaacg

SEQ ID NO: 309151 - DNA, 522 bp, Homo sapiens
  misc_feature: GZ8MTXP01ELLWC.25.86.H09.1.454.CMB.2.raw
  modified_base (275)..(275): a, c, t, g, unknown or other
  misc_feature (275)..(275): n is a, c, g, or t
  modified_base (396)..(396): a, c, t, g, unknown or other
  misc_feature (396)..(396): n is a, c, g, or t
tcagactgtacagtcacgaccggtgctcgatttagtgctatagacttgggtttgggggagtcagacccactcaggacacagcatggacatgagggtccccgctcagctcctggggcttctgctgctctggctcccaggtgccaaatgtgccatccagttgacccagtctccatcctccctgtctgcctctgttcgagacatagtcaccatcacttgtcgggctagtcgggtcattggcagtgctttagcctggtatcagcagaaaccaggggaanctccaagctctgatctttgatgcctcagtttggaagtgatccatcaagttcagcggcagtgatcgtgggacagtatttcatcctcaccatcagcagccctagccagcctagaacgtattcngactaaaccttatttactgtacaaactaatttaaggactttaccctctctccgttcgggaacggtagggaccaaaggggttgaagtaattaccgaaacgactggtagctgacactaacgttcgtcg

SEQ ID NO: 309152 - DNA, 456 bp, Homo sapiens
  misc_feature: GZ8MTXP01DGR6V.25.86.H09.1.454.CMB.2.raw
  modified_base (218)..(218): a, c, t, g, unknown or other
  misc_feature (218)..(218): n is a, c, g, or t
  modified_base (435)..(435): a, c, t, g, unknown or other
  misc_feature (435)..(435): n is a, c, g, or t
  modified_base (447)..(447): a, c, t, g, unknown or other
  misc_feature (447)..(447): n is a, c, g, or t
  modified_base (449)..(449): a, c, t, g, unknown or other
  misc_feature (449)..(449): n is a, c, g, or t
  modified_base (452)..(456): a, c, t, g, unknown or other
  misc_feature (452)..(456): n is a, c, g, or t
tcagactgtacagtcacgaccggtgctcgatttagtgctatagacttgggtttgggagaagaacctactatgcagactctgtgaagggtcgattcaccacctccagagacaacatcaagaactccctgtatctgcaaatggacagtctgacacctgatgacaccgccttgtattattgtgtgaaaggcggtgttgaggtgaatgcctggaacccccgnggtcagcactacttctacagtgggcgtcgtgggggacaaaggggactacggtcatcgtctcctcacgccctccaccgaaacgggccccagttccggtcccttcccccccgtggcccgcccctggcctccgaggacgcccacccgtccgagacgcacgacggccggcctggggcctgccctggtcaaaggctacttccactgtacagtctgagcgggntggcaaggcgananagnnnnn

SEQ ID NO: 309153 - DNA, 729 bp, Homo sapiens
  misc_feature: GZ8MTXP01ETK9S.25.86.H09.1.454.CMB.2.raw
tcagactgtacagtcacgaccggtgctcgatttagtgctatagacttgggtttggggagctctgggaaaggagccccagccctgagattcccaggtgattccattcggtgatcagcactgaacacagaactcaccatggagtttggactgagctgggtttccttgttgcctattttaaaggtgtccagtgtgaagtgcaactggtggagtcgtgggggagccgtggtacaggccgggggggtcctgagactctcctgtgtagcctctggattcattgtttgatgattatgccatgcacgtggggtccgtacgaaggggtccgggggaaggttcgtaggggtaggttggggtccttcgttctttaagtggtaacgtttgggggaattacgggggaaagtaaaacgtaaacccttaagtaagtcgaccgtaaggtaccttcgtagggtagggtaaaacgggggttccaaactttaccccaaccctaacccctaccgaaagggaacgaaaccaaactaaacttaccaaaacgtaacccttaccccttagtaactacgtaaggaacctaaaagttcgggaaacctacgtacctcgaaccctaccgtaggacttacgacctacccggtctttaaggttaatttgttcggttagtaagggtaaagggttgggtttgttagggaacgggttagtaacgttcggacccgttacccggggaacccccgttgggtaacc

SEQ ID NO: 309154 - DNA, 436 bp, Homo sapiens
  misc_feature: GZ8MTXP01AFCJD.25.86.H09.1.454.CMB.2.raw
  modified_base (218)..(218): a, c, t, g, unknown or other
  misc_feature (218)..(218): n is a, c, g, or t
  modified_base (275)..(275): a, c, t, g, unknown or other
  misc_feature (275)..(275): n is a, c, g, or t
  modified_base (428)..(428): a, c, t, g, unknown or other
  misc_feature (428)..(428): n is a, c, g, or t
  modified_base (431)..(436): a, c, t, g, unknown or other
  misc_feature (431)..(436): n is a, c, g, or t
tcagactgtacagtcacgaccggtgctcgatttagtgctatagacttgggtttgggagaagaacctactatgcagactctgtgaagggtcgattcaccacctccagagacaacatcaagaactccctgtatctgcaaatggacagtctgacacctgatgacaccgccttgtattattgtgtgaaaggcggtgttgaggtgaatgcctggaacccccgnggtcagcactacttctacatgggcgtctgggggcaaaggggactacggtcatcgtcncctcagcctccaccaagggccccatccggtccttccccctggcccgccctgctccaggagccacctccgagacgcacacggccggcctggggcctgcccgtggtcaaagggacctacttccactgacagtctgagcgggctggcaaggcgcanagnnnnnn

SEQ ID NO: 309155 - DNA, 425 bp, Homo sapiens
  misc_feature: GZ8MTXP01ARFP7.25.86.H09.1.454.CMB.2.raw
  modified_base (419)..(425): a, c, t, g, unknown or other
  misc_feature (419)..(425): n is a, c, g, or t
tcagactgtacagtcacgaccggtgctcgatttagtgctatagacttgggtttgggagaagaacctactatgcagactctgtgaagggtcgattcaccacctccagagacaacatcaagaactccctgtatctgcaaatggacagtctgacacctgatgacaccgccttgtattattgtgtgaaaggcggtgttgaggtgaatgcctggaacccccgcggtcagcactacttctacatgggcgtctgggggcaaaggggctacggtcatcgtctcctcagcctccaccaaagggcccatcggtcttccccctggccgccctgctccaggacgcacctccgagagcacacgcggcctgggctgccctggtcaaggactacttccactgtacagtctgagcgggctggcaaggcgcatagnnnnnnn

SEQ ID NO: 309156 - DNA, 522 bp, Homo sapiens
  misc_feature: GZ8MTXP01D58RG.25.86.H09.1.454.CMB.2.raw
  modified_base (273)..(273): a, c, t, g, unknown or other
  misc_feature (273)..(273): n is a, c, g, or t
  modified_base (329)..(329): a, c, t, g, unknown or other
  misc_feature (329)..(329): n is a, c, g, or t
  modified_base (338)..(338): a, c, t, g, unknown or other
  misc_feature (338)..(338): n is a, c, g, or t
tcagactgtacagtcacgaccggtgctcgatttagtgctatagacttgggtttgggggagtcagacccactcaggacacagcatggacatgagggtccccgctcagctcctggggcttctgctgctctggctcccaggtgccaaatgtgccatccagttgacccagtctccatcctccctgtctgcctctgttcgagacatagtcaccatcacttgtcgggctagtcgggtcattggcagtgctttagctggtatcagcagaaaccagggaanctccaagctcctgatcttgatgcctcagtttggaagtgagtccatcaagtcagcgnagtgatcgngggacagtatttcatcctcaccatcagcagcctgcagcctagaatattctgactaaacttatttacttataacaaactaagtttaacgtaactttccctacttccgtccgttcgggaacgggaacgggaccaagggttgaagacttaacgaaacgttactggtaggctcgcaccttcgttcgtg

SEQ ID NO: 309157 - DNA, 566 bp, Homo sapiens
  misc_feature: GZ8MTXP01AZKPH.25.86.H09.1.454.CMB.2.raw
  modified_base (287)..(287): a, c, t, g, unknown or other
  misc_feature (287)..(287): n is a, c, g, or t
  modified_base (421)..(421): a, c, t, g, unknown or other
  misc_feature (421)..(421): n is a, c, g, or t
  modified_base (556)..(556): a, c, t, g, unknown or other
  misc_feature (556)..(556): n is a, c, g, or t
tcagactgtacagtcacgaccggtgctcgatttagtgctatagacttgggtttgggggcaggagtcagacccactcaggacacagcatggacatgagggtccccgctcagctcctggggcttctgctgctctggctcccaggtgccaaatgtgccatccagttgacccagtctccatcctccctgtctgcctctgttcgagacatagtcaccatcacttggtcgggctaggtcgggtcagttggcagtgtctttagcctggtatcagacaagaaaccgaggggaacnctaccaagctcctgattcttgatcgcctcgtaggtttaggaaagtggacgtccatcgaaggtcagcgcagtgatcgtgggacagtacttcactcctcaccatcagcacgcctgcacgcctaggaatcttcgganacctaaacttatttatcgtaactaaacttaaagtttaacggtacctttaacccctcttcccgttaacccggttcggggacgggtaacggaccgtaagggtgaagttcttaaccgaaacgacgttggacgcgttcnccaacgttcg

SEQ ID NO: 309158 - DNA, 430 bp, Homo sapiens
  misc_feature: GZ8MTXP01DG1J9.25.86.H09.1.454.CMB.2.raw
  modified_base (218)..(218): a, c, t, g, unknown or other
  misc_feature (218)..(218): n is a, c, g, or t
  modified_base (422)..(422): a, c, t, g, unknown or other
  misc_feature (422)..(422): n is a, c, g, or t
  modified_base (425)..(430): a, c, t, g, unknown or other
  misc_feature (425)..(430): n is a, c, g, or t
tcagactgtacagtcacgaccggtgctcgatttagtgctatagacttgggtttgggagaagaacctactatgcagactctgtgaagggtcgattcaccacctccagagacaacatcaagaactccctgtatctgcaaatggacagtctgacacctgatgacaccgccttgtattattgtgtgaaaggcggtgttgaggtgaatgcctggaacccccgnggtcagcactacttctacatgggcgtctgggggcaaaggggactacggtcatcgtctcctcagcctccaccaagggccccatccggtccttccccctggccgccctgctccgaggcgccacctccgagagcacacgccggcctgggctgaccctggtcaaaggctacttccactgtacagtctgagcgggctggcaaggcgcanagnnnnnn

SEQ ID NO: 309159 - DNA, 531 bp, Homo sapiens
  misc_feature: GZ8MTXP01EFLWS.25.86.H09.1.454.CMB.2.raw
  modified_base (404)..(404): a, c, t, g, unknown or other
  misc_feature (404)..(404): n is a, c, g, or t
  modified_base (503)..(503): a, c, t, g, unknown or other
  misc_feature (503)..(503): n is a, c, g, or t
  modified_base (526)..(526): a, c, t, g, unknown or other
  misc_feature (526)..(526): n is a, c, g, or t
tcagactgtacagtcacgaccggtgctcgatttagtgctatagacttgggtttgggggcaggagtcagacccactcaggacacagcatggacatgagggtccccgctcagctcctggggcttctgctgctctggctcccaggtgccaaatgtgccatccagttgacccagtctccatcctccctgtctgcctctgttcgagacatagtcaccatcacttgtcgggctagtcgggtcattggcagtgctttagcctggatcagcaagaaaccaggggaagctcctaaagctcctgatctttgatgccctctagtttggaaagtggatccatcaaggttcagcggacagtggatcgtagggactagtatttcatcctcaccatcagcagcctgccagcctgaaatnttctagactaaaccttattacttgtactaaactaaattttaacggactttacccctctctaaccgttcgggacgggacgggaccgaaagggtgaagttnttacaaacggatggtggcttgcnctaag

SEQ ID NO: 309160 - DNA, 605 bp, Homo sapiens
  misc_feature: GZ8MTXP01CQ8B9.25.86.H09.1.454.CMB.2.raw
  modified_base (276)..(276): a, c, t, g, unknown or other
  misc_feature (276)..(276): n is a, c, g, or t
  modified_base (341)..(341): a, c, t, g, unknown or other
  misc_feature (341)..(341): n is a, c, g, or t
tcagactgtacagtcacgaccggtgctcgatttagtgctatagacttgggtttgggggagtcagacccactcaggacacagcatggacatgagggtccccgctcagctcctggggcttctgctgctctggctcccaggtgccaaatgtgccatccagttgacccagtctccatcctcctgtctgcctctgttcgagacatagtcaccatcacttgtcgggctagtcgggtcattggcagtgctttagcctggtatcagcaagaaaccaggggaacnctactagctctgatcttgatcgcctcgtagtttaggaagtgacgtccatacgtaacgtcaggcgnaggtgatcgtagggactagtacttacactcctacactagtacgcacgtcctgacgtacgtaccgtagaactacttcgtacgtaaccttaaacgtttatttaacgttacgtaactaaaacgttaaacgtttaaacgtacctttaccccttcttacccgttaccggttaccggggacgggaacggggtaaccgttaagggtacggaagtaacgtaacgaaacggttacgttcggtcgactcgacctaccgttacttcgttcgttcc

SEQ ID NO: 309161 - DNA, 592 bp, Homo sapiens
  misc_feature: GZ8MTXP01DJ0YF.25.86.H09.1.454.CMB.2.raw
  modified_base (414)..(414): a, c, t, g, unknown or other
  misc_feature (414)..(414): n is a, c, g, or t
tcagactgtacagtcacgaccggtgctcgatttagtgctatagacttgggtttgggggcaggagtcagacccactcaggacacagcatggacatgagggtccccgctcagctcctggggcttctgctgctctggctcccaggtgccaaatgtgccatccagttgacccagtctccatcctccctgtctgcctctgttcgagacatagtcaccatcacttgtcgggctaggtcgggtcagttggcagtgctttagcctggtatcagcaagaaaccgaggggaagctacctaaagctcctgattctttgatcgcctcgagtttggaaagtggacgtcccatcaaggttcagcggacaggtggatcgtgggacagtatttcactcctcaccatcagcacgcctgcagcctagaagtntttcgtagtacctaaaccttattacttagtactaaaccttaaatttaacggtactttaacccctcttcccgttccgtttcgggacgggtaacgggacccgtaaaggggttggaacggttacttaaccgtaaaaaccgtaagttcgggttgggaccttaggaacccttaacgttaaccg

SEQ ID NO: 309162 - DNA, 511 bp, Homo sapiens
  misc_feature: GZ8MTXP01B023C.25.86.H09.1.454.CMB.2.raw
  modified_base (278)..(278): a, c, t, g, unknown or other
  misc_feature (278)..(278): n is a, c, g, or t
  modified_base (350)..(350): a, c, t, g, unknown or other
  misc_feature (350)..(350): n is a, c, g, or t
tcagactgtacagtcacgaccggtgctcgatttagtgctatagacttgggtttgggggcaggagtcagacccactcaggacacagcatggacatgagggtccccgctcagctcctggggcttctgctgctctggctcccaggtgccaaatgtgccatccagttgacccagtctccatcctccctgtctgcctctgttcgagacatagtcaccatcacttgtcgggctagtcgggtcattggcagtgctttagcctggatcagcagaaaccaggggaanctctaagctcctgatctttgatgcctcagtttggaaagtggagtccatcaaggttcagcggcagtggatcgngggacagatttcactcctcaccgatcagcagcctgcagcctagaagtattctgtactaaaccttattattgtacaaactaatttaagacttaccctctctccgttcggcgggaggaccgaaggtgagattacaaacggactggtggcttagcgaaccgtaa

SEQ ID NO: 309163 - DNA, 589 bp, Homo sapiens
  misc_feature: GZ8MTXP01CEOGP.25.86.H09.1.454.CMB.2.raw
  modified_base (276)..(276): a, c, t, g, unknown or other
  misc_feature (276)..(276): n is a, c, g, or t
  modified_base (339)..(339): a, c, t, g, unknown or other
  misc_feature (339)..(339): n is a, c, g, or t
tcagactgtacagtcacgaccggtgctcgatttagtgctatagacttgggtttgggggagtcagacccactcaggacacagcatggacatgagggtccccgctcagctcctggggcttctgctgctctggctcccaggtgccaaatgtgccatccagttgacccagtctccatcctcctgtctgcctctgttcgagacatagtcaccatcacttgtcgggctagtcgggtcattggcagtgcttagcctggtatcagcaagaaaccgaggggaacnctacctaagctcctgatcttgatgcctctagtttggaagtggacgtccatcaacggtcagcgnagtgatcgtgggacagtattcactcctacaccatcagcagcctgcaggtcctagaagtacttcgtacgtactaaactttatttaacttacgttaactaaaacttaaacgtttaaacggtaacctttaccctcttaccgttcccggttccggggaaccgggtaacggggaacctaaaggggttacggtaaagtaacgttaacgaaaacggttaacgtggtacggtctcggaccttacctaacttcgtttcg

SEQ ID NO: 309164 - DNA, 442 bp, Homo sapiens
  misc_feature: GZ8MTXP01EBM73.25.86.H09.1.454.CMB.2.raw
  modified_base (427)..(427): a, c, t, g, unknown or other
  misc_feature (427)..(427): n is a, c, g, or t
  modified_base (434)..(442): a, c, t, g, unknown or other
  misc_feature (434)..(442): n is a, c, g, or t
tcagactgtacagtcacgaccggtgctcgatttagtgctatagacttgggtttgggagaagaacctactatgcagactctgtgaagggtcgattcaccacctccagagacaacatcaagaactccctgtatctgcaaatggacagtctgacacctgatgacaccgccttgtattattgtgtgaaaggcggtgttgaggtgaatgcctggaacccccgcggtcagcactacttctacatgggcgtcgtgggggcaaaggggctacggtcatcgtctcctcacgcctccaccgaacgggccccagtccggtccttccccccgtggccgcccctgctcccaggacgcacctccgagagcacacgcggcctgggctgccctggtcaaggacctacttccactgtacagtctgagcgggctgggcaagggcncagtagnnnnnnnnn

SEQ ID NO: 309165 - DNA, 578 bp, Homo sapiens
  misc_feature: GZ8MTXP01EN0UJ.25.86.H09.1.454.CMB.2.raw
tcagactgtacagtcacgaccggtgctcgatttagtgctatagacttgggtttgggggcaggagtcagacccactcaggacacagcatggacatgagggtccccgctcagctcctggggcttctgctgctctggctcccaggtgccaaatgtgccatccagttgacccagtctccatccctccctgtctgcctctgttcgagacatagtcaccatcacttgtcgggctagtcgggtcattggcagtgctttagcctggtatcagcaagaaaccgaggggaagctcctaagctcctgatctttgatgccctcgtagtttggaaagtggacgtccatcaaggttcagcggcagtggatcgtgggacagtattcactcctcaccatcagcagcctgcagcctagaagtattcggtcactaaccttatttatcgtaacctaaataaacttttaacggacctttacccttcttccgtcccgtttcggggaccggggtaacgggaccgtaaaggggtcggaagttacgttaccgaaaacggtaccgttgggttacggcgttcggaacccgttaacccgttaacg

SEQ ID NO: 309166 - DNA, 559 bp, Homo sapiens
  misc_feature: GZ8MTXP01ET3US.25.86.H09.1.454.CMB.2.raw
  modified_base (252)..(252): a, c, t, g, unknown or other
  misc_feature (252)..(252): n is a, c, g, or t
  modified_base (277)..(277): a, c, t, g, unknown or other
  misc_feature (277)..(277): n is a, c, g, or t
  modified_base (346)..(346): a, c, t, g, unknown or other
  misc_feature (346)..(346): n is a, c, g, or t
  modified_base (524)..(525): a, c, t, g, unknown or other
  misc_feature (524)..(525): n is a, c, g, or t
  modified_base (527)..(559): a, c, t, g, unknown or other
  misc_feature (527)..(559): n is a, c, g, or t
tcagactgtacagtcacgaccggtgctcgatttagtgctatagacttgggtttgggagaagaacctactatgcagactctgtgaagggtcgattcaccacctccagagacaacatcaagaactccctgtatctgcaaatggacagtctgacacctgatgacaccgccttgtattattgtgtgaaaggcggtgttgaggtgaatgcctggaaccccgcggtcagcactacttctacatgggcgtcgtgggggntaaaggggctacggtcaatccgtcncctcagccctcacccaaagggccccagtcccggcttcccccgtggcccgcccctgcccttccgaggacnccaacccgtccgaagacgccgaacgccggacggccgggtcccggtccggtacccgttccggtccgtaccgggtaaccgtaaaccggtaccgtaaccgttaccgtaaccgtacgtacgtacgtacggtacgggtacggtcgggaccggtacgggacggaacggaacgacgtacgtaganngnnnnnnnnnnnnnnnnnnnnnnnnnnnnnnnnn

SEQ ID NO: 309167 - DNA, 590 bp, Homo sapiens
  misc_feature: GZ8MTXP01DUJC4.25.86.H09.1.454.CMB.2.raw
  modified_base (358)..(358): a, c, t, g, unknown or other
  misc_feature (358)..(358): n is a, c, g, or t
tcagactgtacagtcacgaccggtgctcgatttagtgctatagacttgggtttgggggagtcagacccactcaggacacagcatggacatgagggtccccgctcagctcctggggcttctgctgctctggctcccaggtgccaaatgtgccatccagttgacccagtctccatcctccctgtctgcctctgttcgagacatagtcaccatcacttgtcgggctagtcgggtcattggcagtgctttagcctggtatcagcagaaaccaggggaagctacctaagctcctgattcttgatgcctcagtttggaaagtgacgtccatcaaggttcagcggcagtggatcgtgggacagtnttcatcctcacatcagcagccctagctaagcctagaacgtattctacgactaaacccttatttaacgttgtaacctaaacgttaaattttaaacgggaaacttttcccctactttccgtcccgtttccggggaacgggtaacgggaccgtaaagggttggaaacggtaacttaccgaaaacggttaaccgtgggtacgggtcttcggaccttacccgtaagttcgtttccgg

SEQ ID NO: 309168 - DNA, 585 bp, Homo sapiens
  misc_feature: GZ8MTXP01DIYYM.25.86.H09.1.454.CMB.2.raw
  modified_base (284)..(284): a, c, t, g, unknown or other
  misc_feature (284)..(284): n is a, c, g, or t
  modified_base (396)..(396): a, c, t, g, unknown or other
  misc_feature (396)..(396): n is a, c, g, or t
  modified_base (408)..(408): a, c, t, g, unknown or other
  misc_feature (408)..(408): n is a, c, g, or t
tcagactgtacagtcacgaccggtgctcgatttagtgctatagacttgggtttgggggcaggagtcagacccactcaggacacagcatggacatgagggtccccgctcagctcctggggcttctgctgctctggctcccaggtgccaaatgtgccatccagttgacccagtctccatcctccctgtctgcctctgttcgagacatagtcaccatcacgttgtcgggctaggtcgggtcagttggcagtgctttagcctggtatcagcaagaaaccgaggggaanctacctaagctcctgattctttgatcgtccttcgtaggtttaggaaagtggacgtcccaatcgaagttcaggcgacagtggatcgtgggactgtacttcactcctacaccancgagcacgtccngacacgtcgtaagactacttcgtactaaccttaacttagttacttacgtaactaaacgttaaagtttaacgtaccttaccctctccgttccggtacgggacgggtaaacgggacgtaaagggtacgaagttacgttaaacgaaacgtacggttggtcgcgttacgtccgttaacgtc

SEQ ID NO: 309169 - DNA, 795 bp, Homo sapiens
  misc_feature: GZ8MTXP01ARY19.25.86.H09.1.454.CMB.2.raw
tcagactgtacagtcacgaccggtgctcgatttagtgctatagacttgggtttgggggcaggagtcagacccactcaggacacagcatggacatgagggtccccgctcagctcctggggcttctgctgctctggctcccaggtgccaaatgtgccatccagttgacccagtctccatcctccctgtctgcctctgttcgagacatagtcacctatctacttggtcgggctaggtcgggtcagttggctagtcgtctttagcctggtatcgagcaaagaaaccggaggggaactcctaccgtaagcctccgtagtactttcgtttagacgttcgccccttacgttagggtttacgggaaaacgtcggggtaactacccccgtaagttaccggtaaaggggtttccgaacggggtccgggtaaccgtaagggttcgggtactttacggggttacgggggaaacccttaagggttacctttttaccgaaacccttcccttacccaaccgtaacttacccgaaacgtcccgaaaccggttcccgtaacggccgtaacggacccgttaaggtaaacgttctttaccggtacggtaaccttaaacctttaacgtttagtttaacgttaaaccgtaaaacctttaaaagttttaacggtaaccccttttacccttcccgttaaccgttccccgggttacggggacggggttaaaccgggaaccggtaaagggtacggaacgttaacgttaaacccgaaacgtaccggtggtcggttacgttaccgaaccgttaacgttaacg

SEQ ID NO: 309170 - DNA, 689 bp, Homo sapiens
  misc_feature: GZ8MTXP01BTRUB.25.86.H09.1.454.CMB.2.raw
  modified_base (281)..(281): a, c, t, g, unknown or other
  misc_feature (281)..(281): n is a, c, g, or t
  modified_base (370)..(370): a, c, t, g, unknown or other
  misc_feature (370)..(370): n is a, c, g, or t
tcagactgtacagtcacgaccggtgctcgatttagtgctatagacttgggtttgggggagtcagacccactcaggacacagcatggacatgagggtccccgctcagctcctggggcttctgctgctctggctcccaggtgccaaatgtgccatccagttgacccagtctccatcctccctgtctgcctctgttcgagacatagtcaccatcacttgtcgggctagtcgggtcagttggcagtgctttagcctggtatcagacaaggaaaccgaggggaacnctacctaagctcctgtattcgttgatcgtccttacgtagggttttaggaaagtcggtacgtacccgagtacgtaaaggttcaggccggntaggtaggatcggtagggaactagtactttcactcctacaccatcgacgcacgcccgtgcaagcccgtagaacgtatttcgtaacaccgttaaacttagtttacttacggttaaacctaaaaacctttaaagtttaaacggttaaaccctttacccttccgttaccccgtttcccggtttccggggaaccgggttaaacggggttaacccggaaagggttccgggaaaaggtaaccgttaaaccggaaaacccggttaaacgttgggttaaccggggccttaacgggtacccaaaccggttaactttcggtttaacccg

SEQ ID NO: 309171 - DNA, 568 bp, Homo sapiens
  misc_feature: GZ8MTXP01EM8FW.25.86.H09.1.454.CMB.2.raw
  modified_base (272)..(272): a, c, t, g, unknown or other
  misc_feature (272)..(272): n is a, c, g, or t
tcagactgtacagtcacgaccggtgctcgatttagtgctatagacttgggtttgggggagtcagacccactcaggacacagcatggacatgagggtccccgctcagctcctggggcttctgctgctctggctcccaggtgccaaatgtgccatccagttgacccagtctccatcctccctgtctgcctctgttcgagacatagtcaccatcacttgtcgggctagtcgggtcattggcagtgctttagcctggtatcagcagaaccaggganctctaagctcctgatcttgatgcctcagtttggaagtggatccatcgaacggttcagcggcaggtggatcgtgggaactagtatttcactcctcaccatcagcagcctagcaggcctagaacgtcttactgtacctaaacctttatttactttacgtaactaaacgttaaagttttaacggaccttttacccctcttacccgttccgttcggggaacgggtaacgggaaccgtaagggttacggaagtaacttacgaaacgttacgtggtcggctgaccttactaacgttcttccg

SEQ ID NO: 309172 - DNA, 645 bp, Homo sapiens
  misc_feature: GZ8MTXP01DZ1WS.25.86.H09.1.454.CMB.2.raw
  modified_base (283)..(283): a, c, t, g, unknown or other
  misc_feature (283)..(283): n is a, c, g, or t
tcagactgtacagtcacgaccggtgctcgatttagtgctatagacttgggtttgggggcaggagtcagacccactcaggacacagcatggacatgagggtccccgctcagctcctggggcttctgctgctctggctcccaggtgccaaatgtgccatccagttgacccagtctccatcctccctgtctgcctctgttcgagacatagtcaccatcacttgtcgggctagtcgggtcattggcagtgctttagcctggtatcagcaagaaaccgagggggaacnctactaagctctgtacttcttgatcgtcctacgtaggtttaggaagtcggtacgtcctatacgtaaggttcgaggcggaacgaggtggactcgtagggactagtacttcactcctacacatacacgacacgtcctgaccgacgtaccgtaagaacgttacttacgtacgtaaccttaaacctttatttaacgttacgtaaacttaaacgttaaacgtttaaacgtaacctttaaccccttcgttacccgttccgttacggggaccgggtaaacgggttaccgtaaaggggtacggttaaacgttaacttaaccgtaaaacggtacgtcgggtacgtacgttacgtaaccgttaaccgtaacg

SEQ ID NO: 309173 - DNA, 572 bp, Homo sapiens
  misc_feature: GZ8MTXP01AWJPC.25.86.H09.1.454.CMB.2.raw
  modified_base (286)..(286): a, c, t, g, unknown or other
  misc_feature (286)..(286): n is a, c, g, or t
  modified_base (488)..(488): a, c, t, g, unknown or other
  misc_feature (488)..(488): n is a, c, g, or t
tcagactgtacagtcacgaccggtgctcgatttagtgctatagacttgggtttgggggcaggagtcagacccactcaggacacagcatggacatgagggtccccgctcagctcctggggcttctgctgctctggctcccaggtgccaaatgtgccatccagttgacccagtctccatcctccctgtctgcctctgttcgagacatagtcaccatcacttggtcggctaggtcgggtctagttggcagtcgtctttagcctggtatcagcaagaaaccgaggggaanctactaagcctctgatcttgatcgccctcgtaggtttaggaaagtggacgtccatacgtaaggttcaggcggacaggtggatcgtagggactagtactttcactccctacgaccatcagcacgcctgcacgccgtagaagtcttcggactacctaaacttatttacttcaactaaacgttaaagtttacgtaccttaccctntaccgttccgttacgggcgggtaacggaccgtagggtaggattacgttaacgaaagtactggtacggcttgaaccttcgtaacg

SEQ ID NO: 309174 - DNA, 586 bp, Homo sapiens
  misc_feature: GZ8MTXP01DJKRH.25.86.H09.1.454.CMB.2.raw
  modified_base (259)..(259): a, c, t, g, unknown or other
  misc_feature (259)..(259): n is a, c, g, or t
  modified_base (282)..(282): a, c, t, g, unknown or other
  misc_feature (282)..(282): n is a, c, g, or t
  modified_base (403)..(403): a, c, t, g, unknown or other
  misc_feature (403)..(403): n is a, c, g, or t
tcagactgtacagtcacgaccggtgctcgatttagtgctatagacttggggtttgggggagtcagacccactcaggacacagcatggacatgagggtccccgctcagctcctggggcttctgctgctctggctccaggtgccaaatgtgccatccagttgacccagtctccatcctccctgtctgcctctgttcgagacatagtcacatctacttgtcgggctagtcgggtcagttggctagtgtctttagcctggtancagacaagaaaccgaggggaacnctacctaagctcctgtatctttgatcgcctacgtaggtttaggaaagtggactacctatcgtaaacggttcaggcggataggtaggatcgtgggaactagtactttcacttccacacctancgagcacgcgacgcgacgacgtagtagtatactacgtacgtaacttaattaattacgtaactaaacgttaaacgttaacgtaccttaccttcctccgtccggtacgggtaacgggaacgggaacggtaaggaggaacgaacgaacgaaacgacgtaagtcgtcgtcgacactaacgttcgtcg

SEQ ID NO: 309175 - DNA, 582 bp, Homo sapiens
  misc_feature: GZ8MTXP01A1QDZ.25.86.H09.1.454.CMB.2.raw
tcagactgtacagtcacgaccggtgctcgatttagtgctatagacttgggtttgggggcaggagtcagacccactcaggacacagcatggacatgagggtccccgctcagctcctggggcttctgctgctctggctcccaggtgccaaatgtgccatccagttgacccagtctccatcctccctgtctgcctctgttcgagacatagtcaccatcacttgtcgggctagtcgggtcattggcagtgtctttagcctggtatcagcaagaaaccgaggggaacgctacctaagccttcctgattctttgatcgccctcgtagtttaggaaagtggacgtccatcgaaggttcaggcggactagggtggtatcggtagggactagtatttcactccctacaccatcagcacgcctgacgacgtccgtaggaaagtcttctacgtaacctaaaccttattattacgtactaaacttaagtttaacggtactttacccctcttcctccgttcggggaccggtaggaccgtaagggtagggacttagttaccgaaagtactggtacggcttcgaacgttaaccgtaa

SEQ ID NO: 309176 - DNA, 570 bp, Homo sapiens
  misc_feature: GZ8MTXP01EZO58.25.86.H09.1.454.CMB.2.raw
  modified_base (286)..(286): a, c, t, g, unknown or other
  misc_feature (286)..(286): n is a, c, g, or t
  modified_base (372)..(372): a, c, t, g, unknown or other
  misc_feature (372)..(372): n is a, c, g, or t
  modified_base (426)..(426): a, c, t, g, unknown or other
  misc_feature (426)..(426): n is a, c, g, or t
  modified_base (553)..(553): a, c, t, g, unknown or other
  misc_feature (553)..(553): n is a, c, g, or t
tcagactgtacagtcacgaccggtgctcgatttagtgctatagacttgggtttgggggcaggagtcagacccactcaggacacagcatggacatgagggtccccgctcagctcctggggcttctgctgctctggctcccaggtgccaaatgtgccatccagttgacccagtctccatcctccctgtctgcctctgttcgagacatagtccaccatcacttgtcgggctaggtcgggtcagttgggctagtgtctttagcctggtatcagcaagaaaccgagggganctactaagcctctgatctttgatcgcctctaggttaggaagtgacgtccatcgaaggttcagcggacagtgatcgtagggacagtnttcactcctcaccatcgacgctacggccttgactacgcctaggaaagtcttcgngtacctaaaccttattattcgtaactaacttaaatttacgtactttaccctcttcccgtaacgttcgggacgggtacggttaaccgtaagggtacgggagttacaacgtaaaaccgtgtggttcggnttaccggccaaccgttg

SEQ ID NO: 309177 - DNA, 482 bp, Homo sapiens
  misc_feature: GZ8MTXP01AYRU2.25.86.H09.1.454.CMB.2.raw
  modified_base (276)..(276): a, c, t, g, unknown or other
  misc_feature (276)..(276): n is a, c, g, or t
  modified_base (391)..(391): a, c, t, g, unknown or other
  misc_feature (391)..(391): n is a, c, g, or t
  modified_base (394)..(394): a, c, t, g, unknown or other
  misc_feature (394)..(394): n is a, c, g, or t
  modified_base (451)..(451): a, c, t, g, unknown or other
  misc_feature (451)..(451): n is a, c, g, or t
  modified_base (467)..(467): a, c, t, g, unknown or other
  misc_feature (467)..(467): n is a, c, g, or t
  modified_base (476)..(476): a, c, t, g, unknown or other
  misc_feature (476)..(476): n is a, c, g, or t
tcagactgtacagtcacgaccggtgctcgatttagtgctatagacttgggtttgggggagtcagacccactcaggacacagcatggacatgagggtccccgctcagctcctggggcttctgctgctctggctcccaggtgccaaatgtgccatccagttgacccagtctccatcctccctgtctgcctctgttcgagacatagtcaccatcacttgtcgggctagtcgggtcattgggcagtgctttagcctggtatcagcagaaaccaggggaanctcctaagctcctgatctttgatgcctcagtttggaaagtgagtccatcaaggttcagcggcagtggatctgggacagatttcatcctcacatcagcagcctgcagcctgaagtntcnactactattatcgtacaataattaagtacttcctctctcgtggcggacggacgaggngagacacgaacgatgngctgcactnttcgtg

SEQ ID NO: 309178 - DNA, 623 bp, Homo sapiens
  misc_feature: GZ8MTXP01CZOE7.25.86.H09.1.454.CMB.2.raw
  modified_base (286)..(286): a, c, t, g, unknown or other
  misc_feature (286)..(286): n is a, c, g, or t
  modified_base (436)..(436): a, c, t, g, unknown or other
  misc_feature (436)..(436): n is a, c, g, or t
tcagactgtacagtcacgaccggtgctcgatttagtgctatagacttggggtttgggggcaggagtcagacccactcaggacacagcatggacatgagggtccccgctcagctcctggggcttctgctgctctggctcccaggtgccaaatgtgccatccagttgacccagtctccatcctccctgtctgcctctgttcgagacatagtcaccatcacttggtcgggctaggtcgggtcagttggcagtgtctttagcctggatcagcaagaaaccgaggggaacnctacctaagctcctgattctttagatcgccttccgtaggtttacggaaagtcggacgtcccataccgaaaggttcaaggcggaacaggtggatcgtagggactagtatttcactcctcacctatcagcagcctgcacgtcctagaacgtnttcggtctacctaaaccttagttacttagtaacctaaacttaaacgtttaacgtaacctttacccctcttccgtaacccggttacgggggacggggtaaacgggaacccgtaaaggggtcgggaaagttacgttaaaccgaaaacgtacgttgggacgggacttacggaacccgttaaccgttaacg

SEQ ID NO: 309179 - DNA, 425 bp, Homo sapiens
  misc_feature: GZ8MTXP01AQJUF.25.86.H09.1.454.CMB.2.raw
  modified_base (218)..(218): a, c, t, g, unknown or other
  misc_feature (218)..(218): n is a, c, g, or t
  modified_base (331)..(331): a, c, t, g, unknown or other
  misc_feature (331)..(331): n is a, c, g, or t
  modified_base (416)..(425): a, c, t, g, unknown or other
  misc_feature (416)..(425): n is a, c, g, or t
tcagactgtacagtcacgaccggtgctcgatttagtgctatagacttgggtttgggagaagaacctactatgcagactctgtgaagggtcgattcaccacctccagagacaacatcaagaactccctgtatctgcaaatggacagtctgacacctgatgacaccgccttgtattattgtgtgaaaggcggtgttgaggtgaatgcctggaacccccgnggtcagcactacttctacatgggcgtctgggggccaaaggggactacggtcatcgtctcctcagcctcaccaagggcccatcggtctccccctggccgccctgctccaggacncacctccgagagcacagcggcctgggctgcctggtcaaggctacttccatgtacagtctgagcgggctggcaaggcgacgatagnnnnnnnnnn

SEQ ID NO: 309180 - DNA, 576 bp, Homo sapiens
  misc_feature: GZ8MTXP01EJ4XH.25.86.H09.1.454.CMB.2.raw
  modified_base (290)..(290): a, c, t, g, unknown or other
  misc_feature (290)..(290): n is a, c, g, or t
  modified_base (446)..(446): a, c, t, g, unknown or other
  misc_feature (446)..(446): n is a, c, g, or t
tcagactgtacagtcacgaccggtgctcgatttagtgctatagacttgggtttgggggcaggagtcagacccactcaggacacagcatggacatgagggtccccgctcagctcctggggcttctgctgctctggctcccaggtgccaaatgtgccatccagttcgacccagtcctccatccctccctgtctgcctctgttcgagacatagtccaccatctacttggtcgggctaggtcgggtcagttggcagtgtctttagcctggtatcagacgaagaaccgagggacnctactaagcctctgtattcgttagatcgccctacgtaggttaggaaagtggacgtcccatcgtaaggttcaggcggaacgtaggtggattcggtaggggactaggtatttcgactccctacaccatcgagcctacgcctgacagtcctaaggaatnttcgagtacttaaacttatttatcgtaactaaactaagtttaacgtacctttaccctcttccgtccggttgggacggtaacggacgaagggtgagacttaacgaacgagtgtggcttagccgttcgtaag

SEQ ID NO: 309181 - DNA, 432 bp, Homo sapiens
  misc_feature: GZ8MTXP01C1SYQ.25.86.H09.1.454.CMB.2.raw
  modified_base (426)..(432): a, c, t, g, unknown or other
  misc_feature (426)..(432): n is a, c, g, or t
tcagactgtacagtcacgaccggtgctcgatttagtgctatagacttgggtttgggagaagaacctactatgcagactctgtgaagggtcgattcaccacctccagagacaacatcaagaactccctgtatctgcaaatggacagtctgacacctgatgacaccgccttgtattattgtgtgaaaggcggtgttgaggtgaatgcctggaacccccgcggtcagcactacttctacatggggcgtcgtgggggcaaaaggggactacggtcatcgtctcctcacgcctccaccaaagggccccatccggtccttccccctggccgccctgctccaggacgcacctccgagagcacacgcggcctgggctgcctggtcaaaggctacttccactgtacagtctgagcgggctggcaaggcgcatagnnnnnnn

SEQ ID NO: 309182 - DNA, 520 bp, Homo sapiens
  misc_feature: GZ8MTXP01ATRD1.25.86.H09.1.454.CMB.2.raw
  modified_base (391)..(391): a, c, t, g, unknown or other
  misc_feature (391)..(391): n is a, c, g, or t
tcagactgtacagtcacgaccggtgctcgatttagtgctatagacttgggtttgggggagtcagacccactcaggacacagcatggacatgagggtccccgctcagctcctggggcttctgctgctctggctcccaggtgccaaatgtgccatccagttgacccagtctccatcctccctgtctgcctctgttcgagacatagtcaccatcacttgtcgggctagtcgggtcattggcagtgctttagcctggtatcagcagaaaccaggggaagctcctaagctcctgatctttgatgcctcagtttggaagtgagtccatcaaggttcagcggcagtggatcgtgggacagatttcatcctcaccatcagcagcctgcagcctgaaagnttctgactaaccttattattgtacaaacgtaatttaaaggactttacccctctcttcccgttcgggcggtaagggacccaaagggttgaaaggattacgaaacgactgggtagctgccactaattcctg

SEQ ID NO: 309183 - DNA, 442 bp, Homo sapiens
  misc_feature: GZ8MTXP01DX6TM.25.86.H09.1.454.CMB.2.raw
  modified_base (434)..(434): a, c, t, g, unknown or other
  misc_feature (434)..(434): n is a, c, g, or t
  modified_base (437)..(437): a, c, t, g, unknown or other
  misc_feature (437)..(437): n is a, c, g, or t
  modified_base (439)..(442): a, c, t, g, unknown or other
  misc_feature (439)..(442): n is a, c, g, or t
tcagactgtacagtcacgaccggtgctcgatttagtgctatagacttgggtttgggagaagaacctactatgcagactctgtgaagggtcgattcaccacctccagagacaacatcaagaactccctgtatctgcaaatggacagtctgacacctgatgacaccgccttgtattattgtgtgaaaggcggtgttgaggtgaatgcctggaacccccgcggtcagcactacttctacagtgggcgtcgtgggggacaaagggactacggtcatcgtctcctcacgcctccaccgaaacgggccccagttccggtccttccccccgtggccgcccctgcctccgaggacgcaccgtccgagacgcacacgccggcctgggctgccctggtcaaggactacttccactgacagtctggagcgggctggcaagggcanagngnnnn

SEQ ID NO: 309184 - DNA, 532 bp, Homo sapiens
  misc_feature: GZ8MTXP01DTMLI.25.86.H09.1.454.CMB.2.raw
  modified_base (276)..(276): a, c, t, g, unknown or other
  misc_feature (276)..(276): n is a, c, g, or t
tcagactgtacagtcacgaccggtgctcgatttagtgctatagacttgggtttgggggagtcagacccactcaggacacagcatggacatgagggtccccgctcagctcctggggcttctgctgctctggctcccaggtgccaaatgtgccatccagttgacccagtctccatcctccctgtctgcctctgttcgagacatagtcaccatcacttgtcgggctagtcgggtcattggcagtgctttagctggtatcagcaagaaaccgaggggaanctcctaagctcctgattcttgatcgcctctaggtttaggaaagtgacgtccatcaacggttcagcggcaggtcgatcgagggactagtatttcatcctacaccatcagcacggcctgcagcctagaatatctagactaacttattactagtactaaacgtaatttacgacttacctctcgtccgtggaacggaggaccaagggttgaaacgtattaacgaaacgcgttaaggcggctaggccaactcgttcgtccg

SEQ ID NO: 309185 - DNA, 593 bp, Homo sapiens
  misc_feature: GZ8MTXP01EFWVF.25.86.H09.1.454.CMB.2.raw
  modified_base (274)..(274): a, c, t, g, unknown or other
  misc_feature (274)..(274): n is a, c, g, or t
tcagactgtacagtcacgaccggtgctcgatttagtgctatagacttgggtttgggggagtcagacccactcaggacacagcatggacatgagggtccccgctcagctcctggggcttctgctgctctggctcccaggtgtcaaatgtgccatccagttgacccagtctccatcctccctgtctgcctctgttcgagacatagtcaccatcacttgtcgggctagtcgggtcattggcagtgctttagctggtatcagcagaaaccaggggaanctcctaagctcctgatctttgatgcctcgtagtttaggaaagtggacgtccatcaaggtcagcggcagtggatcgtgggactagtactttcactctacacatcagcacgctagcagccgtagaagtatttcagacctaaactttatttaacttacgtacaaactaagtttaaacggtactttaccctcctcgttccgttcggggaacggggtaacgggaccgtaaaggggttggaacgtaacgttaaccgaaaacggttaaacccgttggggtaacgggtccttacgggaccaaccccgttaagtttccgtttaacccg

SEQ ID NO: 309186 - DNA, 544 bp, Homo sapiens
  misc_feature: GZ8MTXP01AFF6F.25.86.H09.1.454.CMB.2.raw
  modified_base (422)..(422): a, c, t, g, unknown or other
  misc_feature (422)..(422): n is a, c, g, or t
tcagactgtacagtcacgaccggtgctcgatttagtgctatagacttgggtttgggggcaggagtcagacccactcaggacacagcatggacatgagggtccccgctcagctcctggggcttctgctgctctggctcccaggtgccaaatgtgccatccagttgacccagtctccatccctcctgtctgcctctgttcgagacatagtcaccatcacttggtcgggctaggtcgggtcattggcagtgctttagcctggatcagcaagaaaccgaggggaacgctacctaagcctcctgattcttgatcgccttctaggtttggaaagtggacgtcccatcgaggttcaggcgacaggtgatcgtgggactagtatttcatccctacaccatccgagcacgcctgctacggcctaggaactntctacgacctaaccttattagttcaacaaacgttaatttacggtaccttaccctctcgtcccgttgggcggacgggacgagggtgacgattacgaaacgtactggtacgcttagccaacgtc

SEQ ID NO: 309187 - DNA, 522 bp, Homo sapiens
  misc_feature: GZ8MTXP01DNHN8.25.86.H09.1.454.CMB.2.raw
  modified_base (363)..(363): a, c, t, g, unknown or other
  misc_feature (363)..(363): n is a, c, g, or t
  modified_base (388)..(388): a, c, t, g, unknown or other
  misc_feature (388)..(388): n is a, c, g, or t
  modified_base (516)..(516): a, c, t, g, unknown or other
  misc_feature (516)..(516): n is a, c, g, or t
tcagactgtacagtcacgaccggtgctcgatttagtgctatagacttggggtttgggggcaggagtcagacccactcaggacacagcatggacatgagggtccccgctcagctcctggggcttctgctgctctggctcccaggtgccaaatgtgccatccagttgacccagtctccatcctccctgtctgcctctgttcgagacatagtcaccatcacttgtcgggctagtcgggtcattggcagtgctttagcctggtatcagcaagaaaccaggggaagctctaagctcctgatcttgatgctcagttgaagtgagtccatcagtcagcggacagtggatcgtgggacagatttcatcctnaccatcagcagcctgcagctgaagnttctgactaaacctattattcgtacaaactaaattttaaaggatttaacccctctccgttaaccgttcgggcgggacggggttacccaaaggggtggaagcttacgaaacgaactggtaggcttgccnccgtaa

SEQ ID NO: 309188 - DNA, 427 bp, Homo sapiens
  misc_feature: GZ8MTXP01C0FOR.25.86.H09.1.454.CMB.2.raw
  modified_base (332)..(332): a, c, t, g, unknown or other
  misc_feature (332)..(332): n is a, c, g, or t
  modified_base (421)..(427): a, c, t, g, unknown or other
  misc_feature (421)..(427): n is a, c, g, or t
tcagactgtacagtcacgaccggtgctcgatttagtgctatagacttgggtttgggagaagaacctactatgcagactctgtgaagggtcgattcaccacctccagagacaacatcaagaactccctgtatctgcaaatggacagtctgacacctgatgacaccgccttgtattattgtgtgaaaggcggtgttgaggtgaatgcctggaacccccgcggtcagcactacttctacatggggcgtctgggggcaaagggactacggtcatcgtctcctcagcctccaccaagggccccatccggtcttccccctgcgccctgctccaggacncacctccgagagcacacgcggcctggggctgaccctggtcaaggctacttccactgtacagtctgagcgggctggcaaggcgacatagnnnnnnn

SEQ ID NO: 309189 - DNA, 558 bp, Homo sapiens
  misc_feature: GZ8MTXP01A2PSD.25.86.H09.1.454.CMB.2.raw
  modified_base (274)..(274): a, c, t, g, unknown or other
  misc_feature (274)..(274): n is a, c, g, or t
  modified_base (281)..(281): a, c, t, g, unknown or other
  misc_feature (281)..(281): n is a, c, g, or t
  modified_base (389)..(389): a, c, t, g, unknown or other
  misc_feature (389)..(389): n is a, c, g, or t
tcagactgtacagtcacgaccggtgctcgatttagtgctatagacttgggtttgggggcaggagtcagacccactcaggacacagcatggacatgagggtccccgctcagctcctggggcttctgctgctctggctcccaggtgccaaatgtgccatccagttgacccagtctccatcctcctgtctgcctctgttcgagacatagtcaccatcacttgtcgggctaggtcgggtcattggcagtgtctttagcctggatcagcaagaaaccgnggggaanctacctaagctcctgattcttgatgcctctaggtttaggaaagtggactcccatcgaaggttcagcggacaggtggactcgtaggggacagtactttcaacttcctanaccatcagcagcctgcagcctagaagtcttcagtactaaaccttattattagtaccaaattaaagtttaacggtactttaacccctctccttccgttcgggacgggtaacggaccgtaaagggtgaacggacttacgaaaccggagtgtcggcttcgaacaaccgtaag

SEQ ID NO: 309190 - DNA, 580 bp, Homo sapiens
  misc_feature: GZ8MTXP01AM5AA.25.86.H09.1.454.CMB.2.raw
  modified_base (276)..(276): a, c, t, g, unknown or other
  misc_feature (276)..(276): n is a, c, g, or t
  modified_base (355)..(355): a, c, t, g, unknown or other
  misc_feature (355)..(355): n is a, c, g, or t
  modified_base (423)..(423): a, c, t, g, unknown or other
  misc_feature (423)..(423): n is a, c, g, or t
tcagactgtacagtcacgaccggtgctcgatttagtgctatagacttgggtttgggggagtcagacccactcaggacacagcatggacatgagggtccccgctcagctcctggggcttctgctgctctggctcccaggtgccaaatgtgccatccagttgacccagtctccatcctccctgtctgcctctgttcgagacatagtcaccatcacttgtcgggctagtcgggtcattggcagtgctttagcctggtatcagcagaaaccgaggggaanctccaagctcctgtatctttgatgcctcgtagtttaggaagtggacgtcccatcgaacggttcagcggcagtggatcgngggacagtactttcactcctacaccatcagcacgcctgccagcctagaagtcttcagacctaaacttntttaatacgttaacaaacgttaagtttaacgtacctttaccctcttccgttccgttcggggaacggaacgggacctaaaggggttggtaaacgaattaaccgaaacggttaaccgttggtacgggcttacgggaccttacccgtaattccgtttccg

SEQ ID NO: 309191 - DNA, 542 bp, Homo sapiens
  misc_feature: GZ8MTXP01CMYKN.25.86.H09.1.454.CMB.2.raw
  modified_base (453)..(453): a, c, t, g, unknown or other
  misc_feature (453)..(453): n is a, c, g, or t
  modified_base (522)..(522): a, c, t, g, unknown or other
  misc_feature (522)..(522): n is a, c, g, or t
tcagactgtacagtcacgaccggtgctcgatttagtgctatagacttgggtttgggggagtcagacccactcaggacacagcatggacatgagggtccccgctcagctcctggggcttctgctgctctggctcccaggtgccaaatgtgccatccagttgacccagtctccatcctccctgtctgcctctgtcgagacatagtcaccatcacttgtcgggctagtcgggtcattggcagtgctttagcctggtatcagcaagaaaccaggggaagctcctaagctcctgatcttgatgcctcagtttggaaagtgacgtccatcaaggttcagcggcaggtggatcgtgggacagtatttcatcctacaccatcagcaggcctgtacgctagaagattctgaccaacgttattattacgtacaaacttaaagtttaaacggatttaacccctnttccgtaccgttcgggcgggaagggtaccaaaggggtggaagtaactacgaaaaccgattggtaacggntcgcaccttagtcttgttcc

SEQ ID NO: 309192 - DNA, 560 bp, Homo sapiens
  misc_feature: GZ8MTXP01DZZ9I.25.86.H09.1.454.CMB.2.raw
  modified_base (368)..(368): a, c, t, g, unknown or other
  misc_feature (368)..(368): n is a, c, g, or t
  modified_base (383)..(383): a, c, t, g, unknown or other
  misc_feature (383)..(383): n is a, c, g, or t
  modified_base (486)..(486): a, c, t, g, unknown or other
  misc_feature (486)..(486): n is a, c, g, or t
  modified_base (502)..(502): a, c, t, g, unknown or other
  misc_feature (502)..(502): n is a, c, g, or t
  modified_base (553)..(553): a, c, t, g, unknown or other
  misc_feature (553)..(553): n is a, c, g, or t
tcagactgtacagtcacgaccggtgctcgatttagtgctatagacttgggtttggggagctctgggaaaggagccccagccctgagattcccaggtgattccattcggtgatcagcactgaacacagaactcaccatggagtttggactgagctgggttttccttgttgcctattttaaaaggtgtccagtgtgaagtgcaactggtggagtcgtgggggagccggtggtacgaggccggggggtcctgagactctcctgtgtagcctctggattcattgttgatgattatgtcatgcacgtgggtccgtcgaaggtccgggggaaggtcgtgggagtgggtctctcttagtgacgttgggatggganaagaactactatgcngactctggtagaagggtcgattccaccactccagacacaaacatacaaagaacctccctagtatacctagacaaagtggaccagtctgacacctgatacgacnccgtcttaagtaattntgttgtagaacggttgttgttagaagtcgaagtcgccttacggaaccccgngtaaccg

SEQ ID NO: 309193 - DNA, 433 bp, Homo sapiens
  misc_feature: GZ8MTXP01AE6BR.25.86.H09.1.454.CMB.2.raw
  modified_base (218)..(218): a, c, t, g, unknown or other
  misc_feature (218)..(218): n is a, c, g, or t
  modified_base (275)..(275): a, c, t, g, unknown or other
  misc_feature (275)..(275): n is a, c, g, or t
  modified_base (427)..(433): a, c, t, g, unknown or other
  misc_feature (427)..(433): n is a, c, g, or t
tcagactgtacagtcacgaccggtgctcgatttagtgctatagacttgggtttgggagaagaacctactatgcagactctgtgaagggtcgattcaccacctccagagacaacatcaagaactccctgtatctgcaaatggacagtctgacacctgatgacaccgccttgtattattgtgtgaaaggcggtgttgaggtgaatgcctggaacccccgnggtcagcactacttctacatgggcgtctgggggcaaaggggactacggtcatcgtcncctcagcctccaccaagggccccatcggtcttccccctggccgcccctgctccaggacgcacctccgagacgcacacgccggcctggggctgccctggtcaagggcctacttccactgtacagtctgaggcgggctggcaaggcgcagtagnnnnnnn

SEQ ID NO: 309194 - DNA, 570 bp, Homo sapiens
  misc_feature: GZ8MTXP01EK7TU.25.86.H09.1.454.CMB.2.raw
  modified_base (281)..(281): a, c, t, g, unknown or other
  misc_feature (281)..(281): n is a, c, g, or t
  modified_base (378)..(378): a, c, t, g, unknown or other
  misc_feature (378)..(378): n is a, c, g, or t
tcagactgtacagtcacgaccggtgctcgatttagtgctatagacttgggtttgggggcaggagtcagacccactcaggacacagcatggacatgagggtccccgctcagctcctggggcttctgctgctctggctcccaggtgccaaatgtgccatccagttgacccagtctccatcctccctgtctgcctctgttcgagacatagtcaccatcacttgtcgggctaggtcgggtcattggcagtgtcttagcctggtatcagcaagaaaccgagggganctacctaagctcctgatctttgatgcctctagtttaggaagtgacgtccatcgaaggtcagcggacaggtggatgtagggactagtattcatccctnaccatcagcacgcctgctagcctggaaattcttctgtaccttaaccttattattcgttactaaacttaaattttaacggtacctttaccctcttccgtcccggtttcggggcgggtaacggaaccgtaaggggtacggaacggttcttaaccgaaaacggtcgttaaggtgggtcttggtaacccaacgttg

SEQ ID NO: 309195 - DNA, 583 bp, Homo sapiens
  misc_feature: GZ8MTXP01BSKAY.25.86.H09.1.454.CMB.2.raw
tcagactgtacagtcacgaccggtgctcgatttagtgctatagacttgggtttgggggagtcagacccactcaggacacagcatggacatgagggtccccgctcagctcctggggcttctgctgctctggctcccaggtgccaaatgtgccatccagttgacccagtctccatcctccctgtctgcctctgttcgagacatagtcaccatcacttgtcgggctagtcgggtcattggcagtgctttagcctggtatcagcaagaaaccgaggggaagctcctaagctcctgatcttgatgcctcagtttggaagtggacgtccatcaaggttcagcggcaggtgatcgtgggacagtattcatcctcaccatcagcagccctagcacgcctagaagtacttctacgacctaaacctttattacttagtacctaaactaagttttaaacggacctttacccctcttccgttacccgtttcggggaacgggtaacggggaaccgtaaagggttggaaacggtacttaacgaaacggttaacgttgggtacggtaaccttggaccttaacttaacgttccgtttcg

SEQ ID NO: 309196 - DNA, 750 bp, Homo sapiens
  misc_feature: GZ8MTXP01C3F97.25.86.H09.1.454.CMB.2.raw
  modified_base (257)..(257): a, c, t, g, unknown or other
  misc_feature (257)..(257): n is a, c, g, or t
tcagactgtacagtcacgaccggtgctcgatttagtgctatagacttgggtttgggggagtcagacccactcaggacacagcatggacatgagggtccccgctcagctcctggggcttctgctgctctggctcccaggtgccaaatgtgccatccagttgacccagtctccatcctcctgtctgcctctgttcgagacatagtcaccatcacttgtcggctagtcgggtcattggcagtgctttagcctggtatagnacgaacgaaggaggactctacgactcctcgagtctttgtactgtcctaccgtacgtttagggtttaaaggacggtacggtacctacgtagtaacggttaaccgacggacggccgtagtagggtaacgtcgtcggggtacgaggttaattcttactacccttaccctacaacgggtttacagaccggaccgccgtacgacgtacgtacgtacgtaacgtacgttacgttacgtaccgtaacgttaacgtttaacgtttaaacgttaaaccgttaaaaccgttaaaaccgtttaaacgtttaaaccgtttaaccccgtttacccgtttacccgtttacccggttacccgggttaaccggggtaaaccggggtaaaccgggttaaacgggtaaacgggttaacggtaaacggtaaaccgttaaaccggttaaacggttaacggtaacgggtacggtaaccgtaccgtaccgttaccgttaaccgttccgttaaccg

SEQ ID NO: 309197 - DNA, 578 bp, Homo sapiens
  misc_feature: GZ8MTXP01BB8RE.25.86.H09.1.454.CMB.2.raw
  modified_base (277)..(277): a, c, t, g, unknown or other
  misc_feature (277)..(277): n is a, c, g, or t
  modified_base (366)..(366): a, c, t, g, unknown or other
  misc_feature (366)..(366): n is a, c, g, or t
tcagactgtacagtcacgaccggtgctcgatttagtgctatagacttgggtttgggggagtcagacccactcaggacacagcatggacatgagggtccccgctcagctcctggggcttctgctgctctggctcccaggtgccaaatgtgccatccagttgacccagtctccatcctccctgtctgcctctgtcgagacatagtcaccatcacttgtcggctagtcgggtcagttggctagtgctttagcctggtatcagcaagaaaccgaggggaanctacctaagctctgattcttgatcgcctacgtaggtttaggaaagtggacgtccatacgtaacggttcaggtcggcaggtaggactcgngggacagtactttcactcctacaccatcagcagctagcagacctaggaactattcgtacaactaaccttattacttacgaactaaacttaagtttaacggactttaccctcttaccgttaccgttcggggaacggtacggggaaacctagggttggaaactacgttacgaaacgacgtttgggcggtctcggacttacctaattcggttaac

SEQ ID NO: 309198 - DNA, 575 bp, Homo sapiens
  misc_feature: GZ8MTXP01AFVBQ.25.86.H09.1.454.CMB.2.raw
tcagactgtacagtcacgaccggtgctcgatttagtgctatagacttgggtttgggggagtcagacccactcaggacacagcatggacatgagggtccccgctcagctcctggggcttctgctgctctggctcccaggtgccaaatgtgccatccagttgacccagtctccatcctccctgtctgcctctgttcgagacatagtcaccatcacttgtcgggctagtcgggtcattggcagtgctttagctggtatcagcagaaaccgagggaagctcctaagctcctgatcttgatgcctcagtttggaagtggagtccatcgaacggttcaggcgcagtgatcgtgggacagtatttcactcctcaccatcagcgagcctgccagccgttgaaagtcttcgtacaccgtaaccttatttattacgttaactaacttaaagtttaacggtactttaccccttcttccgttcccgttcggggtcgggaacggggaccgtaaagggttcgggaagtaacgttaccgaaaacgttaccgtgggtggtaaccttcgaccttaccctaagttccgtttcg

SEQ ID NO: 309199 - DNA, 550 bp, Homo sapiens
  misc_feature: GZ8MTXP01ESMQ4.25.86.H09.1.454.CMB.2.raw
  modified_base (280)..(280): a, c, t, g, unknown or other
  misc_feature (280)..(280): n is a, c, g, or t
  modified_base (403)..(403): a, c, t, g, unknown or other
  misc_feature (403)..(403): n is a, c, g, or t
tcagactgtacagtcacgaccggtgctcgatttagtgctatagacttgggtttgggggcaggagtcagacccactcaggacacagcatggacatgagggtccccgctcagctcctggggcttctgctgctctggctcccaggtgccaaatgtgccatccagttgacccagtctccatcctccctgtctgcctctgttcgagacatagtcaccatcacttgtcgggctaggtcgggtcattggcagtgctttagcctggatcagcaagaaaccaggggaanctcctaagctcctgatctttgatgcctctagtttggaaagtggagtccatcaaggtcagcgacagtggatcgtgggacagtattcactcctacacatcagcacgcctgcacggctaggaaatnttcgtatactaaccttattagttagactaaacttaagtttaacgtacctttaccctctccttccggttcgggacgggaacgggaaccgtaaaggggtcgaaaggacttaacgaaaccgtattggaggcttcgaaccttaacgtaacg

SEQ ID NO: 309200 - DNA, 592 bp, Homo sapiens
  misc_feature: GZ8MTXP01EEXYU.25.86.H09.1.454.CMB.2.raw
  modified_base (280)..(280): a, c, t, g, unknown or other
  misc_feature (280)..(280): n is a, c, g, or t
  modified_base (348)..(348): a, c, t, g, unknown or other
  misc_feature (348)..(348): n is a, c, g, or t
  modified_base (357)..(357): a, c, t, g, unknown or other
  misc_feature (357)..(357): n is a, c, g, or t
tcagactgtacagtcacgaccggtgctcgatttagtgctatagacttggggtttgggggagtcagacccactcaggacacagcatggacatgagggtccccgctcagctcctggggcttctgctgctctggctcccaggtgccaaatgtgccatccagttgacccagtctccatcctccctgtctgcctctgttcgagacatagtcaccatcacttgtcgggctagtcgggtcagttggcagtgctttagcctggtatcagacaagaaaccgaggggaancctacctaagctcctgtattctttgatcgcctcgtagtttaggaagtgacgtccatcaaggtcagcgnagtgatcgngggacagtatttcatcctacaccatcagcagccctagacagcctagaactattcacgaccttaaactttatttactacggttaacctaaagttaaagttttaaacggaccttttacccctcgtttacccgttcccggttacgggggaacgggtaacggggacctaaaggggttgaaacgtaacttaaccgaaaacgttacgttggtcggaacttcggacttaaccttcgttcgtg

SEQ ID NO: 309201 - DNA, 578 bp, Homo sapiens
  misc_feature: GZ8MTXP01BW1VS.25.86.H09.1.454.CMB.2.raw
  modified_base (501)..(501): a, c, t, g, unknown or other
  misc_feature (501)..(501): n is a, c, g, or t
  modified_base (540)..(540): a, c, t, g, unknown or other
  misc_feature (540)..(540): n is a, c, g, or t
  modified_base (569)..(569): a, c, t, g, unknown or other
  misc_feature (569)..(569): n is a, c, g, or t
tcagactgtacagtcacgaccggtgctcgatttagtgctatagacttggggtttgggggagtcagacccactcaggacacagcatggacatgagggtccccgctcagctcctggggcttctgctgctctggctcccaggtgccaaatgtgccatccagttgacccagtctccatcctccctgtctgcctctgttcgagacatagtcaccatcacttgtcgggctagtcgggtcattggctagtgctttagcctggtatcagacaagaaaccgaggggaacgcctacctaagctcctgtacttctttgattcgccttcgtaggtttggaaagtggacgtcccatacgaacggttcaggcggacaggtaggactcggagggactagtactttcactcctacactatcgagctacggccctggaccacgtccgtaggaaactacttcgtacgaaccttaaactttagttattacgtactaaacttaagttacgtacttaccctntcctcggtggaacgggtaacggactaagggttcgaaganaacgaacgacgtggtacggctacgcactnttcgtaacg

SEQ ID NO: 309202 - DNA, 458 bp, Homo sapiens
  misc_feature: GZ8MTXP01BXKXL.25.86.H09.1.454.CMB.2.raw
  modified_base (444)..(444): a, c, t, g, unknown or other
  misc_feature (444)..(444): n is a, c, g, or t
  modified_base (449)..(458): a, c, t, g, unknown or other
  misc_feature (449)..(458): n is a, c, g, or t
tcagactgtacagtcacgaccggtgctcgatttagtgctatagacttgggtttgggagaagaacctactatgcagactctgtgaagggtcgattcaccacctccagagacaacatcaagaactccctgtatctgcaaatggacagtctgacacctgatgacaccgccttgtattattgtgtgaaaggcggtgttgaggtgaatgcctggaacccccgcggtcagcactacttctacagtggggcgtcgtgggggacaaaggggactacggtcatccgtctcctcacgccctccacccgaaacgggccccagtccggtcccttccccccgtggccgcccctgcctcccgaggacgccacctccgagacgcacgacggccggcctggggcctgaccctggtcaaggctacttccatgtacagtctgagcgggctgggcaagggcanatagnnnnnnnnnn

SEQ ID NO: 309203 - DNA, 545 bp, Homo sapiens
  misc_feature: GZ8MTXP01C1W2H.25.86.H09.1.454.CMB.2.raw
  modified_base (281)..(281): a, c, t, g, unknown or other
  misc_feature (281)..(281): n is a, c, g, or t
  modified_base (413)..(413): a, c, t, g, unknown or other
  misc_feature (413)..(413): n is a, c, g, or t
tcagactgtacagtcacgaccggtgctcgatttagtgctatagacttgggtttgggggcaggagtcagacccactcaggacacagcatggacatgagggtccccgctcagctcctggggcttctgctgctctggctcccaggtgccaaatgtgccatccagttgacccagtctccatcctccctgtctgcctctgttcgagacatagtcaccatcacttgtcgggctagtcgggtcattggcagtgctttagcctggtatcagcaagaaaccgaggggaanctcctaaagctcctgattctttgatcgcccttcgagtttaggaaagtggagtcccatcaaggttcagcggacaggtggatcgtgggacaggtatttcactcctacaccatcagcagcctgcagctagaagtnttcgtgactaaccttattattgtacaaacttaagtttacgtaccttaccctctcctccgttcgggcggtagggaccgtaaaggggtgaagacttacgtaaacgaacgttggcggccttagccgaacgtaacg

SEQ ID NO: 309204 - DNA, 424 bp, Homo sapiens
  misc_feature: GZ8MTXP01BN2A8.25.86.H09.1.454.CMB.2.raw
  modified_base (217)..(217): a, c, t, g, unknown or other
  misc_feature (217)..(217): n is a, c, g, or t
  modified_base (275)..(275): a, c, t, g, unknown or other
  misc_feature (275)..(275): n is a, c, g, or t
  modified_base (412)..(412): a, c, t, g, unknown or other
  misc_feature (412)..(412): n is a, c, g, or t
  modified_base (415)..(415): a, c, t, g, unknown or other
  misc_feature (415)..(415): n is a, c, g, or t
  modified_base (418)..(424): a, c, t, g, unknown or other
  misc_feature (418)..(424): n is a, c, g, or t
tcagactgtacagtcacgaccggtgctcgatttagtgctatagacttgggtttgggagaagaacctactatgcagactctgtgaagggtcgattcaccacctccagagacaacatcaagaactccctgtatctgcaaatggacagtctgacacctgatgacaccgccttgtattattgtgtgaaaggcggtgttgaggtgaatgcctggaaccccgnggtcagcactacttctacatgggcgtctgggggcaaaaggggactacggtcatcgtcncctcagcctccaccaaggccccatccggtctccccctggccgccctgctccaggagcacctcgagagcacacgcggcctggggctgcccgtgtcaaaggactacttccatgtacagtctgagcggctggcaaggcgntanagnnnnnnn

SEQ ID NO: 309205 - DNA, 418 bp, Homo sapiens
  misc_feature: GZ8MTXP01APL3M.25.86.H09.1.454.CMB.2.raw
  modified_base (218)..(218): a, c, t, g, unknown or other
  misc_feature (218)..(218): n is a, c, g, or t
  modified_base (274)..(274): a, c, t, g, unknown or other
  misc_feature (274)..(274): n is a, c, g, or t
  modified_base (410)..(418): a, c, t, g, unknown or other
  misc_feature (410)..(418): n is a, c, g, or t
tcagactgtacagtcacgaccggtgctcgatttagtgctatagacttgggtttgggagaagaacctactatgcagactctgtgaagggtcgattcaccacctccagagacaacatcaagaactccctgtatctgcaaatggacagtctgacacctgatgacaccgccttgtattattgtgtgaaaggcggtgttgaggtgaatgcctggaacccccgnggtcagcactacttctacatgggcgtctgggggcaaaggggctacggtcatcgtcncctcagcctccaccaaggcccatcggtctcccctgccgccctgctccaggagcacctcgagagcacacgcggcctgggctgcctggtcaaggctacttccatgtacagtctgagcgggctggcaagggcgcatagnnnnnnnnn

SEQ ID NO: 309206 - DNA, 565 bp, Homo sapiens
  misc_feature: GZ8MTXP01EI96Q.25.86.H09.1.454.CMB.2.raw
  modified_base (273)..(273): a, c, t, g, unknown or other
  misc_feature (273)..(273): n is a, c, g, or t
  modified_base (360)..(360): a, c, t, g, unknown or other
  misc_feature (360)..(360): n is a, c, g, or t
  modified_base (398)..(398): a, c, t, g, unknown or other
  misc_feature (398)..(398): n is a, c, g, or t
tcagactgtacagtcacgaccggtgctcgatttagtgctatagacttgggtttgggggagtcagacccactcaggacacagcatggacatgagggtccccgctcagctcctggggcttctgctgctctggctcccaggtgccaaatgtgccatccagttgacccagtctccatcctccctgtctgcctctgttcgagacatagtcaccatcacttgtcgggctagtcgggtcattggcagtgctttagcctggtatcagcagaaccagggganctcaagctctgatctttgatgccttctaggtttaggaaagtggacgtccatcgaaggttcagcggcagtgggatcgtgggactagtntttcatcctcaccatcagcagcctgcacgcctagaatnttctcgactaactttatttattacgtactaaacttaagttttaacggacttttaccctccttccttccggttcggggaacgggtaacgggaaccgtaaagggttggaaacgtaacgttacgaaaacggttacgtggtaggtcctacggaccaaccttcgttcgttcg

SEQ ID NO: 309207 - DNA, 564 bp, Homo sapiens
  misc_feature: GZ8MTXP01D3MSN.25.86.H09.1.454.CMB.2.raw
  modified_base (275)..(275): a, c, t, g, unknown or other
  misc_feature (275)..(275): n is a, c, g, or t
  modified_base (346)..(346): a, c, t, g, unknown or other
  misc_feature (346)..(346): n is a, c, g, or t
  modified_base (397)..(397): a, c, t, g, unknown or other
  misc_feature (397)..(397): n is a, c, g, or t
tcagactgtacagtcacgaccggtgctcgatttagtgctatagacttgggtttgggggagtcagacccactcaggacacagcatggacatgagggtccccgctcagctcctggggcttctgctgctctggctcccaggtgccaaatgtgccatccagttgacccagtctccatcctccctgtctgcctctgttcgagacatagtcaccatcacttgtcgggctagtcgggtcattggcagtgctttagcctggtatcagcagaaaccaggggaanctcctaagctctgatctttgatgcctcagtttggaagtggagtccatcaaggttcagcggcagtggatcgngggacagtatttcatcctcaccatcagcagcctgcagcctagaacgattcngactaaaccttattaacttgtactaaactaaagtttaacggtactttacccctcttccgttcccgttcgggaacgggtaaggggacccgtaaaggggttggaaacgtaagttaaccgaaaacggttacgtaaggttcgggaacttggccaacctaagttccttaacg

SEQ ID NO: 309208 - DNA, 636 bp, Homo sapiens
  misc_feature: GZ8MTXP01C24IZ.25.86.H09.1.454.CMB.2.raw
tcagactgtacagtcacgaccggtgctcgatttagtgctatagacttggggtttgggggagtcagacccactcaggacacagcatggacatgagggtccccgctcagctcctggggcttctgctgctctggctcccaggtgccaaatgtgccatccagttgacccagtctccatcctccctgtctgcctctgttcgagacatagtcaccatctacttggtcgggctaggtcgggtcagttggctagtgtctttagcctggtatcagcaagaaacgaggggaagctacctaagcctcctgtatcttgactcgcctcgtaggtttaggaaaggtggacgtcccatccgaacggttcaggcggacaggtggatcgtagggacagtacttcactcctacacatcgagcaggtccctgaccagaccgtagaaagtcttacgtacgtaccttaaaccttatttaattacgtaacctaaaacgttaaacgtttaaacggtaccttttacccctaccgttaccgtcccggtttcggggaaccgggtaacggggttaaccgtaaaggggttaggtaacgtaacgttaaaccgaaacggttacgtgggtcggtaacttcgaccttaccttaacgttcgtttaaccg

SEQ ID NO: 309209 - DNA, 643 bp, Homo sapiens
  misc_feature: GZ8MTXP01AX2GM.25.86.H09.1.454.CMB.2.raw
  modified_base (268)..(268): a, c, t, g, unknown or other
  misc_feature (268)..(268): n is a, c, g, or t
  modified_base (277)..(277): a, c, t, g, unknown or other
  misc_feature (277)..(277): n is a, c, g, or t
tcagactgtacagtcacgaccggtgctcgatttagtgctatagacttgggtttgggggagtcagacccactcaggacacagcatggacatgagggtccccgctcagctcctggggcttctgctgctctggctcccaggtgccaaatgtgccatccagttgacccagtctccatcctccctgtctgcctctgttcgagacatagtcaccatcacttgtcgggctagtcgggtcattggcagtgctttagcctggtatcagcagaaaccnggggtaacnctactagctctgtattcttgatcgcctcgtaaggtttaggaaggtggacgtaccctagtacgtaacggttcaggcggcaggtgggatcgtagggactagtactttcactccctacaccatccgaacgcgacgccgtacgacgacgaccgtacgtaagtacgttactacgtaccgtaaaccttaactttaattacgttaactaaacgttaaacgtttaaacgttaaccttacccttaccttccgttcccgttaccgggtaaccgggtaacgggttaaaccgggtaaacgggttacgggtaacggtaacgttaacgttaaaccgttaacggtaacggtacggtcgtcgtacgacctaacgttcgttcg

SEQ ID NO: 309210 - DNA, 443 bp, Homo sapiens
  misc_feature: GZ8MTXP01CVB71.25.86.H09.1.454.CMB.2.raw
  modified_base (406)..(406): a, c, t, g, unknown or other
  misc_feature (406)..(406): n is a, c, g, or t
  modified_base (418)..(418): a, c, t, g, unknown or other
  misc_feature (418)..(418): n is a, c, g, or t
  modified_base (431)..(431): a, c, t, g, unknown or other
  misc_feature (431)..(431): n is a, c, g, or t
  modified_base (433)..(433): a, c, t, g, unknown or other
  misc_feature (433)..(433): n is a, c, g, or t
  modified_base (436)..(443): a, c, t, g, unknown or other
  misc_feature (436)..(443): n is a, c, g, or t
tcagactgtacagtcacgaccggtgctcgatttagtgctatagacttgggtttgggagaagaacctactatgcagactctgtgaagggtcgattcaccacctccagagacaacatcaagaacctccctgtatctgcaaatggacagtctgacacctgatgacaccgccttgtattattgtgtgaaaggcggtgttgaggtgaatgcctcggaacccccgcggtcagcactacttctacagtgggcgtcgtgggggacaaaggggctacggtcatcgtctcctcacgcctccaccgaacgggccccagtccggtcccttcccccgtggccgcccctgcctccgaggacgccacctccgagacgcacgacgccggcctgggctgcctggtcaagctactcactgtacngtctgagcgggntggacaaggcgananagnnnnnnnn

SEQ ID NO: 309211 - DNA, 427 bp, Homo sapiens
  misc_feature: GZ8MTXP01AXOSO.25.86.H09.1.454.CMB.2.raw
  modified_base (420)..(427): a, c, t, g, unknown or other
  misc_feature (420)..(427): n is a, c, g, or t
tcagactgtacagtcacgaccggtgctcgatttagtgctatagacttgggtttgggagaagaacctactatgcagactctgtgaagggtcgattcaccacctccagagacaacatcaagaactccctgtatctgcaaatggacagtctgacacctgatgacaccgccttgtattattgtgtgaaaggcggtgttgaggtgaatgcctggaacccccgcggtcagcactacttctacatgggcgtctgggggcaaaggggactacggtcatcgtctcctcagcctccaccaagggcccatcggtctcccctgcgccctgctccaggcgcacctccgagacgcacacgccggcctggggctgccctgggtcaaagggactacttccatcgtacagtctgagcgggctggcaaggcgcatagnnnnnnnn

SEQ ID NO: 309212 - DNA, 554 bp, Homo sapiens
  misc_feature: GZ8MTXP01CTT79.25.86.H09.1.454.CMB.2.raw
  modified_base (276)..(276): a, c, t, g, unknown or other
  misc_feature (276)..(276): n is a, c, g, or t
tcagactgtacagtcacgaccggtgctcgatttagtgctatagacttgggtttgggggagtcagacccactcaggacacagcatggacatgagggtccccgctcagctcctggggcttctgctgctctggctcccaggtgccaaatgtgccatccagttgacccagtctccatcctccctgtctgcctctgttcgagacatagtcaccatcacttgtcgggctagtcgggtcattggcagtgctttagcctggtatcagcaagaaaccaggggaanctcctaagctctgattcttgatcgcctcgtagtttaggaaagtggacgtccatcgaacggttcagcgcagtggatcgtgggactagtatttcactcctacaccatcacgcacgcctcgcacgccgtagacgtacttctacgaccgtaattaaccccccttattacgtactaaactaaactttaacgtacttaccctacctcgtccgttcgggaacggtacgggaccgtaggttaggagtacgttacgaacgacgtgtggctcgcactaacttcgttcg

SEQ ID NO: 309213 - DNA, 571 bp, Homo sapiens
  misc_feature: GZ8MTXP01CD7WD.25.86.H09.1.454.CMB.2.raw
tcagactgtacagtcacgaccggtgctcgatttagtgctatagacttgggtttgggggcaggagtcagacccactcaggacacagcatggacatgagggtccccgctcagctcctggggcttctgctgctctggctcccaggtgccaaatgtgccatccagttgacccagtctccatcctccctgtctgcctctgttcgagacatagtcaccatcacttgtcgggctagtcgggtcattggcagtgctttagcctggtatcagcaaggaaaccgaggggaagctacctaagctcctgatctttgatcgcctcaggtttggaagtggactccatcaaggttcaggcggcaggtggatcgtagggacagtatttcactccctacaccatcagcacgcctgcacgcctagaagtacttcgagacctaaaccttatttattgtactaaacttaaagtttacggtactttacccctcttccgttccgttcgggttgggaacgggttaaccgtaaaggggttggaacgcgttaccgaaacggtacgtggtacggcttacggaaccttaaccgtaacg

SEQ ID NO: 309214 - DNA, 427 bp, Homo sapiens
  misc_feature: GZ8MTXP01BGYU0.25.86.H09.1.454.CMB.2.raw
  modified_base (420)..(427): a, c, t, g, unknown or other
  misc_feature (420)..(427): n is a, c, g, or t
tcagactgtacagtcacgaccggtgctcgatttagtgctatagacttgggttgggagaagaacctactatgcagactctgtgaagggtcgattcaccacctccagagacaacatcaagaactccctgtatctgcaaatggacagtctgacacctgatgacaccgccttgtattattgtgtgaaaggcggtgttgaggtgaatgcctggaacccccgcggtcagcactacttctacatggggcgtctgggggcaaaggggactacggtcatcgtctcctcagcctccaccaagggccccatcggtccttccccctggccgcccctgctccaggacgcacctccgagagcacacgcggcctgggctgcctggtcaaggctacttccactgtacagtctgagcgggctggcaaggcgcatagnnnnnnnn

SEQ ID NO: 309215 - DNA, 695 bp, Homo sapiens
  misc_feature: GZ8MTXP01ENCPB.25.86.H09.1.454.CMB.2.raw
  modified_base (274)..(274): a, c, t, g, unknown or other
  misc_feature (274)..(274): n is a, c, g, or t
tcagactgtacagtcacgaccggtgctcgatttagtgctatagacttgggtttggggagctctgggaaaggagccccagccctgagattcccaggtgattccattcggtgatcagcactgaacacagaactcaccatggagtttggactgagcttgggttttccttgttgcctaattttaaaaggtgtccagtgtgaagtgcaacgtggtggagtcgtgggggagccggtggtacgaggccgggggggtccctgagactctcctgtgtagcctntggattcatgttgatgattatgccatgcacgtgggtccgtacgaacgggtccgggggaagggtcgtgggagtgggtctctcttatgtaacgttggggatggggaagaaacgtaacctacgtatcgacaaggtactcgtggtagggtaacggggtcgtaatttacccaaccctacccgtacccgaaggaacgaaaccaaacaaacgtacaaacgtaaccctcccgttagtaacttactagaacgtaaagtcggaactacggtctagaaccctaccgtagactcggaaccctacccggttcctttaaggtttaactttagtttaggttaggttaacggtaaaggggttgggtttggttagggtaagggttagtaacgttaccgggcccggttaacccgggaaccccccggttcggggtaaccg

SEQ ID NO: 309216 - DNA, 693 bp, Homo sapiens
  misc_feature: GZ8MTXP01D12O1.25.86.H09.1.454.CMB.2.raw
  modified_base (315)..(315): a, c, t, g, unknown or other
  misc_feature (315)..(315): n is a, c, g, or t
tcagactgtacagtcacgaccggtgctcgatttagtgctatagacttgggtttgggggcaggagtcagacccactcaggacacagcatggacatgagggtccccgctcagctcctggggcttctgctgctctggctcccaggtgccaaatgtgccatccagttgacccagtcctccatcctccctgtctgcctctgttcgagacatagtccaccatctacgttggtcgggtcttagggtcgggtctagttcggactaggttcgtacgttttacgccgttgggtactcgaggacaaaggaaaccgaagggggaacncctacctaaagccttcctgtacttctttgatcgtccctacgtaggtttaggaaagtggacgtaccctagtacgtaaggttcaggcggtacgaaggtgggatcggtagggactagttacttacacttccctacaacctatcgagtacacgcccgtgccgacggcctaaggtaagttaacttcgtacgtaacccttaaacctttaatttaagttagttaaccctaaaagtttaaacgttttaaacgggtaaccctttaacccttccgttcccttaacccgggtttccggggacgggtaacggggttaaaccgtaaggggttacggaagttacgttaaacgaaaccggtagtgggtacgcgttacgtaacttaacgtaacg

SEQ ID NO: 309217 - DNA, 606 bp, Homo sapiens
  misc_feature: GZ8MTXP01BS5JT.25.86.H09.1.454.CMB.2.raw
  modified_base (278)..(278): a, c, t, g, unknown or other
  misc_feature (278)..(278): n is a, c, g, or t
  modified_base (293)..(293): a, c, t, g, unknown or other
  misc_feature (293)..(293): n is a, c, g, or t
tcagactgtacagtcacgaccggtgctcgatttagtgctatagacttgggtttgggggagtcagacccactcaggacacagcatggacatgagggtccccgctcagctcctggggcttctgctgctctggctcccaggtgccaaatgtgccatccagttgacccagtctccatcctccctgtctgcctctgttcgagacatagtcaccatcacttgtcgggctagtcgggtcattgggcagtgctttagcctggtatcagcagaaaccagggggaacnctactagctctgatnttgatcgcctcgtaggtttaggaagtgacgtccagtcgaacggttcaggcggacaggtaggactcggtagggactagttacttcactcctacacctatacgagcacgctcgacgacgacgtagtaagtacttactacgtaccgtaacttaactttaacttacgtaactaaacgttaaacgtttaacgttaaccttacccttccttccgttaccgttccgggtaacgggaacgggaacggtaacgggttaggtaacgtaacgttaaccgttaaacgttaacgtaaggtcggcgtcgaccacctaacgttcgtcg

SEQ ID NO: 309218 - DNA, 666 bp, Homo sapiens
  misc_feature: GZ8MTXP01DSMON.25.86.H09.1.454.CMB.2.raw
  modified_base (615)..(615): a, c, t, g, unknown or other
  misc_feature (615)..(615): n is a, c, g, or t
  modified_base (618)..(618): a, c, t, g, unknown or other
  misc_feature (618)..(618): n is a, c, g, or t
  modified_base (621)..(621): a, c, t, g, unknown or other
  misc_feature (621)..(621): n is a, c, g, or t
  modified_base (630)..(630): a, c, t, g, unknown or other
  misc_feature (630)..(630): n is a, c, g, or t
  modified_base (638)..(638): a, c, t, g, unknown or other
  misc_feature (638)..(638): n is a, c, g, or t
  modified_base (640)..(640): a, c, t, g, unknown or other
  misc_feature (640)..(640): n is a, c, g, or t
  modified_base (660)..(660): a, c, t, g, unknown or other
  misc_feature (660)..(660): n is a, c, g, or t
tcagactgtacagtcacgaccggtgctcgatttagtgctatagacttgggtttggggagctctgggaaaggagccccagccctgagattcccaggtgattccattcggtgatcagcactgaacacagaactcaccatggagtttggactgagctgggttttcctgttgccattttaaaggtgtccagtgtgaagtgcaacgtggtggagtcgtgggggagccggtggtacgaggccggggggtcctgagactctcctgtgtacgcctctggattcagttgttgatgattactgacctagtcgcctacgtcgggtccgtacgaacgggtccggggaaggtcgtgggtagtggtcctcgtcgttagcgtacgttgggagttacgggaagtaaacgtaacctactaagtcgacgtaaggtactcggtaggtacgggtaacgggttctaacgttacccgacccgtaacccgttaccgaacgtaacggaaacctaaaccgtaactaaccgtaaacgtaacccgtacccgttacgtaacgttacgtacgtacgtaaacggtacggtaccgtacgtacgtacgaccgtaccgtacgtacgtacgaccgtaccgtcgttaatnttntgngtagtaggngttgttgngngaacgtcgccgaccgcccgngtaacg

SEQ ID NO: 309219 - DNA, 566 bp, Homo sapiens
  misc_feature: GZ8MTXP01E0MFW.25.86.H09.1.454.CMB.2.raw
  modified_base (353)..(353): a, c, t, g, unknown or other
  misc_feature (353)..(353): n is a, c, g, or t
  modified_base (361)..(361): a, c, t, g, unknown or other
  misc_feature (361)..(361): n is a, c, g, or t
tcagactgtacagtcacgaccggtgctcgatttagtgctatagacttggggtttgggggcaggagtcagacccactcaggacacagcatggacatgagggtccccgctcagctcctggggcttctgctgctctggctcccaggtgccaaatgtgccatccagttgacccagtctccatcctccctgtctgcctctgttcgagacatagtcaccatcacttggtcgggctaggtcgggtcattggcagtgtctttagcctggatcagcaagaaaccgaggggaagctacctaagcctcctgattctttgatcgcctcgtaggtttaggaagtggactccatcgaagtcagcganagtgatgngggacagtacttcactcctacaccatcagcacgcctgaccagcctaggaatacttcgacgtactaaaccttagttattacgtaactaaacttaaagtttaacgtacctttaccctcgttccgtcgttcggggacgggaacgggttaaccgaagggtaggagacttacgaaaccggtagtggtacggtcagtccgttaacgtaacg

SEQ ID NO: 309220 - DNA, 669 bp, Homo sapiens
  misc_feature: GZ8MTXP01BL5QV.25.86.H09.1.454.CMB.2.raw
  modified_base (374)..(374): a, c, t, g, unknown or other
  misc_feature (374)..(374): n is a, c, g, or t
tcagactgtacagtcacgaccggtgctcgatttagtgctatagacttgggtttggggagctctgggaaaggagccccagccctgagattcccaggtgattccattcggtgatcagcactgaacacagaactcaccatggagtttggactgagctgggttttcctgttgcctattttaaaggtgtcagtgtgaagtgtaactggtggagtcgtgggggagccgtggtacagggccggggggtcctgagactctcctgtgtacgcctctggtattcattgttgatgattatgccatgcacgtcgggtcctacgaaggggtccggggaaggtcgtgggaggtgggtctcttcttagtgtacgttgggagtggggaanaacggtaacctatatggaaccagtaactcgtaggtaggaaggggtctacttaccaaccctaccctaccgaaggaacaaccaaaactataaccgaaacgtaacctccctagtactctagacaaaggtcgaacgtagtactagaacctaccgtgaactcgtaacccgacccggttcctttagtaagttttaagttgggtaggttagggtaaaccgggtgggttagggtttgggacggttaaggtaacggttcggaccccgttcccgggggaaacccccgtcgggttcctaacccggg

SEQ ID NO: 309221 - DNA, 580 bp, Homo sapiens
  misc_feature: GZ8MTXP01DKLPY.25.86.H09.1.454.CMB.2.raw
  modified_base (235)..(235): a, c, t, g, unknown or other
  misc_feature (235)..(235): n is a, c, g, or t
  modified_base (278)..(278): a, c, t, g, unknown or other
  misc_feature (278)..(278): n is a, c, g, or t
  modified_base (378)..(378): a, c, t, g, unknown or other
  misc_feature (378)..(378): n is a, c, g, or t
  modified_base (394)..(394): a, c, t, g, unknown or other
  misc_feature (394)..(394): n is a, c, g, or t
tcagactgtacagtcacgaccggtgctcgatttagtgctatagacttgggtttgggggcaggagtcagacccactcaggacacagcatggacatgagggtccccgctcagctcctggggcttctgctgctctggctcccaggtgccaaatgtgccatccagttgacccagtctccatcctccctgtctgcctctgttcgagacatagtcaccatcacttgtcgggctagtcgggnattggcagtgcttagctggatcagacaagaaccgaggggaacnctacctaagctcctgtattctttgatcgcccttactaggtttaggaaagttggactacccatacgtaaggttcaggcggacagtgatcgtagggacagtntttcactcctcaccancagcgacgctcgacacgactagtaactcttacgtacgtaacttaaaccttatttattacgtaactaaacgttaaagtttacgtacctttaccctcgttccgttccggtacgggacgggaacgggaacgtaagggtaggaaacgttacaacgaaacgtacgtcggtcgtcttacgtaaccgaacgtg

SEQ ID NO: 309222 - DNA, 569 bp, Homo sapiens
  misc_feature: GZ8MTXP01BEPJ2.25.86.H09.1.454.CMB.2.raw
  modified_base (273)..(273): a, c, t, g, unknown or other
  misc_feature (273)..(273): n is a, c, g, or t
  modified_base (389)..(389): a, c, t, g, unknown or other
  misc_feature (389)..(389): n is a, c, g, or t
  modified_base (550)..(550): a, c, t, g, unknown or other
  misc_feature (550)..(550): n is a, c, g, or t
tcagactgtacagtcacgaccggtgctcgatttagtgctatagacttgggtttgggggagtcagacccactcaggacacagcatggacatgagggtccccgctcagctcctggggcttctgctgctctggctcccaggtgccaaatgtgccatccagttgacccagtctccatcctccctgtctgcctctgttcgagacatagtcaccatcacttgtcgggctagtcgggtcattggcagtgctttagcctggtatcagcagaaccagggaanctctaagctcctgatctttgatgcctcagtttggaagtgagtccatcaaggttcagcgcagtgatcgtgggactagatttcatcctcaccatcagcagcctagcagcctagaagtnttctagctaacttcgttattattacgtaactaaacgttaaagtttaacggtaccctttacccgtcttcccgttccgggttaacgggaacgggttacgggtaaaccgttaggggtaggaacgttaacgttaacgttaaacgtaacggtacggtcgtaccggngacctaacgttaacttccg

SEQ ID NO: 309223 - DNA, 723 bp, Homo sapiens
  misc_feature: GZ8MTXP01CMGRA.25.86.H09.1.454.CMB.2.raw
  modified_base (306)..(306): a, c, t, g, unknown or other
  misc_feature (306)..(306): n is a, c, g, or t
tcagactgtacagtcacgaccggtgctcgatttagtgctatagacttgggtttgggggcaggagtcagacccactcaggacacagcatggacatgagggtccccgctcagctcctggggcttctgctgctctggctcccaggtgccaaatgtgccatccagttgacccagtctccatcctccctgtctgcctctgttcgagacatagtcacatcacttggtcggctaggtcgggtctagttggcagtcgtcttagccgttaggatcgagacgaagaaaccggaggggaatctacgtaagcttccgngtattcttgactcgtcctacgtaggtttaggaaagtggtacgtcctacgtacgtaaggtcgaacggccggaagtaggtggtagttccggtaggggtaactaggtactttaccaacttccccttacaacccttaacacgaccgtacctacgtccgtacgaccgtacgtaccgtaagtaacgttacgttaccggtaacgttaaacccttaaacgtttatttaacgttaactaaaccgttaaaacgtttaaacgtttaaccgtaaccctttacccgttaccggtttcccggttaaccggggtaacggggaaccgggggtaaaaccggttaacgggtaaagggtacgttaaacggttaaaccgttaaaccgggaaacgttcggttcgggtacctccgttaccgtaacccgttaacgttccg

SEQ ID NO: 309224 - DNA, 582 bp, Homo sapiens
  misc_feature: GZ8MTXP01C7A19.25.86.H09.1.454.CMB.2.raw
  modified_base (285)..(285): a, c, t, g, unknown or other
  misc_feature (285)..(285): n is a, c, g, or t
  modified_base (352)..(352): a, c, t, g, unknown or other
  misc_feature (352)..(352): n is a, c, g, or t
  modified_base (390)..(390): a, c, t, g, unknown or other
  misc_feature (390)..(390): n is a, c, g, or t
  modified_base (401)..(401): a, c, t, g, unknown or other
  misc_feature (401)..(401): n is a, c, g, or t
tcagactgtacagtcacgaccggtgctcgatttagtgctatagacttggggtttggggggcaggagtcagacccactcaggacacagcatggacatgagggtccccgctcagctcctggggcttctgctgctctggctcccaggtgccaaatgtgccatccagttgacccagtctccatcctccctgtctgcctctgttcgagacatagtcaccatcacttgtcgggctaggtcgggtcagttggcagtgtctttagcctggatcagcaagaaaccgaggggaanctactaagctctgattctttgatcgtcctcgtaggttaggaagtggactccatcgaaggtcagcganagtggatcgtagggactagtacttcactcctacaccancacgcacgtcngacgacgacgtaagtaacgtacttacgtacgtaacttaacttattacttaactaactaaagtttaacgttaaccgtaccttaccctcgtccgttccggtacgggacgggtaacggaacggtaaggtacgaagttacgttaacgtaaacgtacgtcggtacgcgttacgtaaccgttaactg

SEQ ID NO: 309225 - DNA, 560 bp, Homo sapiens
  misc_feature: GZ8MTXP01CVRWH.25.86.H09.1.454.CMB.2.raw
tcagactgtacagtcacgaccggtgctcgatttagtgctatagacttggggtttgggggagtcagacccactcaggacacagcatggacatgagggtccccgctcagctcctggggcttctgctgctctggctcccaggtgccaaatgtgccatccagttgacccagtctccatcctccctgtctgcctctgttcgagacatagtcaccatcacttgtcgggctagtcgggtcattggcagtgctttagcctggtatcagcagaaaccgaggggaagctcctaagctcctgattcttgatgcctcaggttttggaaagtggactcccatcaacggttcaggtcggcagtagggatcgtggggacagtattcatccctacaccatcagcagccctgacagacctgaagtacttctagctaaccttagttaattagtaccaaattaacttaaggtactttaccctcttccgttccgttcgggaacgggtacgggaacccgtaagggttggaactagttaacgaaacgttacgtcgtaggccgtggccacctaattccgttcg

SEQ ID NO: 309226 - DNA, 555 bp, Homo sapiens
  misc_feature: GZ8MTXP01ALKTK.25.86.H09.1.454.CMB.2.raw
  modified_base (276)..(276): a, c, t, g, unknown or other
  misc_feature (276)..(276): n is a, c, g, or t
tcagactgtacagtcacgaccggtgctcgatttagtgctatagacttgggtttgggggagtcagacccactcaggacacagcatggacatgagggtccccgctcagctcctggggcttctgctgctctggctcccaggtgccaaatgtgccatccagttgacccagtctccatcctccctgtctgcctctgttcgagacatagtcaccatcacttgtcgggctagtcgggtcattggcagtgctttagcctggtatcagcagaaaccgaggggaanctctaagctcctgatctttgatcgcctcgagtttaggaagtggagtccatcaaggttcagcggcagtggatcgtgggacagtactttcatcctacaccatcagcagcctgacagcctagaagtacttctgacctaaacttatttattacgtacctaaactaaacgtttaaggacctttaccctctccttccgttcggggaacgggtaacgggacgaaagggttcggaagtaacttacgaaacggacgttggagggtctggaccttacgtaacgttctcg

SEQ ID NO: 309227 - DNA, 700 bp, Homo sapiens
  misc_feature: GZ8MTXP01A9PQ1.25.86.H09.1.454.CMB.2.raw
  modified_base (648)..(648): a, c, t, g, unknown or other
  misc_feature (648)..(648): n is a, c, g, or t
tcagactgtacagtcacgaccggtgctcgatttagtgctatagacttgggtttggggagctctgggaaaggagccccagccctgagattcccaggtgattccattcggtgatcagcactgaacacagaactcaccatggagtttggactgagcttgggttttccttgttgcctaattttaaaaggtgtccagtgtgaagtgcaagtggtggagtcgtgggggagccggtggtacgacgggccgggggggtccctggagactctccgtgtgtagccgtccggattcagtcttcagacaaatatagtgtagaacgtcgggtcccgcgaggcctccggaggggaggggctgggaggtggggtcgctagtttcggagtagtagtagtagttaaccttaataaatacgtaacgcaaagagtcgagggttgggacggggtcctagtttcaacttaactccctaccgaaggaacgaaccaaacaacccgaaaggtacgtactttaagtttttcgggtttacacggtaaacctaaaattacgggggaaactacggtcccgtagggaacggacggacccgggaaggtaacgttaccgggtccttaggttaggttaactttaaggttcggaggtaccgaagaacctaaggttaaacgngacgtaagggtcgaacggttggggcctttaggaaccgttaacgggccggggg

SEQ ID NO: 309228 - DNA, 579 bp, Homo sapiens
  misc_feature: GZ8MTXP01BMZMH.25.86.H09.1.454.CMB.2.raw
  modified_base (278)..(278): a, c, t, g, unknown or other
  misc_feature (278)..(278): n is a, c, g, or t
  modified_base (367)..(367): a, c, t, g, unknown or other
  misc_feature (367)..(367): n is a, c, g, or t
  modified_base (432)..(432): a, c, t, g, unknown or other
  misc_feature (432)..(432): n is a, c, g, or t
  modified_base (436)..(436): a, c, t, g, unknown or other
  misc_feature (436)..(436): n is a, c, g, or t
tcagactgtacagtcacgaccggtgctcgatttagtgctatagacttggggtttgggggagtcagacccactcaggacacagcatggacatgagggtccccgctcagctcctggggcttctgctgctctggctcccaggtgccaaatgtgccatccagttgacccagtctccatcctccctgtctgcctctgttcgagacatagtcaccatcacttgtcgggctagtcgggtcattggcagtgctttagctggtatcagcaagaaaccgaggggaacnctacctaagctcctgtattctttgattcgcccttacgtaggtttaggaaacgttggaacgtcccaagtccgtaaaggttccaggccggntaggtagggactcgtagggactagtactttcactcctacaccatcagcacgctgcagcctgaatntcanactaacttattatactaactaaacgttaagttaacgtaccttcctcttccgtccggtcggggaacggtaacgggaacgtagggttaggaacgtaacgttaacgaacgttacgtggtacgtctacgacttactaacgttcgtcg

SEQ ID NO: 309229 - DNA, 585 bp, Homo sapiens
  misc_feature: GZ8MTXP01AK852.25.86.H09.1.454.CMB.2.raw
  modified_base (429)..(429): a, c, t, g, unknown or other
  misc_feature (429)..(429): n is a, c, g, or t
tcagactgtacagtcacgaccggtgctcgatttagtgctatagacttggggtttgggggagtcagacccactcaggacacagcatggacatgagggtccccgctcagctcctggggcttctgctgctctggctcccaggtgccaaatgtgccatccagttgacccagtctccatcctccctgtctgcctctgttcgagacatagtcacatcacttgtcgggctagtcgggtcattggcagtgtctttagcctggtatcagcagaaaccgaggggaagctcctaagctcctgatctttgatcgcctcgtagtttaggaaagtggacgtcccatacgtaaggttcaggcggactaggtagggtactcgtaggggactaggtactttacactccctacacctatcacgcagcctgcagcctagaactcttcngacctaacttattattgtaacaagtaatttaaggtaccttaccctctaccgttccgtcggggcggtaacgggaccgaagggttggaacgaacgttaaccgaaacccggttacttggggtcgggtcttacggacccttaccctaattccggtttccg

SEQ ID NO: 309230 - DNA, 540 bp, Homo sapiens
  misc_feature: GZ8MTXP01EFH8P.25.86.H09.1.454.CMB.2.raw
tcagactgtacagtcacgaccggtgctcgatttagtgctatagacttgggtttgggggagtcagacccactcaggacacagcatggacatgagggtccccgctcagctcctggggcttctgctgctctggctcccaggtgccaaatgtgccatccagttgacccagtctccatcctccctgtctgcctctgttcgagacatagtcaccatcacttgtcgggctagtcgggtcattggcagtgctttagcctggtatcagcagaaaccgaggggaagctcctaagctcctgatctttgatgcctcagtttaggaagtggacgtccatcaaggtcaggcggcagtggatcgtagggacagatttcactctacaccatcgagcagcctgcagcctagaagtacttctacactaacttaatttacttagtaacaaactaaatttaacggaactttaacccctcttccgtccgttccgggaacgggtaagggaccgaagggttagagaacttacgaaaggactgtggaactgcactaattcgttg

SEQ ID NO: 309231 - DNA, 447 bp, Homo sapiens
  misc_feature: GZ8MTXP01BJIO1.25.86.H09.1.454.CMB.2.raw
  modified_base (323)..(323): a, c, t, g, unknown or other
  misc_feature (323)..(323): n is a, c, g, or t
  modified_base (328)..(328): a, c, t, g, unknown or other
  misc_feature (328)..(328): n is a, c, g, or t
  modified_base (347)..(347): a, c, t, g, unknown or other
  misc_feature (347)..(347): n is a, c, g, or t
  modified_base (424)..(424): a, c, t, g, unknown or other
  misc_feature (424)..(424): n is a, c, g, or t
  modified_base (438)..(438): a, c, t, g, unknown or other
  misc_feature (438)..(438): n is a, c, g, or t
  modified_base (440)..(447): a, c, t, g, unknown or other
  misc_feature (440)..(447): n is a, c, g, or t
tcagactgtacagtcacgaccggtgctcgatttagtgctatagacttgggtttgggagaagaacctactatgcagactctgtgaagggtcgattcaccacctccagagacaacatcaagaactccctgtatctgcaaatggacagtctgacacctgatgacaccgccttgtattattgtgtgaaaggcggtgttgaggtgaatgcctggaacccccgcggtcagcactacttctacagtggggcgtcgtgggggacaaaggggactacgggtcatcgtctcctcagccctccaccgaaagggccccatccggtccttcccccnggccncccctgcctcccgaggacnccaccgtccgagacgcacacggccggccgtgggctgccctggtcaaaggctactccactgtacagtctggagcgggntggcgaaggccganannnnnnnn

SEQ ID NO: 309232 - DNA, 637 bp, Homo sapiens
  misc_feature: GZ8MTXP01CGAVH.25.86.H09.1.454.CMB.2.raw
  modified_base (194)..(194): a, c, t, g, unknown or other
  misc_feature (194)..(194): n is a, c, g, or t
  modified_base (233)..(233): a, c, t, g, unknown or other
  misc_feature (233)..(233): n is a, c, g, or t
  modified_base (278)..(278): a, c, t, g, unknown or other
  misc_feature (278)..(278): n is a, c, g, or t
  modified_base (405)..(405): a, c, t, g, unknown or other
  misc_feature (405)..(405): n is a, c, g, or t
tcagactgtacagtcacgaccggtgctcgatttagtgctatagacttggggtttgggggcaggagtcagacccactcaggacacagcatggacatgagggtccccgctcagctcctggggcttctgctgctctggctcccaggtgccaaatgtgccatccagttgacccagtctccatcctccctgtctgcctntgttcgagacatagtcacatcattgtcggctagtcggtnagttggcagtgctttagctggatcagacaagaaaccgagggaacnctactagctctgattcgttgactcgccttacgtaggtttaggaaagtgacgtcctatacgtagttcgagcggaactaggtggactcggtagggactaggttactttcaacttccctacgaaccgtanacgacgtacgtacgtcctgaccgtacgtacgtaagtaacttacttacgtacgttaaccttaaccgtttagttacgttacgtaaacttaaacgtttaaacgtttaccgtacctttcccgtccgttcccggttccgggtacggggaacgggtaacggaaccggtaaagggtacgaaacgttacgttaaccgtaacggtcggtcggtacggtacgttacgtaaccgttaaccgtg

SEQ ID NO: 309233 - DNA, 530 bp, Homo sapiens
  misc_feature: GZ8MTXP01ATN7T.25.86.H09.1.454.CMB.2.raw
  modified_base (277)..(277): a, c, t, g, unknown or other
  misc_feature (277)..(277): n is a, c, g, or t
  modified_base (524)..(524): a, c, t, g, unknown or other
  misc_feature (524)..(524): n is a, c, g, or t
tcagactgtacagtcacgaccggtgctcgatttagtgctatagacttggggtttgggggagtcagacccactcaggacacagcatggacatgagggtccccgctcagctcctggggcttctgctgctctggctcccaggtgccaaatgtgccatccagttgacccagtctccatcctccctgtctgcctctgttcgagacatagtcaccatcacttgtcgggctagtcgggtcattggcagtgctttagcctggtatcagcagaaaccgaggggaanctccaagctcctgatcttgatcgcctcagtttggaagtgactccatcaagtcagcggcagtgatcgtgggacagtatttcatcctcaccatcagcagcctgacacgcctaggaactattcagacctaaaccttattagtacgtactaaactaaagtttaacggactttaccctcttcctccgttcgggcggtaaggaccgtaagggttcgaagtacttacaaacgttacgtgtggctcggacacctnttcgtg

SEQ ID NO: 309234 - DNA, 593 bp, Homo sapiens
  misc_feature: GZ8MTXP01BL8R9.25.86.H09.1.454.CMB.2.raw
  modified_base (278)..(278): a, c, t, g, unknown or other
  misc_feature (278)..(278): n is a, c, g, or t
  modified_base (419)..(419): a, c, t, g, unknown or other
  misc_feature (419)..(419): n is a, c, g, or t
tcagactgtacagtcacgaccggtgctcgatttagtgctatagacttggggtttgggggagtcagacccactcaggacacagcatggacatgagggtccccgctcagctcctggggcttctgctgctctggctcccaggtgccaaatgtgccatccagttgacccagtctccatcctccctgtctgcctctgttcgagacatagtcaccatcacttgtcgggctagtcgggtcattggcagtgctttagctggtatcgagcagaaaccgaggggaacnctacctaagctcctgtattctttgatgcctcgtaggtttaggaaagtcggacgtcccatcgaaacggttcaggcgcagtgggatcgagggactgtatttcattccacacatcgagtcacgcctgcacgctagacgtattcngactaactttattacttagtaactaactaagtttaacgactttaccctcttacctccggttcgggaacggggtaacgggttaccgtaaggggttacggaaagtaacgttaaccgaaaacggccgtttgggacggtcctacgggacccttaaccggtaatttcccggtttaaccg

SEQ ID NO: 309235 - DNA, 648 bp, Homo sapiens
  misc_feature: GZ8MTXP01AXGEK.25.86.H09.1.454.CMB.2.raw
  modified_base (277)..(277): a, c, t, g, unknown or other
  misc_feature (277)..(277): n is a, c, g, or t
  modified_base (284)..(284): a, c, t, g, unknown or other
  misc_feature (284)..(284): n is a, c, g, or t
  modified_base (293)..(293): a, c, t, g, unknown or other
  misc_feature (293)..(293): n is a, c, g, or t
  modified_base (349)..(349): a, c, t, g, unknown or other
  misc_feature (349)..(349): n is a, c, g, or t
tcagactgtacagtcacgaccggtgctcgatttagtgctatagacttgggtttgggggagtcagacccactcaggacacagcatggacatgagggtccccgctcagctcctggggcttctgctgctctggctcccaggtgccaaatgtgccatccagttgacccagtctccatcctccctgtctgcctctgttcgagacatagtcaccatcacttgtcggctagtcgggtcattggcagtgctttagcctggtatcagcaagaaaccgaggggaacnctctacnctctgtatnttgatcgtcctcgtaggtttaggaagtcggacgtccagtacgtaacggtcaggcgngtaggtacggattcggtagggactagttactttaccactcccctacaaccctagtcgacgacgacgaccgtacgacgacgtaccgtacgtaacgtacgttacgtacgtaaccgtaacttaactttaacttactaactaaacgttaaacgtttaacgttaaccttacccttcccttacccgttacccggttccgggtaacgggtaacgggaaccggtaacgggttacggtaacgtaacgttaaccgttaaaccgttaacgtaacggtcggtaacgtacgtaccgacctaacgttcgttcg

SEQ ID NO: 309236 - DNA, 588 bp, Homo sapiens
  misc_feature: GZ8MTXP01A9TS7.25.86.H09.1.454.CMB.2.raw
tcagactgtacagtcacgaccggtgctcgatttagtgctatagacttggggtttgggggagtcagacccactcaggacacagcatggacatgagggtccccgctcagctcctggggcttctgctgctctggctcccaggtgccaaatgtgccatccagttgacctagtctccatcctccctgtctgcctctgttcgagacatagtcaccatcacttgtcgggctagtcgggtcattggcagtgctttagctggtatcagcaagaaaccgaggggaagctacctaagctcctgattctttgatcgtcctcgtaggtttggaaagtggacgtcccagtcaacggttcaggcgcgaggtggatcgtgggactagtctttcacttcctacacctatcagcagcctaggcacgccttagaaacgtcttctacgaacctaacgttatttacttataacctaaactaagtttaacgaactttccctcgttaccgttcccgttacggggaaccgggaaggggttaaccgaagggttcggaacggtaattaaccgaaacgttacgtggtacgaacgtcgaccttactaacttcgtcg

SEQ ID NO: 309237 - DNA, 572 bp, Homo sapiens
  misc_feature: GZ8MTXP01BAENB.25.86.H09.1.454.CMB.2.raw
tcagactgtacagtcacgaccggtgctcgatttagtgctatagacttgggtttgggggagtcagacccactcaggacacagcatggacatgagggtccccgctcagctcctggggcttctgctgctctggctcccaggtgccaaatgtgccatccagttgacccagtctccatcctccctgtctgcctctgttcgagacatagtcaccatcacttgtcgggctagtcgggtcattggcagtgctttagcctggtatcagcagaaaccaggggaagctcctaagctcctgattcttgatgcctcgagtttggaagtggagtccatcaaggttcagcggcaggtgatcgtgggacagtatttcatcctacaccatcagcagcctgcagcctagaatattctgactaactttattacttgtactaaactaagttttaacggactttcccctacttccgttacccgttcggggcgggaacggggttacccgtaaaggggttccggaaagtaacgttaccgaaaacggttaaccgttggttacgggccttacggacaaccccgtaagttcctttccg

SEQ ID NO: 309238 - DNA, 521 bp, Homo sapiens
  misc_feature: GZ8MTXP01DJZ8O.25.86.H09.1.454.CMB.2.raw
tcagactgtacagtcacgaccggtgctcgatttagtgctatagacttgggtttggggagtcagacccactcaggacacagcatggacatgagggtccccgctcagctcctggggcttctgctgctctggctcccaggtgccaaatgtgccatccagttgacccagtctccatcctccctgtctgcctctgttcgagacatagtcaccatcacttgtcgggctagtcgggtcattggcagtgctttagcctggtatcagcagaaaccaggggaagctcctaagctcctgatcttgatgcctcagtttggaagtggagtcccatcaagttcagcggcagtggatcgtgggacagtattcatcctcaccatcagcagccctgcagcctagagattctgtcaaaccttatttattagtacaaactaatttaaggaactttaccctcgtctccgttgggcggacgggaccgtaaagggttggaacgtattacgaaacgaacgtgtaggctgcacctaattcgttcg

SEQ ID NO: 309239 - DNA, 589 bp, Homo sapiens
  misc_feature: GZ8MTXP01CD1FN.25.86.H09.1.454.CMB.2.raw
  modified_base (284)..(284): a, c, t, g, unknown or other
  misc_feature (284)..(284): n is a, c, g, or t
  modified_base (387)..(387): a, c, t, g, unknown or other
  misc_feature (387)..(387): n is a, c, g, or t
  modified_base (404)..(404): a, c, t, g, unknown or other
  misc_feature (404)..(404): n is a, c, g, or t
tcagactgtacagtcacgaccggtgctcgatttagtgctatagacttgggtttgggggcaggagtcagacccactcaggacacagcatggacatgagggtccccgctcagctcctggggcttctgctgctctggctcccaggtgccaaatgtgccatccagttgacccagtctccatcctcctgtctgcctctgttcgagacatagtcaccatcacttgcgggctaggtcgggtcagttggcagtcgtctttagcctggtatcagcaagaaaccgaggggaacnctactaagtcctcctgacttctttgatcgtcctcgtagtttggaaagtggacgtccatcgagtcgagcggacaggtgatcgtagggactagtattcatccctnaccatcagcacgctgcncgctaggatcttcagactaaccttattatacgtactaaacgttaagttttaacgaccttttaccctctttcccgtccggttcggggaccgggtaacggggttaaccgtaaacgggggtggaacgttaacaaacccggttaaaaggtacgtttcggcgggactttacgaacccttaaccgttaacg

SEQ ID NO: 309240 - DNA, 530 bp, Homo sapiens
  misc_feature: GZ8MTXP01EAT2W.25.86.H09.1.454.CMB.2.raw
  modified_base (404)..(404): a, c, t, g, unknown or other
  misc_feature (404)..(404): n is a, c, g, or t
  modified_base (409)..(409): a, c, t, g, unknown or other
  misc_feature (409)..(409): n is a, c, g, or t
  modified_base (413)..(413): a, c, t, g, unknown or other
  misc_feature (413)..(413): n is a, c, g, or t
  modified_base (431)..(431): a, c, t, g, unknown or other
  misc_feature (431)..(431): n is a, c, g, or t
  modified_base (498)..(498): a, c, t, g, unknown or other
  misc_feature (498)..(498): n is a, c, g, or t
  modified_base (517)..(517): a, c, t, g, unknown or other
  misc_feature (517)..(517): n is a, c, g, or t
  modified_base (530)..(530): a, c, t, g, unknown or other
  misc_feature (530)..(530): n is a, c, g, or t
tcagactgtacagtcacgaccggtgctcgatttagtgctatagacttgggtttgggggcaggagtcagacccactcaggacacagcatggacatgagggtccccgctcagctcctggggcttctgctgctctggctcccaggtgccaaatgtgccatccagttgacccagtctccatcctccctgtctgcctctgttcgagacatagtcaccatcacttgtcgggctagtcgggtcattggcagtgctttagcctggtatcagcaagaaaccgaggggaagctcctaaagctcctgattctttgatgcccttacgtaggtttaggaaagtggagtcccaatcaaggttcagcggacagtggatcgtgggacagtattcatcctcaccatcagcagcctgcagcngaagnttcngactaaccttattagttntactaaactaagtttaacgtacttaccctctccttccgttcgggacggtagggacgtaagggtgagnttacgaaacgctggtcggnttacgcaaccgtn

SEQ ID NO: 309241 - DNA, 428 bp, Homo sapiens
  misc_feature: GZ8MTXP01DYAIN.25.86.H09.1.454.CMB.2.raw
  modified_base (218)..(218): a, c, t, g, unknown or other
  misc_feature (218)..(218): n is a, c, g, or t
  modified_base (419)..(419): a, c, t, g, unknown or other
  misc_feature (419)..(419): n is a, c, g, or t
  modified_base (421)..(421): a, c, t, g, unknown or other
  misc_feature (421)..(421): n is a, c, g, or t
  modified_base (423)..(428): a, c, t, g, unknown or other
  misc_feature (423)..(428): n is a, c, g, or t
tcagactgtacagtcacgaccggtgctcgatttagtgctatagacttgggtttgggagaagaacctactatgcagactctgtgaagggtcgattcaccacctccagagacaacatcaagaactccctgtatctgcaaatggacagtctgacacctgatgacaccgccttgtattattgtgtgaaaggcggtgttgaggtgaatgcctggaacccccgnggtcagcactacttctacatggggcgtctgggggcaaaaggggactacggtcatcgtctcctcagcctccaccaaagggcccatcggtcttccccctggcgcccctgctccaggagcacctcgagagcacagcggcctgggcctgaccctggtcaaaggctaacttccactgtacagtctgagcgggctggcaaaggcgananannnnnn

SEQ ID NO: 309242 - DNA, 612 bp, Homo sapiens
  misc_feature: GZ8MTXP01CGY0C.25.86.H09.1.454.CMB.2.raw
  modified_base (283)..(283): a, c, t, g, unknown or other
  misc_feature (283)..(283): n is a, c, g, or t
tcagactgtacagtcacgaccggtgctcgatttagtgctatagacttgggtttgggggcaggagtcagacccactcaggacacagcatggacatgagggtccccgctcagctcctggggcttctgctgctctggctcccaggtgccaaatgtgccatccagttgacccagtctccatcctccctgtctgcctctgttcgagacatagtcaccatcacttggtcgggctagtcgggtcagttggcagtgtctttagcctggatcagcaagaaaccgaggggaanctactaagctcctgatctttgatcgcctcgtagtttaggaaagtggacgtccatacgtaggtcgagcggacaggtgatcgtagggacagtacttcactcctacaccgatcaacgcacgccctgacgacgcctaaggaactcttcgtacgtaccttaaaccttattaacttcgtaactaaacgttaaagtttaaaccgtacctttaccccttcttcccgttaacccggtttcggggaccgggtaaacggggaaccgtaaagggttcgggaaacgttagttaaccggtaaaccgtaaggtcggtacggtcgttacgaacttaacccgttcg

SEQ ID NO: 309243 - DNA, 746 bp, Homo sapiens
  misc_feature: GZ8MTXP01AYRCF.25.86.H09.1.454.CMB.2.raw
  modified_base (239)..(239): a, c, t, g, unknown or other
  misc_feature (239)..(239): n is a, c, g, or t
  modified_base (288)..(288): a, c, t, g, unknown or other
  misc_feature (288)..(288): n is a, c, g, or t
  modified_base (410)..(410): a, c, t, g, unknown or other
  misc_feature (410)..(410): n is a, c, g, or t
tcagactgtacagtcacgaccggtgctcgatttagtgctatagacttgggtttgggggcaggagtcagacccactcaggacacagcatggacatgagggtccccgctcagctcctggggcttctgctgctctggctcccaggtgccaaatgtgccatccagttgacccagtctccatcctccctgtctgcctctgttcgagacatagtcaccatctacttggtcgggctaggtcgggtnagttggcagtgtcttagcctggtatcagacaaggaaaccgaggggaacncctaccgtaaggtcctccgtagtacttcgtttagactcgtccccttacgtaagggttttaggaaaacggttcgggtaacgtcccctaagtaccggtaaagggtttcgaagggtcccgggaanacgggttaagggtcgttacgggtaacgggggtaacctagggtttaactttacctaaccttccccctacaaacccgttataccgaaacgtccgtaacggtccctgggacccagtcccgtaagtaaacgttactttccgggacgtaaccttaaaccttagtttacttacgtaactaaaacctttaaagtttaaccggtaacctttaccccgtccttccgttaacccgggttcggggttaaccggggaaacggggttaccgaaacggggttggaaacttaacgttaaacccggaaaacgttcgttcgggcggccttaccggtaacccgttaacgttccg

SEQ ID NO: 309244 - DNA, 596 bp, Homo sapiens
  misc_feature: GZ8MTXP01BBS7P.25.86.H09.1.454.CMB.2.raw
  modified_base (282)..(282): a, c, t, g, unknown or other
  misc_feature (282)..(282): n is a, c, g, or t
tcagactgtacagtcacgaccggtgctcgatttagtgctatagacttgggtttgggggcaggagtcagacccactcaggacacagcatggacatgagggtccccgctcagctcctggggcttctgctgctctggctcccaggtgccaaatgtgccatccagttgacccagtctccatcctccctgtctgcctctgttcgagacatagtcaccatcacttgtcgggctagtcggggtcattggcagtgtctttagcctggtatcagcagaaaccgaggggaanctcctaagctcctgatctttgatgccctctagtttggaaagtggagtccatcaaggttcagcggacagtggatcgtagggactagtatttcatcctcaccatcagcacgctgcagcctgaagtacttcagtactaaaccttatttacgttgtacctaaacttaaacgttttaacggtaactttaccccttccgttccgttcccggtttcggggacggggtaacggggaacccgtaaagggggttacggaacggttacgttaaccgtaaaacggtaaccgtggttacgggacttacggaaccttaaccgttaacg

SEQ ID NO: 309245 - DNA, 578 bp, Homo sapiens
  misc_feature: GZ8MTXP01DNAPZ.25.86.H09.1.454.CMB.2.raw
  modified_base (283)..(283): a, c, t, g, unknown or other
  misc_feature (283)..(283): n is a, c, g, or t
  modified_base (363)..(363): a, c, t, g, unknown or other
  misc_feature (363)..(363): n is a, c, g, or t
  modified_base (439)..(439): a, c, t, g, unknown or other
  misc_feature (439)..(439): n is a, c, g, or t
  modified_base (578)..(578): a, c, t, g, unknown or other
  misc_feature (578)..(578): n is a, c, g, or t
tcagactgtacagtcacgaccggtgctcgatttagtgctatagacttggggtttgggggcaggagtcagacccactcaggacacagcatggacatgagggtccccgctcagctcctggggcttctgctgctctggctcccaggtgccaaatgtgccatccagttgacccagtctccatcctccctgtctgcctctgttcgagacatagtcaccatcacttgtcgggctagtcgggtcattggcagtgctttagcctggatcagacaagaaaccgaggggaacnctacctaagctcctgacttctttgatgcccttactaggtttaggaaagtggacgtccatacgaaaggttccaggtccggnaacggtgggatccgtaggggactagtactttcactcctacacctatcgaagtcagcctgctaagcctagaaacgtnttcggactactaaaccttaggtttatacgtacaaactaaagtttacgactttaccctctacgtccgttcggggacgggtaacgggacgtaaagggtcgaagttcttacaaacgtactggtacggcttacgccaaccgtn

SEQ ID NO: 309246 - DNA, 725 bp, Homo sapiens
  misc_feature: GZ8MTXP01EXXOY.25.86.H09.1.454.CMB.2.raw
  modified_base (438)..(438): a, c, t, g, unknown or other
  misc_feature (438)..(438): n is a, c, g, or t
tcagactgtacagtcacgaccggtgctcgatttagtgctatagacttgggtttgggggcaggagtcagacccactcaggacacagcatggacatgagggtccccgctcagctcctggggcttctgctgctctggctcccaggtgccaaatgtgccatccagttgacccagtctccatcctccctgtctgcctctgttcgagacatagtccaccatctacttggtcgggctaggtcgggtcagttggcagtgtctttagcctggtactcagacgaaacgaaaccggaaggggaactcctaccgtaagccttccgtgtactttcgtttagacgttcgtccccttacgttaggtttaggaaaggtggacgtaccagtacgtaaggtcgagtccggataggtggtatcgggacggactagttacttcaacttcccacacacncgaagccgaacgtccgtagccgacgtccgtaaggtaaacttcttaccggtacgtaaaccgttaaacctttaatttaacggtttaaccgtaaaccttaaaacgtttaaaagggttttaaccgtaccccttttaacccctcccgtttaacccggttccgggtttaacccgggggaacgggggtaaaccgggttaaaccgggtaaaggggttaaccgggaaagtttaaccaaaccggtaaaaccgggttgttcggggaacgtcccggttaacgaaccgttaacgtttccg

SEQ ID NO: 309247 - DNA, 570 bp, Homo sapiens
  misc_feature: GZ8MTXP01EOM5V.25.86.H09.1.454.CMB.2.raw
  modified_base (367)..(367): a, c, t, g, unknown or other
  misc_feature (367)..(367): n is a, c, g, or t
  modified_base (382)..(382): a, c, t, g, unknown or other
  misc_feature (382)..(382): n is a, c, g, or t
  modified_base (430)..(430): a, c, t, g, unknown or other
  misc_feature (430)..(430): n is a, c, g, or t
tcagactgtacagtcacgaccggtgctcgatttagtgctatagacttgggtttggggagctctgggaaaggagccccagccctgagattcccaggtgattccattcggtgatcagcactgaacacagaactcaccatggagtttggactgagctgggttttccttgttgcctattttaaaaggtgtccagtgtgaagtgcaactggtggagtcgtgggggagccgtggtacgaggccggggggtcctgagactctcctgtgtagcctctggattcatgttgatgattatgccatgcacgtgggtccgtcgaagggtccgggggaaggtctgggagttgggtcttctcttatgacgttgggatggganaagaacctatatgcngctctgtagagggtcattccacccactaccagacgaacaacatacaanacctcctgtatctagactaaagtggaacacggtctacgactacctagatcgaccaccgtcttaagttattatggttagtaggtaaggttggttgttggaaggtgtaagtcggcccgttacggaacccccgttggtaaccc

SEQ ID NO: 309248 - DNA, 628 bp, Homo sapiens
  misc_feature: GZ8MTXP01AXVZ4.25.86.H09.1.454.CMB.2.raw
  modified_base (279)..(279): a, c, t, g, unknown or other
  misc_feature (279)..(279): n is a, c, g, or t
  modified_base (398)..(398): a, c, t, g, unknown or other
  misc_feature (398)..(398): n is a, c, g, or t
tcagactgtacagtcacgaccggtgctcgatttagtgctatagacttgggtttgggggagtcagacccactcaggacacagcatggacatgagggtccccgctcagctcctggggcttctgctgctctggctcccaggtgccaaatgtgccatccagttgacccagtctccatcctccctgtctgcctctgttcgagacatagtcaccatcacttgtcgggctagtcgggtcagttggcagtgtctttagcctggtatcagcgaagaaaccgagggganctacctaagctcctgtacttctttgactcgcctacgtaggtttaggaagtggacgtcccatccgtaacggttcaggcgcaggtgatcgtgggacagtacttcactctacacctatcgancacgtcccgagcccgagtaccgtaggaaacttactttacgacgtacctaaaccctttagtttaaacttcgtaaacctaaaaccttaaagttttaaacggaaccctttacccttcgttcccgttaccggttccggggaacgggaaacggggttaccgaaaggggttcggaaagttaacgaaccgttaaacgaccggttggtcggaacctcgaccttacctaacgttcgtcg

SEQ ID NO: 309249 - DNA, 571 bp, Homo sapiens
  misc_feature: GZ8MTXP01CCFLU.25.86.H09.1.454.CMB.2.raw
  modified_base (219)..(219): a, c, t, g, unknown or other
  misc_feature (219)..(219): n is a, c, g, or t
  modified_base (354)..(354): a, c, t, g, unknown or other
  misc_feature (354)..(354): n is a, c, g, or t
  modified_base (537)..(540): a, c, t, g, unknown or other
  misc_feature (537)..(540): n is a, c, g, or t
  modified_base (542)..(571): a, c, t, g, unknown or other
  misc_feature (542)..(571): n is a, c, g, or t
tcagactgtacagtcacgaccggtgctcgatttagtgctatagacttgggtttgggagaagaacctactatgcagactctgtgaagggtcgattcaccacctccagagacaacatcaagaactccctgtatctgcaaaatggacagtctgacacctgatgacaccgccttgtattattgtgtgaaaggcggtgttgaggtgaatgcctggaacccccgnggtcagcactacttctacagtgggcgtcgtgggggacaaaggggactacggtcatcgtctcctcagccctccgaccaaacgggcccctagtccggtcccttccccccgtggcccgcccctcgcctcccgaggacnccacccgtccggaagacgcaccgtaccggccggcccgtggggcctcggccccgttaggggtccgaaaacggggtaccctttaacccttccccgaacgtttacgggtaccgaacggtttcccgtaggggacgggccgggggtcccgttaggggacccgtaaacggggccgacgaagttaaggcnnnngnnnnnnnnnnnnnnnnnnnnnnnnnnnnnn

SEQ ID NO: 309250 - DNA, 663 bp, Homo sapiens
  misc_feature: GZ8MTXP01DJJYI.25.86.H09.1.454.CMB.2.raw
tcagactgtacagtcacgaccggtgctcgatttagtgctatagacttgggtttgggggcaggagtcagacccactcaggacacagcatggacatgagggtccccgctcagctcctggggcttctgctgctctggctcccaggtgccaaatgtgccatccagttgacccagtcctccatccctccctgtctgcctctgttcgagacatacgtcaccatctacgttggtcgggtctacggtcgggtcagttggctaggtgtcgtttagccgttggtactcgagacgaaacggaaaccggaggggtaacgcttaaccctaaggtcccttcctagtactttctttgactcgtcccttacgtaggtttaggaaaggtgacgtaccctagtacgtaaggtcgaggccggagagtggatcggtagggtactagttacttcacttccctacgacctagtccagaccgagtcctgccgagtacctagggtaaactctttactaccggtaacttaacctttattatttaccgaaccttaaagttaaagtttaaccgtccctttaccctcgttaccggttccgtaacgggggacggtaacgggacgtaaaggggtgttaaacgacttaaacgaaaccggtgttggggaaccgtcgttactaaccgttaacgttg

SEQ ID NO: 309251 - DNA, 579 bp, Homo sapiens
  misc_feature: GZ8MTXP01ENED4.25.86.H09.1.454.CMB.2.raw
  modified_base (369)..(369): a, c, t, g, unknown or other
  misc_feature (369)..(369): n is a, c, g, or t
tcagactgtacagtcacgaccggtgctcgatttagtgctatagacttgggtttggggggcaggagtcagacccactcaggacacagcatggacatgagggtccccgctcagctcctggggcttctgctgctctggctcccaggtgccaaatgtgccatccagttgacccagtctccatcctccctgtctgcctctgttcgagacatagtcaccatcacttggtcgggctaggtcgggtcagttggcagtgtctttagcctggtatcagcaaggaaaccgaggggaacgctcctaagctcctgtactctttgatgcccttcgtagtttggaaagtggactccatacgaaggtcagcggacagtggatcgngggacagtatttcactcctcaccatcagcagcctgccagcctagaatctttcgggactacctaaaccttattaattacgtaacctaaagtaaacgtttttaacggtacctttaccccttgttacccgttccggttacgggacgggtacgggaaaccgtaagggtacggaacgcttaacgaaacgtacgtgtcggcttagccttaaccgtg

SEQ ID NO: 309252 - DNA, 578 bp, Homo sapiens
  misc_feature: GZ8MTXP01DD0BN.25.86.H09.1.454.CMB.2.raw
  modified_base (275)..(275): a, c, t, g, unknown or other
  misc_feature (275)..(275): n is a, c, g, or t
  modified_base (346)..(346): a, c, t, g, unknown or other
  misc_feature (346)..(346): n is a, c, g, or t
  modified_base (393)..(393): a, c, t, g, unknown or other
  misc_feature (393)..(393): n is a, c, g, or t
  modified_base (397)..(397): a, c, t, g, unknown or other
  misc_feature (397)..(397): n is a, c, g, or t
tcagactgtacagtcacgaccggtgctcgatttagtgctatagacttggggtttgggggagtcagacccactcaggacacagcatggacatgagggtccccgctcagctcctggggcttctgctgctctggctcccaggtgccaaatgtgccatccagttgacccagtctccatcctcctgtctgcctctgttcgagacatagtcaccatcacttgtcgggctagtcgggtcattggcagtgctttagcctggtatcagcagaaaccaggggaanctcctaagctcctgatcttgatgcctcagtttggaagtggactccatcgaaggttcagcgcagtggatcgngggacagtattcatcctcaccatcagcagcctgctagcctagaagtnttcncgactaaccttattaactgtaactaaactaaagtttaacgtactttaacccctcgttacctcccgttcggggaaccgggaacgggttacccgaaaggggttaggaaacggtaacttaaccggaaaacgttaaacccgttgggtacggtccgttacggaccttaccctaacgttcttaaccg

SEQ ID NO: 309253 - DNA, 620 bp, Homo sapiens
  misc_feature: GZ8MTXP01D6H4Z.25.86.H09.1.454.CMB.2.raw
  modified_base (237)..(237): a, c, t, g, unknown or other
  misc_feature (237)..(237): n is a, c, g, or t
  modified_base (284)..(284): a, c, t, g, unknown or other
  misc_feature (284)..(284): n is a, c, g, or t
tcagactgtacagtcacgaccggtgctcgatttagtgctatagacttggggtttggggggcaggagtcagacccactcaggacacagcatggacatgagggtccccgctcagctcctggggcttctgctgctctggctcccaggtgccaaatgtgccatccagttgacccagtctccatcctcctgtctgcctctgttcgagacatagtcaccatcacttgtcgggctagtcgggtnagttggcagtgtctttagcctggtatcagcaagaaaccgaggggaanctaccgtaagctcctgattctttgatgccctcgtaggtttaggaaagtggacgtcccatcgaaaggttcgagcggactagtgggatcggtggggaactaggtatttcactccctacaccatcaagcacgcctgcacgcctaggaatcttcgtacactaaaccttattattacgtaacctaaaagttaaagtttaaacggtacctttaccccttcgttcccgttcccggttaccggggacggggtaaacgggttaacccgtaaaggggttacggaacgttaacgttaaccgtaaaacggtacttgggcgggtacttacggaacccttaacgttaacg

SEQ ID NO: 309254 - DNA, 576 bp, Homo sapiens
  misc_feature: GZ8MTXP01EEOBA.25.86.H09.1.454.CMB.2.raw
  modified_base (274)..(274): a, c, t, g, unknown or other
  misc_feature (274)..(274): n is a, c, g, or t
  modified_base (334)..(334): a, c, t, g, unknown or other
  misc_feature (334)..(334): n is a, c, g, or t
tcagactgtacagtcacgaccggtgctcgatttagtgctatagacttgggtttgggggagtcagacccactcaggacacagcatggacatgagggtccccgctcagctcctggggcttctgctgctctggctcccaggtgccaaatgtgccatccagttgacccagtctccatcctccctgtctgcctctgttcgagacatagtcaccatcacttgtcggctagtcgggtcattggcagtgctttagcctggtatcagcagaaaccgagggganctctaagctctgatctttgatgcctctagtttaggaaagtgactccatcgaagtcagcgnagtgatcgtgggactagtatttcactcctcaccagtcagcagcctgcagcctagaagtcttacgacgactaaactttatttacttacgtaactaaaaccgttaagtttaacggacctttaccctcttccgtcccggttcggggaacgggaagggacccgtaagggttcggaaagtaacgttaaccgaaaacggttaacgttgggacggtaacttcggacccttaccctaacgttccgtttcc

SEQ ID NO: 309255 - DNA, 645 bp, Homo sapiens
  misc_feature: GZ8MTXP01AUJCL.25.86.H09.1.454.CMB.2.raw
  modified_base (286)..(286): a, c, t, g, unknown or other
  misc_feature (286)..(286): n is a, c, g, or t
  modified_base (372)..(372): a, c, t, g, unknown or other
  misc_feature (372)..(372): n is a, c, g, or t
  modified_base (410)..(410): a, c, t, g, unknown or other
  misc_feature (410)..(410): n is a, c, g, or t
tcagactgtacagtcacgaccggtgctcgatttagtgctatagacttggggtttgggggagtcagacccactcaggacacagcatggacatgagggtccccgctcagctcctggggcttctgctgctctggctcccaggtgccaaatgtgccatccagttgacccagtctccatcctccctgtctgcctctgttcgagacatagtcaccatcacgttgtcgggctaggtcgggtcagttggcagttgctttagcctggtactcagacgaagaaaccgaggggaacnctacctaagctccgtgtattcgtttgatcgtccgtacgtaggtttaggaaagtggacgtccagtacgtaacggttccaggccgganaggtggatcgtagggacagtactttcactcctacaccntacagcacggtcctacggacagtaccgtaggaaactcttctacgtaacttaacctttaatttacgtacgttaaacgtaaacttaaacgtttaacggtaacctttaccctcgttccgttacccgggttccgggggaacggtaaacgggaccgtaaaggggttccgggaaataacgttaccgaaaacgttaccgttgggtacggttaaccacgaccgaaaccctttcgttccgttcg

SEQ ID NO: 309256 - DNA, 587 bp, Homo sapiens
  misc_feature: GZ8MTXP01BWXGK.25.86.H09.1.454.CMB.2.raw
  modified_base (276)..(276): a, c, t, g, unknown or other
  misc_feature (276)..(276): n is a, c, g, or t
  modified_base (403)..(403): a, c, t, g, unknown or other
  misc_feature (403)..(403): n is a, c, g, or t
tcagactgtacagtcacgaccggtgctcgatttagtgctatagacttgggtttgggggagtcagacccactcaggacacagcatggacatgagggtccccgctcagctcctggggcttctgctgctctggctcccaggtgccaaatgtgccatccagttgacccagtctccatcctccctgtctgcctctgttcgagacatagtcaccatcacttgtcgggctaggtcgggtcagttggcagtgctttagcctggtatcagcagaaaccagggganctcctaagctcctgatctttgatgcctcagtttggaagtggatcccatcgaaggttcagcgcagtggatcgtgggactagtatttcatcctcaccagtcagcagccctgcagcctagaagtcttcgnactaaccttattacttagtacctaaactaaagttttaacggactttaacccctcttccgttcccgttaggggaaccgggtaaggggaacccgtaaagggggttccggaaagtaacgttaaccgttaaaaaccgggaacctttcgggggcggtaaccgtcgtaccttaccgttaacgttcgttcg

SEQ ID NO: 309257 - DNA, 565 bp, Homo sapiens
  misc_feature: GZ8MTXP01BH5QU.25.86.H09.1.454.CMB.2.raw
  modified_base (275)..(275): a, c, t, g, unknown or other
  misc_feature (275)..(275): n is a, c, g, or t
  modified_base (383)..(383): a, c, t, g, unknown or other
  misc_feature (383)..(383): n is a, c, g, or t
  modified_base (537)..(537): a, c, t, g, unknown or other
  misc_feature (537)..(537): n is a, c, g, or t
  modified_base (558)..(558): a, c, t, g, unknown or other
  misc_feature (558)..(558): n is a, c, g, or t
tcagactgtacagtcacgaccggtgctcgatttagtgctatagacttgggtttgggggagtcagacccactcaggacacagcatggacatgagggtccccgctcagctcctggggcttctgctgctctggctcccaggtgccaaatgtgccatccagttgacccagtctccatcctccctgtctgcctctgttcgagacatagtcaccatcacttgtcggctagtcgggtcattggcagtgctttagctggtatcagcaagaaaccgaggggaanctactaagctcctgtatctttgatcgcctcgtagtttaggaaagtggacgtccatacgaacggttcaggcggcaggtggatcgtagggacagtatttcactcctcacntcagcagcctaggccagtcctagaatcttcgacgaccgtaactttattacgttactaactaaacttaagtttacgtacctttacccgtcttccgtcccggttcggggaacggttaacgggacgtaagggttgaagtaacgttacgaaacgttcnggtcggctacgacttaccgtnttcgtcg

SEQ ID NO: 309258 - DNA, 666 bp, Homo sapiens
  misc_feature: GZ8MTXP01ADJ8Z.25.86.H09.1.454.CMB.2.raw
  modified_base (280)..(280): a, c, t, g, unknown or other
  misc_feature (280)..(280): n is a, c, g, or t
tcagactgtacagtcacgaccggtgctcgatttagtgctatagacttggggtttgggggagtcagacccactcaggacacagcatggacatgagggtccccgctcagctcctggggcttctgctgctctggctcccaggtgccaaatgtgccatccagttgacccagtctccatcctccctgtctgcctctgttcgagacatagtcaccatcacgttgtcgggctaggtcgggtcattggctagtgctttagcctggtatcagcaagaaacgaggggaanctactaagctctgtatcttgatcgtcctcgtaggtttaggaaagtggacgtcccagtcgtaacggttcaggcggcgaggtggatcgtagggactagtactttcacgtcctacaccgtatacaggacccacgtcgtacgactacgtacgtagtaacttacttacgtacgtaaccgttaaacgtttatttacgttaacgttaaaccgtaaacgtttaaacgtttaaccgttaccctttacccgttccgttacccggttaccggggtcgggggaaccgggtaaacggggttaacggtaaggggttacgggtaaacgtaaacgttaaaccgggttaaacggttacggtcgggtacgtccgtacgtaccgttaccttaacgtttccgttcg

SEQ ID NO: 309259 - DNA, 666 bp, Homo sapiens
  misc_feature: GZ8MTXP01D5CUV.25.86.H09.1.454.CMB.2.raw
tcagactgtacagtcacgaccggtgctcgatttagtgctatagacttgggtttgggggcaggagtcagacccactcaggacacagcatggacatgagggtccccgctcagctcctggggcttctgctgctctggctcccaggtgccaaatgtgccatccagttgacccagtctccatcctccctgtctgcctctgttcgagacatagtcaccatcacttgtcgggctaggtcgggtcagttggcagtgctttagcctggtatcagcaagaaaccgaggggaacgctaccgtaagcctcctgacttctttgactcgcccttacgtaggtttaggaaaggtcggacgtacccctagtcgtaaaggttcgaggtccggaacaggttggactcggtacggggaactaggtactttcaacttccctacaccatcacgcacgccctaggcctacggacctaggaaacttcttcctagtacccttaaaccttatttaacgttacgtaactaaacgtttaaacgtttaacggtaccctttaaccccttccgttcccgttaaccggttaccggggacgggtaaacgggttaacccgtaaaggggttaggaacggttaacttaaccgaaaacggtacgtttgggaacggtcttacggtaaccgttaaccgttaacg

SEQ ID NO: 309260 - DNA, 582 bp, Homo sapiens
  misc_feature: GZ8MTXP01CCJOY.25.86.H09.1.454.CMB.2.raw
  modified_base (283)..(283): a, c, t, g, unknown or other
  misc_feature (283)..(283): n is a, c, g, or t
tcagactgtacagtcacgaccggtgctcgatttagtgctatagacttgggtttgggggagtcagacccactcaggacacagcatggacatgagggtccccgctcagctcctggggcttctgctgctctggctcccaggtgccaaatgtgccatccagttgacccagtctccatcctccctgtctgcctctgttcgagacatagtcaccatcacgttggtcgggctaggtcgggtctagttggcagtgctttagcctggtatcagacagaaaccgaggggaacnctcctaagctcctgattcgttgatcgtcctacgtaggtttaggaaacgtggacgtcccagtacgaacgggttcaggccggataggtggaactcggagggacctagtactttcactcctacaccatcgacgcgacgcccgtgaccgacgtccgtagaaacgtcttctacgtacctaactttattattacgtactaaacgtaagtttaacgacctttccctacgtcgttccgtacgggaacggaggttacgaggttgagacttaacgaacgagtgtacggctcgccttactaacttcgtcg

SEQ ID NO: 309261 - DNA, 636 bp, Homo sapiens
  misc_feature: GZ8MTXP01CKBWM.25.86.H09.1.454.CMB.2.raw
  modified_base (271)..(271): a, c, t, g, unknown or other
  misc_feature (271)..(271): n is a, c, g, or t
  modified_base (279)..(279): a, c, t, g, unknown or other
  misc_feature (279)..(279): n is a, c, g, or t
  modified_base (425)..(425): a, c, t, g, unknown or other
  misc_feature (425)..(425): n is a, c, g, or t
  modified_base (428)..(428): a, c, t, g, unknown or other
  misc_feature (428)..(428): n is a, c, g, or t
tcagactgtacagtcacgaccggtgctcgatttagtgctatagacttgggtttgggggagtcagacccactcaggacacagcatggacatgagggtccccgctcagctcctggggcttctgctgctctggctcccaggtgccaaatgtgccatccagttgacccagtctccatcctccctgtctgcctctgttcgagacatagtcaccatcacttggcggctagtcgggtcattggcagtgctttagcctggtatcagacgaagaaaccgnggggaacncctaccgtaagcctccgtgtacttctttgactcgccgtacgtaggtttaggaaagtcggacgtacccatcgtaaacggttccgaggcggcgtaggtaggaacttcggtaggggtaactaggtactttcactcctacaccatcagcngcngacagctagactctactagtactaacttattactagtaactaaacttaacgtttaacgtaccttacccgtcgttacccgttccggttacggggtaacgggaaccgggttaacggtaaacgggttacggtaaactaacggttaaaccgttaaaacgggttacgtcggttacggaacgtacgaccgttacgttaaccgttcgtttaaccg

SEQ ID NO: 309262 - DNA, 648 bp, Homo sapiens
  misc_feature: GZ8MTXP01CYEWG.25.86.H09.1.454.CMB.2.raw
tcagactgtacagtcacgaccggtgctcgatttagtgctatagacttgggtttggggagctctgggaaaggagccccagccctgagattcccaggtgattccattcggtgatcagcactgaacacagaactcaccatggagtttggactgagctgggttttccttgttgcctattttaaaaggtgtccagtgtgaagtgcaactggtggagtcgtgggggagcgtggtacaggccggggggtcctggagactctcctgtgtagcctctggattcatgtttgatgattatcgccatgcacgtgggtccgtcgaaggtccggggaaggtcgtggagtgggtcttctcgttagtcgtacgttgggacgtaggggaagaaaggtaacctaacgtagtacgacaaggtactcgtgggtagaaggggtctaagttccacctactaccgaagacgaacaacaatacgaaacgtactccctagtactcgtagacgtaaagtcggaactacgtcgtacgaccgtaccgtagtactacggacctaaccgtccttaagttaacgtttaggttagttagggttaaggtaaacgggttcgggttgttagggtaaggtagtaacgttcggacccggttacgggaacccccgttggtaacccg

SEQ ID NO: 309263 - DNA, 610 bp, Homo sapiens
  misc_feature: GZ8MTXP01BT96R.25.86.H09.1.454.CMB.2.raw
  modified_base (282)..(282): a, c, t, g, unknown or other
  misc_feature (282)..(282): n is a, c, g, or t
  modified_base (369)..(369): a, c, t, g, unknown or other
  misc_feature (369)..(369): n is a, c, g, or t
tcagactgtacagtcacgaccggtgctcgatttagtgctatagacttggggtttggggggagtcagacccactcaggacacagcatggacatgagggtccccgctcagctcctggggcttctgctgctctggctcccaggtgccaaatgtgccatccagttgacccagtctccatcctccctgtctgcctctgttcgagacatagtcaccatcacttggtcgggctaggtcgggtcagttggcagtgctttagctggtatcagcaagaaaccgaggggaacnctccgtaagctcctgtattctttgatcgcctcgtaggttttggaaagtggacgtcccatcgaacggttcaggcggcaggtggatcgnggggactagtactttcacttcctacacctatcagcagcctgcagcctagaacgtacttcgtacgactaaactttagtttacttacgtaactaaaccttaaagtttaacggtacctttaccccttcttcccgttaccggttcgggggaaccgggtacgggaaccgtaagggttacgggaacgtaacgttaacccgaaaaggttaccgtggtcgggtaacctcggaccactaacgttcttccg

SEQ ID NO: 309264 - DNA, 732 bp, Homo sapiens
  misc_feature: GZ8MTXP01CCKRY.25.86.H09.1.454.CMB.2.raw
  modified_base (295)..(295): a, c, t, g, unknown or other
  misc_feature (295)..(295): n is a, c, g, or t
tcagactgtacagtcacgaccggtgctcgatttagtgctatagacttggggtttgggggagtcagacccactcaggacacagcatggacatgagggtccccgctcagctcctggggcttctgctgctctggctcccaggtgccaaatgtgccatccagttgacccagtcctccatcctccctgtctcgcctctgttcgagacatagtcaccatctacgttggtcgggctaggtcgggtcagttggctaggtgtctttagccgtggtatcgagacgaacggaaaccgaggggaacncctaccgtaagtccttccgtagtactttcgttagtacttcgtcccttaccggttaaagggttttaggggaaaaggttcgggtaaccgtaccccgtaaagttaccggtaaacgggttcgaagggccggtacgtagggtaacgggacttcggtaggggaacctaagtctttacacttcctacacatcgaacgcgacgtccctaggaccgtagccgttagaacgtattcgtactaaccgttaaacctttagtttaacgtaccggttaaactaaaacgtttaaacggtttaacgtaacccttttccctccgtttacccgttccgggtacccgggaacgggggtaacggttaacgtaaaggggttaccggaaagtacgttaaacccggttaaagttaccgttggtcgtaaccgtacgacccttaccgttaagttccctttcg

SEQ ID NO: 309265 - DNA, 742 bp, Homo sapiens
  misc_feature: GZ8MTXP01ECZW1.25.86.H09.1.454.CMB.2.raw
tcagactgtacagtcacgaccggtgctcgatttagtgctatagacttgggtttgggggcaggagtcagacccactcaggacacagcatggacatgagggtccccgctcagctcctggggcttctgctgctctggctcccaggtgccaaatgtgccatccagttgacccagtctccatccctccctgtctgcctctgttcgagacatagtccaccatctacttggtcgggctaggtcgggtcagttggcagtgtcttagcctggtatcgagacgaagaaaccggaggggaacgcctaccgtaaagcctccctgtacttcgtttagctcgtccccttacgttaggtttaggaaacggtggaccgtcccctaagtaccgtaaagggttcaacgggccgggtaactaagggtgggtactacgggtaggggtaactaaggttactttacaccttccctacaacctatacgacgctaaccggcccttaggccaacgtcccgtaaggtaaactctttacgggtacgtaacccttaaacctttaaggtttacttaagtaaccttaaaaacgtttaaacgttttaacggtaccctttaaccccgttcgttaccccggttaaccggttaccgggggaaccgggtaacgggttaaacccgggttaaagggtacgggttaaacggttaccaaaaccggtaaaacccggttaggttcggtacggggtaccttacgggccccttaaaccctttcgg

SEQ ID NO: 309266 - DNA, 596 bp, Homo sapiens
  misc_feature: GZ8MTXP01C4PZH.25.86.H09.1.454.CMB.2.raw
  modified_base (277)..(277): a, c, t, g, unknown or other
  misc_feature (277)..(277): n is a, c, g, or t
  modified_base (379)..(379): a, c, t, g, unknown or other
  misc_feature (379)..(379): n is a, c, g, or t
  modified_base (396)..(396): a, c, t, g, unknown or other
  misc_feature (396)..(396): n is a, c, g, or t
tcagactgtacagtcacgaccggtgctcgatttagtgctatagacttggggtttggggggagtcagacccactcaggacacagcatggacatgagggtccccgctcagctcctggggcttctgctgctctggctcccaggtgccaaatgtgccatccagttgacccagtctccatcctccctgtctgcctctgttcgagacatagtcaccatcacttgtagggctagtcgggtcattggcagtgcttagctggtatcagacagaaaccgaggggaanctacctaagctcctgatcttgatcgcctcgtagtttaggaaagtggacgtccatcgaaggttcaggcggcaggtaggatcgtagggacagtatttcacttcncacctatcagcagtccngacacgactagatacttctacgaccgttaaacttatttaacttacgtaaactaaacgttaaacgtttaacgtaaccttacccttcgttaccgttaccgggtacggggaacgggtaacgggaacggtaagggttacggaaacgtaacgttaaacgaaacggttacgtaaggtcgtcgtacgacttacgtaacgttcgttcg

SEQ ID NO: 309267 - DNA, 758 bp, Homo sapiens
  misc_feature: GZ8MTXP01CGOY2.25.86.H09.1.454.CMB.2.raw
  modified_base (277)..(277): a, c, t, g, unknown or other
  misc_feature (277)..(277): n is a, c, g, or t
tcagactgtacagtcacgaccggtgctcgatttagtgctatagacttgggtttgggggagtcagacccactcaggacacagcatggacatgagggtccccgctcagctcctggggcttctgctgctctggctccaggtgccaaatgtgccatccagttgacccagtctccatcctcctgtctgcctctgttcgagacatagtcacatcacttggcggctagtcgggtcattggctagtgcttagcctggtatcgagccaagaaacccgaggggtaancctaccgtaaagtccttaccgtaggtatttccgttttaggaacttcggtacccctttaccggtaagggtttttaagggaaaacggtttggaaccgttaccccaagttacccgtaaaagggtttccgaaacggcgggtaccgtaggttaacgggaatttccggtaggggaaacctagttaacttttcggaactttcccctaactaacccatacggaacggccaacgggttcccgacgacgtacgtacgtacgtacgtacgttacgtacgtaccgttaacttaactttaacgttacgttaacttaaacgttaaacgtttaaacgttaaccttacccgttacccgttacccgttacccggttaccgggtaaccgggtaaccgggttaacgggtaacgggttaacggtaacggtaacgttaaccgttaaacggttaacggtaacggtacggtaacgtacgtaccgttaccgttaacgttcgttcg

SEQ ID NO: 309268 - DNA, 599 bp, Homo sapiens
  misc_feature: GZ8MTXP01A0KQR.25.86.H09.1.454.CMB.2.raw
  modified_base (280)..(280): a, c, t, g, unknown or other
  misc_feature (280)..(280): n is a, c, g, or t
  modified_base (358)..(358): a, c, t, g, unknown or other
  misc_feature (358)..(358): n is a, c, g, or t
  modified_base (368)..(368): a, c, t, g, unknown or other
  misc_feature (368)..(368): n is a, c, g, or t
  modified_base (567)..(567): a, c, t, g, unknown or other
  misc_feature (567)..(567): n is a, c, g, or t
  modified_base (590)..(590): a, c, t, g, unknown or other
  misc_feature (590)..(590): n is a, c, g, or t
tcagactgtacagtcacgaccggtgctcgatttagtgctatagacttggggtttggggggagtcagacccactcaggacacagcatggacatgagggtccccgctcagctcctggggcttctgctgctctggctcccaggtgccaaatgtgccatccagttgacccagtctccatcctccctgtctgcctctgttcgagacatagtcaccatcacttgtcgggctagtcgggtcagttggctagtgctttagcctggtatcagacaagaacgagggaacnctacctaagctcctgtacttcgttgatcgtcctcgtaggtttaggaagtggtacgtccatacgtacggttcgagcggnaggtgatcgngggactagtacttcactctacactatcgagtcacgtccctagaccgacgtccgttaagaattacttctacgaacttaacccttagttacttacggtaaactaaacgttaacgtttaacggtaccctttacccgtcgttacccgtccgggttcgggaacgggtacggttacgaaggttcgaaagtacttaaacggttaangttggcggcttcggaccttactnttccgtaac

SEQ ID NO: 309269 - DNA, 615 bp, Homo sapiens
  misc_feature: GZ8MTXP01C03LF.25.86.H09.1.454.CMB.2.raw
  modified_base (222)..(222): a, c, t, g, unknown or other
  misc_feature (222)..(222): n is a, c, g, or t
  modified_base (282)..(282): a, c, t, g, unknown or other
  misc_feature (282)..(282): n is a, c, g, or t
  modified_base (421)..(421): a, c, t, g, unknown or other
  misc_feature (421)..(421): n is a, c, g, or t
tcagactgtacagtcacgaccggtgctcgatttagtgctatagacttggggtttgggggagtcagacccactcaggacacagcatggacatgagggtccccgctcagctcctggggcttctgctgctctggctccaggtgccaaatgtgccatccagttgacccagtctccatcctccctgtctgcctctgttcgagacatagtcacatcacttggtcgggntaggtcgggtcagttggcagtgtctttagcctggtatcagacaagaaaccgaggggaacnctacctaagctcctgtattctttgatcgcctcgtaggtttaggaagtggactccatacgaacggttcaggcggcaggtggatcgagggacaggtacttcgactcctcaccatcagcacgtccagcagtccgtagaactnttcacgtacttaaacttatttaacgtacgtaactaaacgttaagtttaacgtacctttccctcgttaccgttccggtttcggggaacgggtaacggggaaccgttaaggggacggtaaacgtaacgttaaaccgttaaacggttaacgttggtaccgggtcttacggaccttaacccgtttcgttccgttaacg

SEQ ID NO: 309270 - DNA, 525 bp, Homo sapiens
  misc_feature: GZ8MTXP01A1B65.25.86.H09.1.454.CMB.2.raw
  modified_base (218)..(218): a, c, t, g, unknown or other
  misc_feature (218)..(218): n is a, c, g, or t
  modified_base (277)..(277): a, c, t, g, unknown or other
  misc_feature (277)..(277): n is a, c, g, or t
  modified_base (329)..(329): a, c, t, g, unknown or other
  misc_feature (329)..(329): n is a, c, g, or t
  modified_base (502)..(506): a, c, t, g, unknown or other
  misc_feature (502)..(506): n is a, c, g, or t
  modified_base (508)..(525): a, c, t, g, unknown or other
  misc_feature (508)..(525): n is a, c, g, or t
tcagactgtacagtcacgaccggtgctcgatttagtgctatagacttggggtttgggagaagaacctactatgcagactctgtgaagggtcgattcaccacctccagagacaacatcaagaactccctgtatctgcaaatggacagtctgacacctgatgacaccgccttgtattattgtgtgaaaggcggtgtgaggtgaatgcctggaacccccgnggtcagcactacttctacagtgggcgtcgtgggggacaaaagggctacggtcatcgtcncctcacgccctaccaccgaaacggccccatcccggtccttcccccgtggccncccctgctcccgaggacgccacctccggagacgccaccgacgcccgggccgtggggcctcggacccgttcgggtaaccgaaagggtacccttacccttaccccaacgttcggtaacctacgtccgttggaacgggcgggggtcgttgggacgaaacggggccgtactaagagnnnnngnnnnnnnnnnnnnnnnnn

SEQ ID NO: 309271 - DNA, 610 bp, Homo sapiens
  misc_feature: GZ8MTXP01E2C9T.25.86.H09.1.454.CMB.2.raw
  modified_base (225)..(225): a, c, t, g, unknown or other
  misc_feature (225)..(225): n is a, c, g, or t
  modified_base (432)..(432): a, c, t, g, unknown or other
  misc_feature (432)..(432): n is a, c, g, or t
  modified_base (437)..(437): a, c, t, g, unknown or other
  misc_feature (437)..(437): n is a, c, g, or t
tcagactgtacagtcacgaccggtgctcgatttagtgctatagacttggggtttgggggagtcagacccactcaggacacagcatggacatgagggtccccgctcagctcctggggcttctgctgctctggctcccaggtgtcaaatgtgccatccagttcgacccagtctccactcctccctgtctgcctctgttcgagacatagtcaccatcacttgtcgggntagtcgggtcagttggctaggttgtactttagccgttggtaactcagacgaacgaaaccggaggggaactcctaccgtaacgccttccgtagtactttcgtttagactcgtaccctacgtagtttagggaagtcgacgtacccagtaccgtaaggtcgaggtccgagaggtcggtatcgtagggcaagtactttcactctacaccancagcncgtcgagctacgtacagactctacataaccgttaaacttagttaatacgtaaactaaagttaacgttacgtacccttacctctacgtccggtacgggaacggtaacgggagtaggacgtaacgtaacaacgttaacgttacgtggcgtaacgtcgtacttacttcgttcgtcg

SEQ ID NO: 309272 - DNA, 650 bp, Homo sapiens
  misc_feature: GZ8MTXP01B0LE0.25.86.H09.1.454.CMB.2.raw
  modified_base (286)..(286): a, c, t, g, unknown or other
  misc_feature (286)..(286): n is a, c, g, or t
tcagactgtacagtcacgaccggtgctcgatttagtgctatagacttggggtttgggggcaggagtcagacccactcaggacacagcatggacatgagggtccccgctcagctcctggggcttctgctgctctggctcccaggtgccaaatgtgccatccagttgacccagtctccatcctccctgtctgcctctgttcgagacatagtcaccatcacttggtcgggctaggtcgggtcagttggcagtgctttagcctggtatcagcaagaaaccgaggggaacncctactaacgctcctgtacttcgttgactcgtcctacgtaggtttaggaagtcggtacgtcctacgtacgtaaggttcgaggcgaacgtaggtggacgtcggtagggtactaggttactttacacttccctacaacctactcgaccgcgaacccggcccggactacgggtcctaggaaacttctttaccggacgtaaaccttaacctttagttaacttacgtaaacctaaaccgtttaaagtttaaccgtaaccttccccgttactccgttcggtaaccgggtacgggaacgggaccgttagggtacgaattaccgttaacgaaacgttccgtaggtcgtcggtacgacctaaccgttcgttcg

SEQ ID NO: 309273 - DNA, 706 bp, Homo sapiens
  misc_feature: GZ8MTXP01B9SUZ.25.86.H09.1.454.CMB.2.raw
  modified_base (279)..(279): a, c, t, g, unknown or other
  misc_feature (279)..(279): n is a, c, g, or t
tcagactgtacagtcacgaccggtgctcgatttagtgctatagacttgggtttgggggcaggagtcagacccactcaggacacagcatggacatgagggtccccgctcagctcctggggcttctgctgctctggctcccaggtgccaaatgtgccatccagttcgacccagtctccatcctccctgtctgcctctgttcgagacatagtcacatcacttgtcgggctagtcgggtcagttggcagtgtcttagcctggatcagcgaagaaccgaggganctacagctctgatcttgatcgtcctacgtaggtttaggaaacgtggtacgtacccagtaccgtaaaggttcgacggcggtaacgtacgggttgggacgttcgggtacggggtaacgtaggttactttaccaaccttccctaacacccgtattcgaacgccgaacgtccgtaggtaccgaacgtacccgttaagggaaacgttactttccggtacgttaaaccttaaaccctttatttaacgttaactaaccgttaaaacctttaaagttttaaccggtacccttttaccccgttccttcccggttaacccgggttacgggggaaccgggtaaacgggaaccgtaaagggggttcgaaaacgttccgttaaacgtaaaccggttacgtcgggggttcaccgttacggaacccgttaaccgtttaaccg

SEQ ID NO: 309274 - DNA, 445 bp, Homo sapiens
  misc_feature: GZ8MTXP01A7RJT.25.86.H09.1.454.CMB.2.raw
  modified_base (200)..(200): a, c, t, g, unknown or other
  misc_feature (200)..(200): n is a, c, g, or t
  modified_base (218)..(218): a, c, t, g, unknown or other
  misc_feature (218)..(218): n is a, c, g, or t
  modified_base (356)..(356): a, c, t, g, unknown or other
  misc_feature (356)..(356): n is a, c, g, or t
  modified_base (371)..(371): a, c, t, g, unknown or other
  misc_feature (371)..(371): n is a, c, g, or t
  modified_base (434)..(438): a, c, t, g, unknown or other
  misc_feature (434)..(438): n is a, c, g, or t
  modified_base (440)..(445): a, c, t, g, unknown or other
  misc_feature (440)..(445): n is a, c, g, or t
tcagactgtacagtcacgaccggtgctcgatttagtgctatagacttgggtttgggagaagaacctactatgcagactctgtgaagggtcgattcaccacctccagagacaacatcaagaactccctgtatctgcaaatggacagtctgacacctgatgacaccgccttgtattattgtgtgaaaggcggtgttgaggtnaatgcctggaacccccgnggtcagcactacttctacatgggcgtctgggggcaaaagggactacggtcatcgtctcctcagcctccaccaagggccccatcggtccttccccctggccgcccctcgctcccgaggacgccacctccgagacgcacncgccggcctggggcncgcctggcaaaggctactccactgtacagtctgacggcgggctggcgaagggtcgacagtagnnnnngnnnnnn

SEQ ID NO: 309275 - DNA, 619 bp, Homo sapiens
  misc_feature: GZ8MTXP01AKIR8.25.86.H09.1.454.CMB.2.raw
  modified_base (189)..(189): a, c, t, g, unknown or other
  misc_feature (189)..(189): n is a, c, g, or t
  modified_base (289)..(289): a, c, t, g, unknown or other
  misc_feature (289)..(289): n is a, c, g, or t
  modified_base (396)..(396): a, c, t, g, unknown or other
  misc_feature (396)..(396): n is a, c, g, or t
  modified_base (413)..(413): a, c, t, g, unknown or other
  misc_feature (413)..(413): n is a, c, g, or t
  modified_base (469)..(469): a, c, t, g, unknown or other
  misc_feature (469)..(469): n is a, c, g, or t
  modified_base (607)..(607): a, c, t, g, unknown or other
  misc_feature (607)..(607): n is a, c, g, or t
tcagactgtacagtcacgaccggtgctcgatttagtgctatagacttgggtttgggggagtcagacccactcaggacacagcatggacatgagggtccccgctcagctcctggggcttctgctgctctggctcccaggtgccaaatgtgccatccagttgacccagtctccatcctccctgtctgcctntgttcgagacatagtccaccatcacgttggtcgggctagtcgggtcagttgactagtgtctttacgcctggtactcagcaaggaaaccggagggggaacnctaccgtaagtcctaccgtgtactttctttagatcgtcctacgtaggtttaggaagtggacgtccatcgaacgttcgaggcgacgaggtggatcggtaggactagtntttccatccctacaccntcagtcacgccgtagcacgtaccgtagaaacgtcttaccgtactacctaaacgttntttatacgtaaactaaacgttaagtttaacgaccctttacctccgttacctcccggttcggggaacgggtaacgggttacgaaacgggttgaaacgtacgttaaccgaaaggttcgtaagtcgaacgttcacttactnttccgttaaccg

SEQ ID NO: 309276 - DNA, 579 bp, Homo sapiens
  misc_feature: GZ8MTXP01BKTXH.25.86.H09.1.454.CMB.2.raw
  modified_base (190)..(190): a, c, t, g, unknown or other
  misc_feature (190)..(190): n is a, c, g, or t
  modified_base (286)..(286): a, c, t, g, unknown or other
  misc_feature (286)..(286): n is a, c, g, or t
  modified_base (442)..(442): a, c, t, g, unknown or other
  misc_feature (442)..(442): n is a, c, g, or t
  modified_base (572)..(572): a, c, t, g, unknown or other
  misc_feature (572)..(572): n is a, c, g, or t
tcagactgtacagtcacgaccggtgctcgatttagtgctatagacttggggtttgggggagtcagacccactcaggacacagcatggacatgagggtccccgctcagctcctggggcttctgctgctctggctcccaggtgccaaatgtgccatccagttgacccagtctccatcctccctgtctgcctntgttcgagacatagtcacatcacgttggtcgggctaggtcgggtcagttggctagtgctttagcctggtatcagacaaggaaaccgagggggaacnctaccgtaagcctccgtgtactttctttgatcgtcccttacgtaggtttagggaaagtcggactccagtccgaaaggttcaggcggcaggtggactcgtagggactagtatttccacttcccacaccatcgagccagcctagcacgcctagaactnttcgtacactaacttattactacgtaactaaactaagtttaacgtaccttaccctcgttcctccgtcgggaacggaacggacgtaaggttgaacgtaacttacgaaacgcggttgacggcctagccactnttcgttc

SEQ ID NO: 309277 - DNA, 618 bp, Homo sapiens
  misc_feature: GZ8MTXP01CQCYE.25.86.H09.1.454.CMB.2.raw
  modified_base (275)..(275): a, c, t, g, unknown or other
  misc_feature (275)..(275): n is a, c, g, or t
  modified_base (297)..(297): a, c, t, g, unknown or other
  misc_feature (297)..(297): n is a, c, g, or t
tcagactgtacagtcacgaccggtgctcgatttagtgctatagacttgggtttgggggagtcagacccactcaggacacagcatggacatgagggtccccgctcagctcctggggcttctgctgctctggctcccaggtgccaaatgtgccatccagttgacccagtctccatcctccctgtctgcctctgttcgagacatagtcacatcacttgtcggctagtcgggtcagttggcagtgctttagcctggtatcagcaagaaaccgagggganctactaagctcctgatctttgntgcctcgtaggtttaggaagtggacgtccatcaacggttcaggcgcagtgatcgtgggacagtacttcactcctacaccatcacgcaacgtccctagaccgagtccgttagaaacgttacttacctacgacttaaacctttagtttaacttacgtaactaaacttaaacgttttaacggtaacctttacccctcttaccgttccggtttcggggaacgggtaacgggaaccggtaaggggttaggttaaacgaacgttaaccgaaacggttaaaccgttgggtcggtcttcggaccgttaccttaacgttccgttttaacg

SEQ ID NO: 309278 - DNA, 762 bp, Homo sapiens
  misc_feature: GZ8MTXP01AZ0TM.25.86.H09.1.454.CMB.2.raw
tcagactgtacagtcacgaccggtgctcgatttagtgctatagacttggggtttgggggagtcagacccactcaggacacagcatggacatgagggtccccgctcagctcctggggcttctgctgctctggctcccaggtgccaaatgtgccatccagttcgacccagtctccatcctccctgtctgcctctgttcgagacatagtcacctatcacgttggtcgggctaggtcgggtcagttggctagttcgtctttacgccgttggtatcgagacaacggaaaccgaggggaacgctacctaagcctcctgtacttcgtttgactcgtcccgttacgtagggttttagggaaaggttcggaaccgtaccctaagtaccgtaacggttccgaagggccgggtactaggttaacggacgttccgggtaggggtaaccctagggttaacctttaccgaccttaccccttaccaacctactaccgacggacctaacggccccttaggaccctaaggtaccccgttaaggtaaacgttacttaccgtacgtaaacctttaaaacctttagggttttaaacttacgggttaaaccctaaaagtttaaacgttttaaaccgggtacccttttaccccctaacgttcccggttaccgggttccgggggaacgggtaaacgggttaccggtaaagggttagaaaccgggtaacttaaaccggaaacggttccgtggtacggctacgccttaacgttcgttaacctttccg

SEQ ID NO: 309279 - DNA, 779 bp, Homo sapiens
  misc_feature: GZ8MTXP01AQBXG.25.86.H09.1.454.CMB.2.raw
  modified_base (290)..(290): a, c, t, g, unknown or other
  misc_feature (290)..(290): n is a, c, g, or t
tcagactgtacagtcacgaccggtgctcgatttagtgctatagacttggggtttgggggagtcagacccactcaggacacagcatggacatgagggtccccgctcagctcctggggcttctgctgctctggctcccaggtgccaaatgtgccatccagttcgacccagtctccatcctccctgtctgcctctgttcgagacatagtcacatcacgttgtcggctaggtcgggtcagttggcagttcgtctttacggcctggtatcagacgaacggaaaccgaggggaacncctaccgtaagtccttcctgtactttcgtttagacgttcgtacccgttacgtaagggttttacggaaaacggttcggtaaaccgttcccctaaagttaccgtaaacggggtttaccgaagggtccggtacgtaagggtcgggtaacttccgggtaggggaaacctagggttaacttttccacgttacccctaccgaaaccccttaagtaccgtacggtccgtaccggtcccgtacggacctaccggtaccgtaaaggtaacgttaccgtttaccgtaaccgttaaaccctttaaacgtttaagtttaacgttaaccgttaaacttaaaacgtttaaacgtttaaccggttacccctttaccccgttcgttacccgttaccgggtaccgggggtaacgggtaaacgggttaaccggtaagggttacgaaacgtaacttaaaccggttaaacgttcggtcggtcgccgtacgaccttacgttcgttcgtcg

SEQ ID NO: 309280 - DNA, 856 bp, Homo sapiens
  misc_feature: GZ8MTXP01E0N14.25.86.H09.1.454.CMB.2.raw
tcagactgtacagtcacgaccggtgctcgatttagtgctatagacttgggtttggggggagtcagacccactcaggacacagcatggacatgagggtccccgctcagctcctggggcttctgctgctctggctcccaggtgccaaatgtgccatccagttgacccagtctccatcctccctgtctgcctctgttcgagacatagtcaccatcacttggtcgggctaggtcgggtcagttggctaggtgtctttagcctggtatcgagacgaagaaaccggaggggaacgcctacctaagcctaccgtgtacttctttgacttcgtcccttaccgtaagggttttagggaaacggttcgggtaccgtaccccgaagtttaccggtaaaaccggggtttcgaacgggtccggggaccgtagggtacgggtaacgttcggttacgggggaaaccttagggttacttttaccgtaacttcccctacccgtaaccctaaacttccgaacgggtccaaccgggtcccttaacgggacccgtaacggggtaccccttaaaggggaaacgttaccgtttacctaaccggtaacccgtttaaaacccgttttattttaaaccggtttaaccgttaaacccttaaaaccgtttaaaacggttttttaaaccgggtaacccctttttaaaccccctccgtttccccgggttacccgggtttaccggggggaacccgggggtaaacggggtttaaacccgggaaagggggtttaggaaacggtaaaccgttaaacccggttaaaacgggttaccgttggggttacggcccttagggaccccttaaacgttaacggtttccgtttcccg

SEQ ID NO: 309281 - DNA, 573 bp, Homo sapiens
  misc_feature: GZ8MTXP01E5IXU.25.86.H09.1.454.CMB.2.raw
  modified_base (284)..(284): a, c, t, g, unknown or other
  misc_feature (284)..(284): n is a, c, g, or t
  modified_base (294)..(294): a, c, t, g, unknown or other
  misc_feature (294)..(294): n is a, c, g, or t
  modified_base (303)..(303): a, c, t, g, unknown or other
  misc_feature (303)..(303): n is a, c, g, or t
  modified_base (386)..(386): a, c, t, g, unknown or other
  misc_feature (386)..(386): n is a, c, g, or t
  modified_base (427)..(427): a, c, t, g, unknown or other
  misc_feature (427)..(427): n is a, c, g, or t
tcagactgtacagtcacgaccggtgctcgatttagtgctatagacttggggtttgggggcaggagtcagacccactcaggacacagcatggacatgagggtcccgctcagctcctggggcttctgctgctctggctcccaggtgccaaatgtgccatccagttgacccagtctccactcctccctgtctgcctctgttcgagacatagtcaccagtcacttggtcgggcttaggtcgggtctagttggcagtgtctttagcctggatcagcaagaacgaggganctcaagctcngatctttgntcgcctctaggttagaaagtggactacccagttacgaaggtcagcggtacagggtgatcgagggtacagtattcactccctanaccatacgagcgaaccgcccgtacacgccgttagaaacgtnttactcggacaaacctttattacgttattaaaccaaacttaaagttaacgtacctacccttctcccgttcgtccgggaggaacgggaccgttaaaggtgaagacgttaacaaagaacctggtcggtctcgacctaaccttaagttc

SEQ ID NO: 309282 - DNA, 752 bp, Homo sapiens
  misc_feature: GZ8MTXP01BPG3R.25.86.H09.1.454.CMB.2.raw
  modified_base (283)..(283): a, c, t, g, unknown or other
  misc_feature (283)..(283): n is a, c, g, or t
tcagactgtacagtcacgaccggtgctcgatttagtgctatagacttgggtttgggggagtcagacccactcaggacacagcatggacatgagggtccccgctcagctcctggggcttctgctgctctggctcccaggtgccaaatgtgccatccagttgacccagtctccatcctccctgtctgcctctgttcgagacatagtcaccatcacttgtcgggctaggtcgggtcagttggcagtgctttagcctggtatcgagacaaggaaaccgaggggaacnctacctaagctcctgtacttctttgactcgtcccttaccgtaagggttttagggaaaggttcggtaacgtaccccgtaagttaccgtaaacggggttccgaggtccgggacgtaagggtacgggtaacgttccggtaggggtaacctagggttacctttaccaaccttccccttacccgaaaccctattacccgaacggacccgtaaccggtcccgttagggaccctaacgggtaccccgttaaggtaaaacggttactttaccggtaaccgtaaccgttaaaaccctttttaagtttaacttaacggttaaactaaaacgttaacgttttaaaccggaccttttaccccgtactttcccgttcccggttcggggaacgggtaacggggttaaccctaaggggttaggaaacgtaacgttaacgaaacggttaccgtggtcggtctccgacttacctaagttcctttcg

SEQ ID NO: 309283 - DNA, 704 bp, Homo sapiens
  misc_feature: GZ8MTXP01A2H30.25.86.H09.1.454.CMB.2.raw
  modified_base (343)..(343): a, c, t, g, unknown or other
  misc_feature (343)..(343): n is a, c, g, or t
  modified_base (461)..(461): a, c, t, g, unknown or other
  misc_feature (461)..(461): n is a, c, g, or t
tcagactgtacagtcacgaccggtgctcgatttagtgctatagacttgggtttggggagctctgggaaaggagccccagccctgagattcccaggtgattccattcggtgatcagcactgaacacagaactcaccatggagtttggactgagcttgggttttccttgttgcctaattttaaaaggtgtccagtgtgaagtgcaactggtggagtcgtgggggagccggtggtacgagggccggggggtcctgagactctcctgtgtagcctctggattcagttgtttgatgtattatgccattgctacgtgggtcccgtgaacggggtccgggggaaggtcgngggtaggttggggtactcttcgtagtcgtagttggggattccggggaagaaacgtaacctataatcgacaagacctgtggtaggaagggtacgtattccaaacccacctacgaagaanaaccaaagactaccaaagtaaccctcctagtaaactcctaggactaaaagttcgggaacctaggttacctcgaacctaccttaggaacgtacccgaccctaaccccgggttcttttaagtttaatttaggttagggttacgggttaaagggggtaacgggtttcggggttgttaaggggtaaggttacccgtaacgggttcccgggaccccggttaccccggggaacccccggttggtaaccg

SEQ ID NO: 309284 - DNA, 869 bp, Homo sapiens
  misc_feature: GZ8MTXP01CYOF7.25.86.H09.1.454.CMB.2.raw
  modified_base (189)..(189): a, c, t, g, unknown or other
  misc_feature (189)..(189): n is a, c, g, or t
tcagactgtacagtcacgaccggtgctcgatttagtgctatagacttgggtttgggggagtcagacccactcaggacacagcatggacatgagggtccccgctcagctcctggggcttctgctgctctggctcccaggtgccaaatgtgccatccagttgacccagtctccatcctccctgtctgcctntgttcgagacatagtcaccatcacttgtcgggctagtcgggtctattggctagtgtctttagcctggtactcagacaaggaaaccgagggggaactcctaccgtaagccttccgttagtactttccgtttagaacgttcgtaccccgttaccgttaagggtttttaaggggaaaacgggttcgggtaaaccgttcccccgtaaagttacccggtaaaacggggtttccgaaacgggtcccggggaccttaaggggttacgggtaacgtttcccgggtagggggtaaacctaagggttacttttacccaacgttcccctacctaaccctaagttaccgaacggacccgtaacggtccccgttaggacccgtaacgggtaccccgttaaagggtaaacgttaactttacccgttacgggtaacccgtttaaaacccgttttattttaaacgtttaaccggtttaaacctaaaaaccgtttaaaccgtttttaaacgggtaacccttttaaccccttccgtttaacccgttccccgggttaccgggggtaaccggggtaaacgggggttaaccccgggtaaagggggtttacgggaaaacggggttaaccttaaccgggttaaaaccgttaacggttgggtaaccgggtcttacgggacccttacggtaaccttcgttttccg

SEQ ID NO: 309285 - DNA, 584 bp, Homo sapiens
  misc_feature: GZ8MTXP01BLWSR.25.86.H09.1.454.CMB.2.raw
  modified_base (219)..(219): a, c, t, g, unknown or other
  misc_feature (219)..(219): n is a, c, g, or t
  modified_base (356)..(356): a, c, t, g, unknown or other
  misc_feature (356)..(356): n is a, c, g, or t
  modified_base (547)..(547): a, c, t, g, unknown or other
  misc_feature (547)..(547): n is a, c, g, or t
  modified_base (549)..(549): a, c, t, g, unknown or other
  misc_feature (549)..(549): n is a, c, g, or t
  modified_base (553)..(553): a, c, t, g, unknown or other
  misc_feature (553)..(553): n is a, c, g, or t
  modified_base (555)..(555): a, c, t, g, unknown or other
  misc_feature (555)..(555): n is a, c, g, or t
  modified_base (557)..(584): a, c, t, g, unknown or other
  misc_feature (557)..(584): n is a, c, g, or t
tcagactgtacagtcacgaccggtgctcgatttagtgctatagacttgggtttgggagaagaacctactatgcagactctgtgaagggtcgattcaccacctccagagacaacatcaagaactccctgtatctgcaaatggacagtctgacacctgatgacaccgccttgtattattgtgtgaaaggcggtgttgaggtgaatgcctcggaacccccgnggtcagcactacttctacagtgggcgtgtgggggacaaagggctacggtcagtcgtctcctcacgccctaccaaccgaaacgggcccctagttcccggtcccttccccccgtggcccgacccctgcctccgaggacnccaccgtcgagacgcacgtaccggccggtccgtggggcctcggtaccccgttagggttaaccgaaacgggtaccctttaaccttaccccgaacgtttcggtaaacctacgggttcccgttaggggaaccgggtccggggggaccgttacgggggaaccctaaaacggggggccccttaaacgtaaagtcgngngagngngnnnnnnnnnnnnnnnnnnnnnnnnnnnn

SEQ ID NO: 309286 - DNA, 700 bp, Homo sapiens
  misc_feature: GZ8MTXP01A5BZL.25.86.H09.1.454.CMB.2.raw
  modified_base (304)..(304): a, c, t, g, unknown or other
  misc_feature (304)..(304): n is a, c, g, or t
  modified_base (480)..(480): a, c, t, g, unknown or other
  misc_feature (480)..(480): n is a, c, g, or t
tcagactgtacagtcacgaccggtgctcgatttagtgctatagacttgggtttgggggcaggagtcagacccactcaggacacagcatggacatgagggtccccgctcagctcctggggcttctgctgctctggctcccaggtgccaaatgtgccatccagttgacccagtctccatccctccctgtctcgcctctgttcgagactatagtccacctatctacttggtcgggctaggtcgggtctagttgggctagtgtcgtttagcccgttggtatcgagacgaaggaaaccggaggggaacncctaccgtaagcctccgtgtacttcgtttgctcgtcccttacgtaggtttaggaagtcggacgtacctacgtacgtacggtacgacggtacggacgtaggtcgacgtcggtacgggactacgttactttacaccttaccctaccgacacgtcgacgtacgcgaccgtgcggtaacnccgtagacgttactcgggtataaaccttaaccttatttaacgttaccgtaacttaaacgttaaacggtttaaccgtacctttaccccttaccgtttcccggttaaccgggttacgggaccgggttaaacggggacccggtaaaggggtacgttaacggttaacgttaaaccgtaaagggtaccgttgggtacgtaccgacggtaacccttaacgtttccg

SEQ ID NO: 309287 - DNA, 758 bp, Homo sapiens
  misc_feature: GZ8MTXP01CILLF.25.86.H09.1.454.CMB.2.raw
  modified_base (286)..(286): a, c, t, g, unknown or other
  misc_feature (286)..(286): n is a, c, g, or t
tcagactgtacagtcacgaccggtgctcgatttagtgctatagacttgggtttgggggagtcagacccactcaggacacagcatggacatgagggtccccgctcagctcctggggcttctgctgctctggctcccaggtgccaaatgtgccatccagttcgacccagtctccatcctccctgtctgcctctgttcgagacatacgtcaccatcacttggtcgggtctaggtcgggtctagttggctagtgtctttagcgtggtatcagcaagaaccgaggggaacnctacctagctctgtacttcgttgactcgtccttaccgttagggttttacgggaaacgtcggtaccgtacccgtaagtacggtaaacggtttccgaacgggtcgggtaccgtaggttacgggtaacgttcggtacggggtaaacctaggttaactttccaccgtttacccaccaaccctacgtaccagtacccgacggtccccgtaggaccgtaacgtccgtaagggaacttaccgttacctacggtaacccgttaaaccgtttttaatttaccggtttaaacgttaaccctaaaacgtttaaacgtttaaacccgggtttaaccttttaacccccgttccgtttcccgttacccggggtttcggggaacccgggggttaacgggttaacccggtaaagggttacggaaacgtaacgttaacgaaaacccggttgtcgggtacgcgtcggacttacctaacttcgttaacccg

SEQ ID NO: 309288 - DNA, 755 bp, Homo sapiens
  misc_feature: GZ8MTXP01BOONW.25.86.H09.1.454.CMB.2.raw
  modified_base (238)..(238): a, c, t, g, unknown or other
  misc_feature (238)..(238): n is a, c, g, or t
  modified_base (269)..(269): a, c, t, g, unknown or other
  misc_feature (269)..(269): n is a, c, g, or t
  modified_base (296)..(296): a, c, t, g, unknown or other
  misc_feature (296)..(296): n is a, c, g, or t
tcagactgtacagtcacgaccggtgctcgatttagtgctatagacttggggtttgggggagtcagacccactcaggacacagcatggacatgagggtccccgctcagctcctggggcttctgctgctctggctcccaggtgccaaatgtgccatccagttgacccagtctccatcctccctgtctcgcctctgttcgagacatacgtcacatctacttggtcgggtctaggtcgggtnagttggacagtgtctttacgccgtggtactnacgacaaaggaaaccgaagggggaacnctaccgtaacgtctacctgtacttcgtttgaacgtcgtccttaccgtagggtttaacggaacggtacggtactcccgaataccgtaaaggttccgaggcggtaccgtaggtcggtaactccgggtagggtaacgtagttaacttttacaacccttcctaaccctacccgtaaacgtaccgacgtaccgtaccgtacgtacggacctaccggtactaacggtacgttaacttacgtaacgtaaccttaaacgttaacgtttaacgtaacgttaaacctaaaacgtttaaacgtttaaccgttaacccctttcccgttaccggtttcccggttaacccgggtacggggaaccggggtaaacgggttaccggtaaacgggttacggaaacgttaacgttaaaccggttaaacgttacggttcgggtaccgtccgtacgtacccttacgttccgtttccgtcg

SEQ ID NO: 309289 - DNA, 760 bp, Homo sapiens
  misc_feature: GZ8MTXP01CGS3V.25.86.H09.1.454.CMB.2.raw
  modified_base (405)..(405): a, c, t, g, unknown or other
  misc_feature (405)..(405): n is a, c, g, or t
  modified_base (673)..(673): a, c, t, g, unknown or other
  misc_feature (673)..(673): n is a, c, g, or t
tcagactgtacagtcacgaccggtgctcgatttagtgctatagacttggggtttggggggagtcagacccactcaggacacagcatggacatgagggtccccgctcagctcctggggcttctgctgctctggctcccaggtgccaaatgtgccatccagttgacccagtctccatcctccctgtctgcctctgttcgagacatagtccacatcacttgtcgggctagtcgggtctagttggctagtgctttaggcctggtatcagacaacgaaaaccgagggggaaagcctaccgtaagtcctacctgtaacttcgtttagacttcggtccccttaccggtaaggtttagggaaacggtcgggtacgtacccaagttaccgtaaacggttccgaggacccggtanacggggttaagggaattccggtagggggaacctagggttaacttttacgacttaccctacctaaccgtaactcgaaacggtccacgtcccgttagggaccttacggacctagggtaaactactttacgtaccggacgttaaaacctttattttaaacggttacgtaaacctaaaacggtttaaactttaaacgggtaccctttaaccccggttcctttacccgtaccggtttccgggggaacgggtaacgggttaccggttaaagggnggtaaacggttaccaaaacggttaaaacggacggtttaacgggtacggttaacgccggtaccttaaccttaacggttccgttaaccg

SEQ ID NO: 309290 - DNA, 493 bp, Homo sapiens
  misc_feature: GZ8MTXP02IUQDT.25.86.H09.1.454.CMB.2.raw
  modified_base (368)..(368): a, c, t, g, unknown or other
  misc_feature (368)..(368): n is a, c, g, or t
  modified_base (398)..(398): a, c, t, g, unknown or other
  misc_feature (398)..(398): n is a, c, g, or t
  modified_base (429)..(429): a, c, t, g, unknown or other
  misc_feature (429)..(429): n is a, c, g, or t
tcagactgtacagtcacgaccggtgctcgatttagtgctatagacttgggtttggggcaggagtcagacccactcaggacacagcatggacatgagggtccccgctcagctcctggggcttctgctgctctggctcccaggtgccaaatgtgccatccagttgacccagtctccatcctccctgtctgcctctgttcgagacatagtcaccatcacttgtcgggctagtcgggtcattggcagtgctttagcctggtatcagcagaaaccaggggaagctcctaagctcctgatctttgatgcctcagtttggaaagtggagtccatcaaggttcagcggcagtggatctgggacagatttcatcctnaccatcagcagcctgcagcctgaagattcngcaacctattaatgtacaactaatttaaggnttaccctctactccttcggcggacggaccaaggtcgagatcaaaacgactgtacggctgcacta

SEQ ID NO: 309291 - DNA, 503 bp, Homo sapiens
  misc_feature: GZ8MTXP02FKPRB.25.86.H09.1.454.CMB.2.raw
  modified_base (393)..(393): a, c, t, g, unknown or other
  misc_feature (393)..(393): n is a, c, g, or t
  modified_base (396)..(396): a, c, t, g, unknown or other
  misc_feature (396)..(396): n is a, c, g, or t
  modified_base (409)..(409): a, c, t, g, unknown or other
  misc_feature (409)..(409): n is a, c, g, or t
tcagactgtacagtcacgaccggtgctcgatttagtgctatagacttgggtttgggggagtcagacccactcaggacacagcatggacatgagggtccccgctcagctcctggggcttctgctgctctggctcccaggtgccaaatgtgccatccagttgacccagtctccatcctccctgtctgcctctgttcgagacatagtcaccatcacttgtcgggctagtcgggtcattggcagtgctttagcctggtatcagcagaaaccaggggaagctcctaagctcctgatctttgatgcctcagtttggaaagtggagtccatcaaggttcagcggcagtggatctgggacagatttcatcctcaccatcagcagcctgcagcctgaaagtntcngacaactattatnacaaactaattaagtacttacctctctccgtcggacggagggaccaaggtggaagactaacgaaaacgaacgtggtcgctacgacacctatctg

SEQ ID NO: 309292 - DNA, 533 bp, Homo sapiens
  misc_feature: GZ8MTXP02FWUZL.25.86.H09.1.454.CMB.2.raw
  modified_base (286)..(286): a, c, t, g, unknown or other
  misc_feature (286)..(286): n is a, c, g, or t
  modified_base (417)..(417): a, c, t, g, unknown or other
  misc_feature (417)..(417): n is a, c, g, or t
  modified_base (422)..(422): a, c, t, g, unknown or other
  misc_feature (422)..(422): n is a, c, g, or t
tcagactgtacagtcacgaccggtgctcgatttagtgctatagacttgggtttgggggcaggagtcagacccactcaggacacagcatggacatgagggtccccgctcagctcctggggcttctgctgctctggctcccaggtgccaaatgtgccatccagttgacccagtctccatcctccctgtctgcctctgttcgagacatagtccaccatctacttggtcgggctaggtcgggtcagttggcagtgtctttagcctggtatcagcaagaaaccgagggganctctaagctctgattcttgatcgccctcgtaggtttaggaaagtggacgtccatacgtaagtcaggcgcaggtgatcgtagggacagtacttcattcctcaccatcagcacgcctgcacgcctaggaaatntctanactaacttattagtcactaaactaatttaagccttacctctacctcgtcgggacggtacggacgtaggtagacgtactaacaacggtactggtacgcgtacacaaccttcg

SEQ ID NO: 309293 - DNA, 513 bp, Homo sapiens
  misc_feature: GZ8MTXP02ILVYZ.25.86.H09.1.454.CMB.2.raw
  modified_base (270)..(270): a, c, t, g, unknown or other
  misc_feature (270)..(270): n is a, c, g, or t
  modified_base (277)..(277): a, c, t, g, unknown or other
  misc_feature (277)..(277): n is a, c, g, or t
  modified_base (362)..(362): a, c, t, g, unknown or other
  misc_feature (362)..(362): n is a, c, g, or t
  modified_base (392)..(392): a, c, t, g, unknown or other
  misc_feature (392)..(392): n is a, c, g, or t
tcagactgtacagtcacgaccggtgctcgatttagtgctatagacttgggtttggggcaggagtcagacccactcaggacacagcatggacatgagggtcccgctcagctcctggggcttctgctgctctggctcccaggtgccaaatgtgccatccagttgacccagtctccatcctccctgtctgcctctgttcgagacatagtcaccatcacttgtcgggctagtcgggtcattggcagtgctttagcctggtatcagcagaaaccnggggaanctcctaagctcctgatctttgatgcctcagttgaaagtgagtccatcagttcagcgcagtggatcgtgggacagatttcatcctnaccatcagcagcctgcagcctgaagattcngcaaccttattattgtacaaactaatttaaaggactttaaccctcttaccttcccgtttcgggaccggtacggggaaccaaagggtcggaagtatacgaaaacgactgtcggctgacacta

SEQ ID NO: 309294 - DNA, 517 bp, Homo sapiens
  misc_feature: GZ8MTXP02H9W8J.25.86.H09.1.454.CMB.2.raw
  modified_base (332)..(333): a, c, t, g, unknown or other
  misc_feature (332)..(333): n is a, c, g, or t
  modified_base (341)..(341): a, c, t, g, unknown or other
  misc_feature (341)..(341): n is a, c, g, or t
  modified_base (345)..(345): a, c, t, g, unknown or other
  misc_feature (345)..(345): n is a, c, g, or t
  modified_base (363)..(364): a, c, t, g, unknown or other
  misc_feature (363)..(364): n is a, c, g, or t
  modified_base (366)..(366): a, c, t, g, unknown or other
  misc_feature (366)..(366): n is a, c, g, or t
  modified_base (370)..(370): a, c, t, g, unknown or other
  misc_feature (370)..(370): n is a, c, g, or t
  modified_base (372)..(373): a, c, t, g, unknown or other
  misc_feature (372)..(373): n is a, c, g, or t
tcagactgtacagtcacgaccggtgctcgatttagtgctatagacttgggtttggggagtcagacccactcaggacacagcatggacatgagggtccccgctcagctcctggggcttctgctgctctggctcccaggtgccaaatgtgccatccagttgacccagtctccatcctccctgtctgcctctgttcgagacatagtcaccatcacttgtcgggctagtcgggtcattggcagtgctttagcctggatcagcaagaaaccaggggaagctcctaagctcctgatcttgatgcctcagtttgaaagtggatccatcaaggtcagcgnngtgatcgngganagtattcactctcaccannancacncnncacgcagatatactcactaactattattatactaactaaattaagtaacttaccttaccttcctcgttcggtacggacggacgaacggtaggaacgacgtaacgtaaacgaacgtaagtacgtacgtacgacacctactactcg

SEQ ID NO: 309295 - DNA, 553 bp, Homo sapiens
  misc_feature: GZ8MTXP02HO342.25.86.H09.1.454.CMB.2.raw
  modified_base (285)..(285): a, c, t, g, unknown or other
  misc_feature (285)..(285): n is a, c, g, or t
  modified_base (473)..(473): a, c, t, g, unknown or other
  misc_feature (473)..(473): n is a, c, g, or t
tcagactgtacagtcacgaccggtgctcgatttagtgctatagacttgggtttgggggcaggagtcagacccactcaggacacagcatggacatgagggtccccgctcagctcctggggcttctgctgctctggctcccaggtgccaaatgtgccatccagttgacccagtctccatcctccctgtctgcctctgttcgagacatagtcaccatcacttggtcgggctaggtcgggtcagttggcagtgtctttagcctggtatcagcaagaaaccgaggggaanctcaagctcctgatctttgatcgcctctagtttaggaaagtggacgtccatacgtaaggttcaggcggcagtgggatcgtagggacagtatttcactcctacaccagtcagcagcctgcagcctaggaaatcttcacgactaacctttagttacttgtaaccaaattaagtttaacgactttaccctntcccttccgttacggggacgggacggaaccgtaaggtggaactatacgaaaacgtactaggtcggactcgacctaactcg

SEQ ID NO: 309296 - DNA, 521 bp, Homo sapiens
  misc_feature: GZ8MTXP02F3D10.25.86.H09.1.454.CMB.2.raw
  modified_base (279)..(279): a, c, t, g, unknown or other
  misc_feature (279)..(279): n is a, c, g, or t
  modified_base (385)..(385): a, c, t, g, unknown or other
  misc_feature (385)..(385): n is a, c, g, or t
tcagactgtacagtcacgaccggtgctcgatttagtgctatagacttgggtttgggggcaggagtcagacccactcaggacacagcatggacatgagggtccccgctcagctcctggggcttctgctgctctggctcccaggtgccaaatgtgccatccagttgacccagtctccatcctccctgtctgcctctgttcgagacatagtcaccatcacttgtcgggctagtcgggtcattggcagtgctttagcctggtatcagcagaaaccaggggaanctcctaagctcctgatctttgatgcctcagtttggaaagtggagtccatcaagttcagcggcagtggatcgtgggacagatttcatcctcaccatcagcagcccgnagcctagaagtattctgacaaccttattattgtacaaactaatttaaggacttaccctctctaccgttcgggcggtagggaccaaagggtcggagaactacgaaaacgtaacgtggtacggctacgacaccattcg

SEQ ID NO: 309297 - DNA, 496 bp, Homo sapiens
  misc_feature: GZ8MTXP02IZGQG.25.86.H09.1.454.CMB.2.raw
  modified_base (397)..(397): a, c, t, g, unknown or other
  misc_feature (397)..(397): n is a, c, g, or t
  modified_base (401)..(401): a, c, t, g, unknown or other
  misc_feature (401)..(401): n is a, c, g, or t
  modified_base (410)..(410): a, c, t, g, unknown or other
  misc_feature (410)..(410): n is a, c, g, or t
  modified_base (417)..(417): a, c, t, g, unknown or other
  misc_feature (417)..(417): n is a, c, g, or t
  modified_base (483)..(483): a, c, t, g, unknown or other
  misc_feature (483)..(483): n is a, c, g, or t
tcagactgtacagtcacgaccggtgctcgatttagtgctatagacttgggtttgggggagtcagacccactcaggacacagcatggacatgagggtccccgctcagctcctggggcttctgctgctctggctcccaggtgccaaatgtgccatccagttgacccagtctccatcctccctgtctgcctctgttcgagacatagtcaccatcacttgtcgggctagtcgggtcattggcagtgctttagcctggtatcagcagaaaccaggggaagctcctaagctcctgatctttgatgcctcgtagtttggaaatggacgtcccatcaacggttcagcggcagtggatcgtggggacagatttcatcctcaccatcagctagcctgcagcctgaanttcngacaacttnttacttnacaataattacgacttcctctctcgtcggacggacggacgaggacgagactacgaacgagtgagcncacactactctcg

SEQ ID NO: 309298 - DNA, 424 bp, Homo sapiens
  misc_feature: GZ8MTXP02IH0QB.25.86.H09.1.454.CMB.2.raw
  modified_base (313)..(313): a, c, t, g, unknown or other
  misc_feature (313)..(313): n is a, c, g, or t
  modified_base (352)..(352): a, c, t, g, unknown or other
  misc_feature (352)..(352): n is a, c, g, or t
  modified_base (355)..(355): a, c, t, g, unknown or other
  misc_feature (355)..(355): n is a, c, g, or t
  modified_base (416)..(424): a, c, t, g, unknown or other
  misc_feature (416)..(424): n is a, c, g, or t
tcagactgtacagtcacgaccggtgctcgatttagtgctatagacttgggtttgggagaagaacctactatgcagactctgtgaagggtcgattcaccacctccagagacaacatcaagaactccctgtatctgcaaatggacagtctgacacctgatgacaccgccttgtattattgtgtgaaaggcggtgttgaggtgaatgcctggaacccccgcggtcagcactacttctacatgggcgtctggggcaaaggggactacggtcatcgtctcctcagcctccaccaagggcccatcggtctcccctggcnccctgctccaggacgcacctccgagagcacgcgccgcgngcncgcgtcgagacgtacttacctcctgtcgactcgtcgtagcggcgtcgcgacgagcgatagnnnnnnnnn

SEQ ID NO: 309299 - DNA, 421 bp, Homo sapiens
  misc_feature: GZ8MTXP02HPAG7.25.86.H09.1.454.CMB.2.raw
  modified_base (340)..(340): a, c, t, g, unknown or other
  misc_feature (340)..(340): n is a, c, g, or t
  modified_base (416)..(421): a, c, t, g, unknown or other
  misc_feature (416)..(421): n is a, c, g, or t
tcagactgtacagtcacgaccggtgctcgatttagtgctatagacttgggtttgggagaagaacctactatgcagactctgtgaagggtcgattcaccacctccagagacaacatcaagaactccctgtatctgcaaatggacagtctgacacctgatgacaccgccttgtattattgtgtgaaaggcggtgttgaggtgaatgcctggaaccccgcggtcagcactacttctacatgggcgtctggggcaaaggggactacggtcatcgtctcctcagcctccaccaagggccccatcggtcttccccctggcgccctgctccaggagcacctccgagngcacacgcggccctgggctgccctggtcaaggctacttccactgtacagtctgagcgggctggcaaggcgcatagnnnnnn

SEQ ID NO: 309300 - DNA, 425 bp, Homo sapiens
  misc_feature: GZ8MTXP02F9NQW.25.86.H09.1.454.CMB.2.raw
  modified_base (419)..(425): a, c, t, g, unknown or other
  misc_feature (419)..(425): n is a, c, g, or t
tcagactgtacagtcacgaccggtgctcgatttagtgctatagacttgggttgggagaagaacctactatgcagactctgtgaagggtcgattcaccacctccagagacaacatcaagaactccctgtatctgcaaatggacagtctgacacctgatgacaccgccttgtattattgtgtgaaaggcggtgttgaggtgaatgcctggaacccccgcggtcagcactacttctacatgggcgtctggggcaaaggggactacggtcatcgtctcctcagccctccaccaagggccccatccggtcttccccctggccgccctgctccaggagcacctccgagagcacacgcggccctgggctcgcctgggtcaaggctacttccactgtacagtctgagcggctggcaaggcgcatagnnnnnnn

SEQ ID NO: 309301 - DNA, 529 bp, Homo sapiens
  misc_feature: GZ8MTXP02JUQIR.25.86.H09.1.454.CMB.2.raw
  modified_base (399)..(399): a, c, t, g, unknown or other
  misc_feature (399)..(399): n is a, c, g, or t
tcagactgtacagtcacgaccggtgctcgatttagtgctatagacttgggtttggggcaggagtcagacccactcaggacaaagcatggacatgagggtccccgctcagctcctggggcttctgctgctctggctcccaggtgccaaatgtgccatccagttgacccagtctccatcctccctgtctgcctctgttcgagacatagtcaccatcacttgtcgggctagtcgggtcattggcagtgctttagcctggtatcagcagaaaccaggggaagctcctaagctcctgatctttgatgcctcagtttggaaagtggagtcccatccaaggttcagcggcagtgggatcgtggggacagtatttcatcctcaccatcagcagcctgcagcctgaanattctgctaacttattattgtactaaactaattttaaaggactttaaccctcttctcccgtttcggacgggagggacccgtaagggtcggaagactacgaaaacgaacgtgtacggctgacaccattccg

SEQ ID NO: 309302 - DNA, 492 bp, Homo sapiens
  misc_feature: GZ8MTXP02I75JZ.25.86.H09.1.454.CMB.2.raw
  modified_base (390)..(390): a, c, t, g, unknown or other
  misc_feature (390)..(390): n is a, c, g, or t
  modified_base (393)..(393): a, c, t, g, unknown or other
  misc_feature (393)..(393): n is a, c, g, or t
  modified_base (406)..(406): a, c, t, g, unknown or other
  misc_feature (406)..(406): n is a, c, g, or t
tcagactgtacagtcacgaccggtgctcgatttagtgctatagacttgggtttggggagtcagacccactcaggacacagcatggacatgagggtccccgctcagctcctggggcttctgcttctctggctcccaggtgccaaatgtgccatccagttgacccagtctccatcctccctgtctgcctctgttcgagacatagtcaccatcacttgtcgggctagtcgggtcattggcagtgctttagcctggtatcagcagaaaccaggggaagctcctaagctcctgatctttgatgcctcagtttgaaagtgagtccatcaaggttccagcgcagtggatctggggacagatttcatcctcaccatcagcagcctgcagcctgaaatntcnactaactattatntacaaataattaagacttacctctctcgtcggacggacggacgaggtgagactacgaaacgtatgcgctacgacactactctcgtc

SEQ ID NO: 309303 - DNA, 530 bp, Homo sapiens
  misc_feature: GZ8MTXP02H9TUU.25.86.H09.1.454.CMB.2.raw
  modified_base (276)..(276): a, c, t, g, unknown or other
  misc_feature (276)..(276): n is a, c, g, or t
  modified_base (323)..(323): a, c, t, g, unknown or other
  misc_feature (323)..(323): n is a, c, g, or t
  modified_base (344)..(344): a, c, t, g, unknown or other
  misc_feature (344)..(344): n is a, c, g, or t
  modified_base (394)..(394): a, c, t, g, unknown or other
  misc_feature (394)..(394): n is a, c, g, or t
tcagactgtacagtcacgaccggtgctcgatttagtgctatagacttgggtttggggcaggagtcagacccactcaggacacagcatggacatgagggtcccgctcagctcctggggcttctgctgctctggctcccaggtgccaaatgtgccatccagttgacccagtctccatcctcctgtctgcctctgttcgagacatagtcaccatcacttgtcgggctagtcgggtcattggcagtgctttagcctggtatcagcagaaaccaggggaanctctaagctcctgatctttgatgcctctagttggaaagtgagtccanctaaggtcagcgcagtgatcnggggacagtatttcatccctcaccatcagcagcctgcagcctagaaagtntttctgtactaaccttattatttgtacaaactaatttaacggtactttaccctcttacttccgttcgggtcggaacggaccgtaaaggtacggaacgtaactacgaaaacgtaactcggtaggactcgactactac

SEQ ID NO: 309304 - DNA, 530 bp, Homo sapiens
  misc_feature: GZ8MTXP02F80XX.25.86.H09.1.454.CMB.2.raw
  modified_base (280)..(280): a, c, t, g, unknown or other
  misc_feature (280)..(280): n is a, c, g, or t
  modified_base (348)..(348): a, c, t, g, unknown or other
  misc_feature (348)..(348): n is a, c, g, or t
  modified_base (382)..(382): a, c, t, g, unknown or other
  misc_feature (382)..(382): n is a, c, g, or t
tcagactgtacagtcacgaccggtgctcgatttagtgctatagacttgggtttgggggcaggagtcagacccactcaggacacagcatggacatgagggtccccgctcagctcctggggcttctgctgctctggctcccaggtgccaaatgtgccatccagttgacccagtctccatcctccctgtctgcctctgttcgagacatagtcaccatcacttgtcgggctagtcgggtcattggcagtgctttagcctggatcagcaagaaaccaggggaacnctactaagctctgattcttgatcgcctacgtaggttaggaaagtggacgtccatacgagtcagcgganagtggatcgaggactagtattcactcctacacanacagcacgcccgacacgcagaatattcgtacgactaacttattattagtaactaaattaagttaacgtacttacctctctcgtacggacggaacggacgaaggtacgacgactaacgaaacgtaacgtgtacgacacgacactactcg

SEQ ID NO: 309305 - DNA, 567 bp, Homo sapiens
  misc_feature: GZ8MTXP02IQWFQ.25.86.H09.1.454.CMB.2.raw
  modified_base (271)..(271): a, c, t, g, unknown or other
  misc_feature (271)..(271): n is a, c, g, or t
  modified_base (327)..(327): a, c, t, g, unknown or other
  misc_feature (327)..(327): n is a, c, g, or t
  modified_base (383)..(383): a, c, t, g, unknown or other
  misc_feature (383)..(383): n is a, c, g, or t
  modified_base (389)..(389): a, c, t, g, unknown or other
  misc_feature (389)..(389): n is a, c, g, or t
  modified_base (441)..(441): a, c, t, g, unknown or other
  misc_feature (441)..(441): n is a, c, g, or t
tcagactgtacagtcacgaccggtgctcgatttagtgctatagacttgggtttggggagtcagacccactcaggacacagcatggacatgagggtccccgctcagctcctggggcttctgctgctctggctcccaggtgccaaatgtgccatccagttgacccagtctccatcctccctgtctgcctctgttcgagacatagtcaccatcacttgtcgggctagtcggtcattggcagtgctttagcctggtatcagcagaaccagggaanctcctaagctcctgatcttgatgcctcagtttgaatgagtccatcaagttcagcgnagtggatcgtgggacagatttcatcctcaccatcagcagcctgcagcctagaacgntttcgngactaaccttattacttgtacaaacttaagtttaacggactttaaccccgtnttaccgttaccgtttacggggacggtaacggggtaaccctaaagggggtttacggaacgtacgttaaccgaaaaccggtaacgttggtacgggaccttacggacctaacccgtagttccgttacgg

SEQ ID NO: 309306 - DNA, 489 bp, Homo sapiens
  misc_feature: GZ8MTXP02HF735.25.86.H09.1.454.CMB.2.raw
  modified_base (279)..(279): a, c, t, g, unknown or other
  misc_feature (279)..(279): n is a, c, g, or t
  modified_base (395)..(395): a, c, t, g, unknown or other
  misc_feature (395)..(395): n is a, c, g, or t
  modified_base (489)..(489): a, c, t, g, unknown or other
  misc_feature (489)..(489): n is a, c, g, or t
tcagactgtacagtcacgaccggtgctcgatttagtgctatagacttgggtttgggggcaggagtcagacccactcaggacacagcatggacatgagggtccccgctcagctcctggggcttctgctgctctggctcccaggtgccaaatgtgccatccagttgacccagtctccatcctccctgtctgcctctgttcgagacatagtcaccatcacttgtcgggctagtcgggtcattggcagtgctttagcctggtatcagcagaaaccaggggaanctcctaagctcctgatcttgatgcctcagtttgaaagtgagtccatcaagttcagcggcagtgatctgggacagatttcatcctcaccatcagcagcctgcagcctgaaagattcngcaacttatatgtacaactaatttaagattacctctctccttcggcggacggaccgaaggtgagagtacaaaacgactgtggactcgcaacctn

SEQ ID NO: 309307 - DNA, 537 bp, Homo sapiens
  misc_feature: GZ8MTXP02IGYCY.25.86.H09.1.454.CMB.2.raw
  modified_base (285)..(285): a, c, t, g, unknown or other
  misc_feature (285)..(285): n is a, c, g, or t
  modified_base (358)..(358): a, c, t, g, unknown or other
  misc_feature (358)..(358): n is a, c, g, or t
  modified_base (411)..(411): a, c, t, g, unknown or other
  misc_feature (411)..(411): n is a, c, g, or t
  modified_base (430)..(430): a, c, t, g, unknown or other
  misc_feature (430)..(430): n is a, c, g, or t
  modified_base (470)..(470): a, c, t, g, unknown or other
  misc_feature (470)..(470): n is a, c, g, or t
tcagactgtacagtcacgaccggtgctcgatttagtgctatagacttgggtttgggggcaggagtcagacccactcaggacacagcatggacatgagggtccccgctcagctcctggggcttctgctgctctggctcccaggtgccaaatgtgccatccagttgacccagtctccatcctccctgtctgcctctgttcgagacatagtccaccatcacttggcggctaggtcgggtcagttggctagtgtctttagcctggtatcagcaagaaaccgaggggaanctacctaagctcctgattcttgatcgccctctagtttaggaaagtgacgtcccatacgtaagttcaggtcggntagtgggatcgtaggggactagtactttcactcctacacctagcagcagcctncgacgcagaaagtcttcgntactaaccttattagtatacaataatttaacgacttaccncttctcgttcggacggacgacgtaggtacgagtactaacgaaacgtactggtcggactcgactactc

SEQ ID NO: 309308 - DNA, 525 bp, Homo sapiens
  misc_feature: GZ8MTXP02FWRKI.25.86.H09.1.454.CMB.2.raw
tcagactgtacagtcacgaccggtgctcgatttagtgctatagacttgggtttggggagtcagacccactcaggacacagcatggacatgagggtcccgctcagctcctggggcttctgctgctctggctcccaggtgccaaatgtgccatccagttgacccagtctccatcctccctgtctgcctctgttcgagacatagtcaccatcacttgtcgggctagtcgggtcattggcagtgctttagcctggtatcagcagaaaccaggggaagctcctaagctcctgatctttgatgcctcagtttggaaagtggagtccatcaaggttcagcggcagtggatcgtggggacagtatttcatcctcaccatcagcagcctgcagcctgaagattctgcctaaacctattattgtacaaactaaatttaaaggactttacccctcttctcccgttcggacgggtaaggggtacccaaagggtggaagactacgaaaacgaactgtacggctacggccaccatctcg

SEQ ID NO: 309309 - DNA, 607 bp, Homo sapiens
  misc_feature: GZ8MTXP02HJHR1.25.86.H09.1.454.CMB.2.raw
  modified_base (278)..(278): a, c, t, g, unknown or other
  misc_feature (278)..(278): n is a, c, g, or t
tcagactgtacagtcacgaccggtgctcgatttagtgctatagacttgggttggggcaggagtcagacccactcaggacacagcatggacatgagggtccccgctcagctcctggggcttctgctgctctggctcccaggtgccaaatgtgccatccagttgacccagtctccatcctccctgtctgcctctgttcgagacatagtcaccatcacttgtcgggctagtcgggtcattggcagtgctttagcctggtatcagcagaaaccaggggaacnctactagctctgattcttgatcgcctcgtagtttaggaaagtggacgtccatacgaaggtcagcggcaggtggatcgtagggacagtacttcactcctacacctatcacgacgacgcctcgacgacgaccgtacgtaagtacttactacgtactaaccttaactttacttacgttaactaaacttaaacgtttaaacgttaaccttacccttaccttaccgttaccgttaccgggtaccgggtaacgggtaaccggtaaacgggtacggtaacgtaacgtaacgtaaaaccgtaacgtacggtacggtacgtacgtaccgtaccgtacg

SEQ ID NO: 309310 - DNA, 509 bp, Homo sapiens
  misc_feature: GZ8MTXP02GMWX5.25.86.H09.1.454.CMB.2.raw
  modified_base (279)..(279): a, c, t, g, unknown or other
  misc_feature (279)..(279): n is a, c, g, or t
tcagactgtacagtcacgaccggtgctcgatttagtgctatagacttgggtttgggggcaggagtcagacccactcaggacacagcatggacatgagggtccccgctcagctcctggggcttctgctgctctggctcccaggtgccaaatgtgccatccagttgacccagtctccatcctccctgtctgcctctgttcgagacatagtcaccatcacttgtcgggctagtcgggtcattggcagtgctttagcctggtatcagcagaaaccaggggaanctcctaagctcctgatctttgatgcctccagtttggaaagtggagtccatcaaggttcagcggcagtgatcgtggggacagatttcatcctacaccatcagcagcctgcagcctgaaagattctgactaacctattattgtacaaataatttaaacggacttaccctactctccgttcggacgggacggaccgaaggtgacgagtacaaagaactgtacggctcgacaca

SEQ ID NO: 309311 - DNA, 537 bp, Homo sapiens
  misc_feature: GZ8MTXP02G9KNJ.25.86.H09.1.454.CMB.2.raw
  modified_base (279)..(279): a, c, t, g, unknown or other
  misc_feature (279)..(279): n is a, c, g, or t
  modified_base (395)..(395): a, c, t, g, unknown or other
  misc_feature (395)..(395): n is a, c, g, or t
  modified_base (400)..(400): a, c, t, g, unknown or other
  misc_feature (400)..(400): n is a, c, g, or t
tcagactgtacagtcacgaccggtgctcgatttagtgctatagacttgggtttgggggcaggagtcagacccactcaggacacagcatggacatgagggtccccgctcagctcctggggcttctgctgctctggctcccaggtgccaaatgtgccatccagttgacccagtctccatcctccctgtctgcctctgttcgagacatagtcaccatcacttgtcgggctagtcgggtcattggcagtgctttagcctggtatcagcagaaaccaggggaanctcctaagctctgatcttgatgcctcagttggaaagtggatccatcaaggttcagcggcagtggatcgtgggactagatttcatcctcaccatcagcagcctgcagcctgaaagtnttcgntactaaaccttatttacttagtaccaaattaaagtttaacggactttaaccctctccgttccgtttcggggacggtacggaacccgtaagggtcggaagtactacgaaaacgtacgtggtacggctcggacacctag

SEQ ID NO: 309312 - DNA, 524 bp, Homo sapiens
  misc_feature: GZ8MTXP02F2Q96.25.86.H09.1.454.CMB.2.raw
  modified_base (279)..(279): a, c, t, g, unknown or other
  misc_feature (279)..(279): n is a, c, g, or t
  modified_base (397)..(397): a, c, t, g, unknown or other
  misc_feature (397)..(397): n is a, c, g, or t
tcagactgtacagtcacgaccggtgctcgatttagtgctatagacttgggtttgggggcaggagtcagacccactcaggacacagcatggacatgagggtccccgctcagctcctggggcttctgctgctctggctcccaggtgccaaatgtgccatccagttgacccagtctccatcctccctgtctgcctctgttcgagacatagtcaccatcacttgtcgggctagtcgggtcattggcagtgctttagcctggtatcagcagaaaccaggggaanctctaagctcctgatctttgatgcctcagtttggaaagtggagtccatcaagttcagcggcagtggatcgtgggacagtatttcatcctcaccatcagcagcctgcagacctgaaagnttctgactaaccttattattacgtactaactaatttaaggacttaccctcttctccgttcgggacgggtacggaccgtaaggtacgagtacgtacgaaacgtactaggtacgacgtacgacacctag

SEQ ID NO: 309313 - DNA, 509 bp, Homo sapiens
  misc_feature: GZ8MTXP02JSTQE.25.86.H09.1.454.CMB.2.raw
  modified_base (400)..(400): a, c, t, g, unknown or other
  misc_feature (400)..(400): n is a, c, g, or t
  modified_base (404)..(404): a, c, t, g, unknown or other
  misc_feature (404)..(404): n is a, c, g, or t
tcagactgtacagtcacgaccggtgctcgatttagtgctatagacttgggtttgggggcaggagtcagacccactcaggacacagcatggacatgagggtccccgctcagctcctggggcttctgctgctctggctcccaggtgccaaatgtgccatccagttgacccagtctccatcctccctgtctgcctctgttcgagacatagtcaccatcacttgtcgggctagtcgggtcattggcagtgctttagcctggtatcagcagaaaccgaggggagctcctaagctcctgatctttgatgcctccagtttggaaagtggagtccatcaaggttcagcggcagtggatcgtgggacagtatttcatcctcaccatcagcagccctgcagcctgaaagnttcngcaaccttattattgtacaaactaattaaggtacttaccctctactccgttcggcggtacggaccaagggtgagactacgaaacgactggtaggctgaccactag

SEQ ID NO: 309314 - DNA, 494 bp, Homo sapiens
  misc_feature: GZ8MTXP02IC7ME.25.86.H09.1.454.CMB.2.raw
  modified_base (368)..(368): a, c, t, g, unknown or other
  misc_feature (368)..(368): n is a, c, g, or t
  modified_base (417)..(417): a, c, t, g, unknown or other
  misc_feature (417)..(417): n is a, c, g, or t
  modified_base (437)..(437): a, c, t, g, unknown or other
  misc_feature (437)..(437): n is a, c, g, or t
tcagactgtacagtcacgaccggtgctcgatttagtgctatagacttgggtttgggggcaggagtcagacccactcaggacacagcatggacatgagggtccccgctcagctcctgggactcctgctgctctggctcccagataccagatgtgacgtccagatgacccagtctccatcctccctgtctgcatctgttggagacagaatcagcatcacttgccgggcagtcagggcattagcaattatttagcctggtatcaaacagaaaccagggagagttcctaaagctcctgatctatgctgcctccacgttacactcaggggtcccatctcggttcagcgggcagtgaatctggggacagagttnactctcacatcagcagcctgcagcctagaagatgtgctaacttatactntacaaaatataaatactacnccctctctactttcggcggacggccaaaggtgacgaatcgaaaagaacttggacgcg

SEQ ID NO: 309315 - DNA, 604 bp, Homo sapiens
  misc_feature: GZ8MTXP02H2NEW.25.86.H09.1.454.CMB.2.raw
  modified_base (282)..(282): a, c, t, g, unknown or other
  misc_feature (282)..(282): n is a, c, g, or t
  modified_base (350)..(350): a, c, t, g, unknown or other
  misc_feature (350)..(350): n is a, c, g, or t
tcagactgtacagtcacgaccggtgctcgatttagtgctatagacttggggtttgggggcaggggtcagacccactcaggacacagcatggacatgagggtccccgcctcagctcctggggcttcctgctgctctggctcccaggtgccaaatgtgccatccagttgacccagtctccatcctccctgtctgcctctgttcgagacatagtcaccatcacttgtcgggctagtcgggtcattggcagtgctttagcctggtatcagcagaaaccaggggaanctcctaagctcctgatctttgatgcctcctagtttggaaagtgagtccatcaaggttcagcgcagtgntctgggacagtatttcattccctcaccatcagcagcctgcacgacctgaaagtattctacgtactaaccttaattatttacgactaaaactaaagtttttaaacggaactttacccctcttccttacccgtttacggggaccgggtaaacggggaaacccgtaaaaggggtacgggtaacgaacttaaaccgaaaaaccggggtaaaacttcgggtaacgggtaccttacggacccgtaacctaacggtttccg

SEQ ID NO: 309316 - DNA, 482 bp, Homo sapiens
  misc_feature: GZ8MTXP02JQFTY.25.86.H09.1.454.CMB.2.raw
  modified_base (276)..(276): a, c, t, g, unknown or other
  misc_feature (276)..(276): n is a, c, g, or t
  modified_base (383)..(383): a, c, t, g, unknown or other
  misc_feature (383)..(383): n is a, c, g, or t
  modified_base (388)..(388): a, c, t, g, unknown or other
  misc_feature (388)..(388): n is a, c, g, or t
  modified_base (400)..(400): a, c, t, g, unknown or other
  misc_feature (400)..(400): n is a, c, g, or t
  modified_base (448)..(448): a, c, t, g, unknown or other
  misc_feature (448)..(448): n is a, c, g, or t
  modified_base (470)..(470): a, c, t, g, unknown or other
  misc_feature (470)..(470): n is a, c, g, or t
  modified_base (478)..(478): a, c, t, g, unknown or other
  misc_feature (478)..(478): n is a, c, g, or t
tcagactgtacagtcacgaccggtgctcgatttagtgctatagacttgggtttgggggagtcagacccactcaggacacagcatggacatgagggtccccgctcagctcctggggcttctgctgctctggctcccaggtgccaaatgtgccatccagttgacccagtctccatcctccctgtctgcctctgttcgagacatagtcaccatcacttgtcgggctagtcgggtcattggcagtgctttagcctggtatcagcagaaaccgaggggaanctctaagctcctgatcttgatgctcagtttgaagtgagtccatcaaggtcagcggcagtggatcgtgggacagtattcatcctcacatcagcagcctgcagcctganattcnactactattatntactaactaattagtacttacctctctcgtcggacggacgacgaaggngacgactacgaacgactgcgcncgacactntctg

SEQ ID NO: 309317 - DNA, 809 bp, Homo sapiens
  misc_feature: GZ8MTXP02JY7FJ.25.86.H09.1.454.CMB.2.raw
tcagactgtacagtcacgaccggtgctcgatttagtgctatagacttgggtttgggggcaggagtcagacccactcaggacacagcatggacatgagggtccccgctcagctcctggggcttctgctgctctggctcccaggtgccaaatgtgccatccagttgacccagtctccatcctccctgtctcgtcctcgtcgtacgacgactagtacgtaccacctactaccttacgttcgggtccggtacgttacgggttccggtacttaggttcggacgtaggtcgttacgtttcgccgttaggtactacgacgacgaaaccgaaaccgggaaggggaactcccttaacgtaacgtcctccgtagtactttcgttagtgtccgtccctaccgtttagggttaaaggtaaggtagggtaccctacctacgtaacggttaacggttacgacgggcgacgtagggtggtacttcgggtacggtagagtttacttactacccttccctaccaaacctcgtacgaccgaacgacctccgtcgaccgaaccgttcccgaaagggtaaagttcctttaccggacgtaacccccttaaacgtttattttacggtaccgtaaaacccgtaaaattttaaaacggggtttaacgtaccccttttaacccctacgttaccccgttttcccgggtaccgggggtaacgggggaacccgggtaaaacccggttagggggaccgggtaaactaaccgttaaaaccggaaaaaccggtcggtttagggggacccgtcggttaccgaaccccgtaaacgtttcccg

SEQ ID NO: 309318 - DNA, 539 bp, Homo sapiens
  misc_feature: GZ8MTXP02F7YX8.25.86.H09.1.454.CMB.2.raw
  modified_base (362)..(362): a, c, t, g, unknown or other
  misc_feature (362)..(362): n is a, c, g, or t
  modified_base (504)..(504): a, c, t, g, unknown or other
  misc_feature (504)..(504): n is a, c, g, or t
tcagactgtacagtcacgaccggtgctcgatttagtgctatagacttgggtttggggagctctgggaaaggagccccagccctgagattcccaggtgattccattcggtgatcagcactgaacacagaactcaccatggagtttggactgagctgggttttccttgttgccattttaaaaggtgtccagtgtgaagtgcaactggtggagtcgtgggggagccgtggtgcaggccggggggtccctgagactctcctgtgtagcctctggattcatgtttgatgattatgccatgcacgtgggtccgtcgaaggtccggggaaggtctgggagtgggtctctctatgacttgggatgggganaagaacctactatgcagactctgtgaagggtcattcaccacctcagagacaacatacaaagaacctaccctagtactctagacaaatggaacagtctgacacctgatacgacaccgccttagtattattgtgtaggaaaggnggtgtgaggtagaagtgaccgtcggaacccgtcgg

SEQ ID NO: 309319 - DNA, 498 bp, Homo sapiens
  misc_feature: GZ8MTXP02J1GGU.25.86.H09.1.454.CMB.2.raw
  modified_base (275)..(275): a, c, t, g, unknown or other
  misc_feature (275)..(275): n is a, c, g, or t
  modified_base (433)..(433): a, c, t, g, unknown or other
  misc_feature (433)..(433): n is a, c, g, or t
tcagactgtacagtcacgaccggtgctcgatttagtgctatagacttgggtttgggggagtcagacccactcaggacacagcatggacatgagggtccccgctcagctcctggggcttctgctgctctggctcccaggtgccaaatgtgccatccagttgacccagtctccatcctccctgtctgcctctgttcgagacatagtcaccatcacttgtcgggctagtcgggtcattggcagtgctttagcctggtatcagcagaaaccaggggaanctcctaagctcctgatctttgatgcctcagtttggaagtggagtcccatcaaggttcagcggcagtggatcgtgggacagattcatcctcaccatcagcagcctgcagctgagattctgcaacttattattgtacaaactatttaaggacttaccctntacctccgttcggacggacggaccaagggtcgagacacaaagactggtggctgaccaccatctcg

SEQ ID NO: 309320 - DNA, 612 bp, Homo sapiens
  misc_feature: GZ8MTXP02JVWGF.25.86.H09.1.454.CMB.2.raw
  modified_base (271)..(271): a, c, t, g, unknown or other
  misc_feature (271)..(271): n is a, c, g, or t
  modified_base (278)..(278): a, c, t, g, unknown or other
  misc_feature (278)..(278): n is a, c, g, or t
  modified_base (291)..(291): a, c, t, g, unknown or other
  misc_feature (291)..(291): n is a, c, g, or t
tcagactgtacagtcacgaccggtgctcgatttagtgctatagacttgggtttgggggagtcagacccactcaggacacagcatggacatgagggtccccgctcagctcctggggcttctgctgctctggctcccaggtgccaatgtggccagtccaaggttgacccagtctccatcctccctgtctgcctctgttcgagacatagtcaccatcacttgtcgggctagtcgggtcattggcagtgctttagcctggtatcagcagaaaccnggggaanctcagctctgatnttgatcgcctctagtttaggaagtgactccatacgaacgtcaggcggacaggtgatcgtagggactagttactttcacttccctacgacctatacacgacgacgccgtcgacgacgacgtacgtaagtacttactcgtacctaaccttattattacgttaactaaacttaaagtttaaacgttaacctttacccttaccttaccgttaccgttaccgggtaccggggtacggggtaaccggtaacgggtaacgggtaacggtaacgtaaccgtaaacgtaacgtaacggtacggtacgtacgaccgacctacgttacgtcg

SEQ ID NO: 309321 - DNA, 511 bp, Homo sapiens
  misc_feature: GZ8MTXP02ILTAU.25.86.H09.1.454.CMB.2.raw
  modified_base (396)..(396): a, c, t, g, unknown or other
  misc_feature (396)..(396): n is a, c, g, or t
tcagactgtacagtcacgaccggtgctcgatttagtgctatagacttgggtttggggcaggagtcagacccactcaggacacagcatggacatgagggtccccgctcagctcctggggcttctgctgctctggctcccaggtgccaaatgtgccatccagttgacccagtctccatcctccctgtctgcctctgttcgagacatagtcaccatcacttgtcgggctagtcgggtcattggcagtgctttagcctggtatcagcagaaaccagggaagctcctaagctcctgatctttgatgcctcagttggaaagtgagtccatcagtcagcggcagtggatcgtggggacagatttcatcctcaccatcagcagcctgcagcctagaagtattcngacctaaccttattactgtacaaactaatttaaagatttaccctctcttccgttcggacggacgggtaaccaaggtcgaagtatacgaaaacgtaactgtacggctcgacaccta

SEQ ID NO: 309322 - DNA, 619 bp, Homo sapiens
  misc_feature: GZ8MTXP02IU9ZZ.25.86.H09.1.454.CMB.2.raw
  modified_base (280)..(280): a, c, t, g, unknown or other
  misc_feature (280)..(280): n is a, c, g, or t
  modified_base (359)..(359): a, c, t, g, unknown or other
  misc_feature (359)..(359): n is a, c, g, or t
tcagactgtacagtcacgaccggtgctcgatttagtgctatagacttgggtttgggggcaggagtcagacccactcaggacacagcatggacatgagggtccccgctcagctcctggggcttctgctgctctggctcccaggtgccaaatgtgccatccagttgacccagtctccatcctccctgtctgcctctgttcgagacatagtcaccatcacttgtcgggctagtcgggtcattggcagtgctttagcctggtatcagcagaaaccgaggggaanctcctaagctcctgatctttgatgcctctagtttggaaagtggagtccatcaagttcagcggcagtggatcgtgggacngatttcatcctcacatcagcagcctgcagcctagaaagtactttcgagtacctaaaccctttattaactttacgtaacctaaaacttaaattttaaacgggacttttaacccccttcgttcccgtttaccccggtttaccgggggaaccggggttaaacgggggaaacccgtaaaacgggggttcggggaaagtaaccgttaaaccgtaaaacggtaaacccgttggttacgggtccttacggacctaacccgtttaacg

SEQ ID NO: 309323 - DNA, 419 bp, Homo sapiens
  misc_feature: GZ8MTXP02IPZHZ.25.86.H09.1.454.CMB.2.raw
  modified_base (387)..(387): a, c, t, g, unknown or other
  misc_feature (387)..(387): n is a, c, g, or t
  modified_base (415)..(419): a, c, t, g, unknown or other
  misc_feature (415)..(419): n is a, c, g, or t
tcagactgtacagtcacgaccggtgctcgatttagtgctatagacttgggtttgggagaagaacctactatgcagactctgtgaagggtcgattcaccacctccagagacaacatcaagaactccctgtatctgcaaatggacagtctgacacctgatgacaccgccttgtattattgtgtgaaaggcggtgttgaggtgaatgcctggaacccccgcggtcagcactacttctacatgggcgtctggggcaaaggggactacggtcatcgtctcctcagccctccaccaagggccccatcggtcttccccctggccgccctgctccaggagcacctccgagagcacagcggccctgggctgcctggcaaggctacttccactgacngtctgagcgggctggcaaggcgcatagnnnnn

SEQ ID NO: 309324 - DNA, 560 bp, Homo sapiens
  misc_feature: GZ8MTXP02INQB8.25.86.H09.1.454.CMB.2.raw
tcagactgtacagtcacgaccggtgctcgatttagtgctatagacttgggtttggggagctctgggaaaggagccccagccctgagattcccaggtgattccattcggtgatcagcactgaacacagaactcaccatggagtttggactgagctgggttttccttgttgccattttaaaaggtgtccagtgtgaagtgcaactggtggagtctgggggagccgtggtacaggccggggggtccctgagactctcctgtgtagcctctggattcattgtttgatgattatgccatgcacttggggtccgtcgaaacgggtccggggaagggtctggaggttgggtctctcttatgacgttggggatggggagaagaacctactatgcagactctggtgaaggggtcattccaccacctccagagacaaacatacaaacgaactaccctagatctgacaaatgacagtctgacactgatgacacgccttagtattattgttagtagtaacggtcggttgttaggaaggttcgaagtcgccgtaccggaaccccgtggtaccg

SEQ ID NO: 309325 - DNA, 508 bp, Homo sapiens
  misc_feature: GZ8MTXP02G1ZQM.25.86.H09.1.454.CMB.2.raw
  modified_base (279)..(279): a, c, t, g, unknown or other
  misc_feature (279)..(279): n is a, c, g, or t
  modified_base (354)..(354): a, c, t, g, unknown or other
  misc_feature (354)..(354): n is a, c, g, or t
  modified_base (401)..(401): a, c, t, g, unknown or other
  misc_feature (401)..(401): n is a, c, g, or t
tcagactgtacagtcacgaccggtgctcgatttagtgctatagacttgggtttgggggcaggagtcagacccactcaggacacagcatggacatgagggtccccgctcagctcctggggcttctgctgctctggctcccaggtgccaaatgtgccatccagttgacccagtctccatcctccctgtctgcctctgttcgagacatagtcaccatcacttgtcgggctagtcgggtcattggcagtgctttagcctggtatcagcagaaaccaggggaanctcctaagctcctgatctttgatgcctcagtttggaaagtggacgtccatcgaaggttcagcggcagtggatcgngggacagtatttcatcctcacatcagcagcctgacagcctgaaagtnttctgactaaaccttattatctacaaactaatttaagactttaccctctctccgttcggcggacggtacaggtcgagactacgaaacgtacgtgcggctacgcactg

SEQ ID NO: 309326 - DNA, 520 bp, Homo sapiens
  misc_feature: GZ8MTXP02F4I2Z.25.86.H09.1.454.CMB.2.raw
  modified_base (367)..(367): a, c, t, g, unknown or other
  misc_feature (367)..(367): n is a, c, g, or t
tcagactgtacagtcacgaccggtgctcgatttagtgctatagacttgggtttggggcaggagtcagacccactcaggacacagcatggacatgagggtccccgctcagctcctggggcttctgctgctctggctcccaggtgccaaatgtgccatccagttgacccagtctccatcctccctgtctgcctctgttcgagacatagtcaccatcacttgtcgggctagtcgggtcattggcagtgctttagcctggtatcagcagaaaccaggggaagctcctaagctcctgatctttgatgcctcagtttgaaagtggagtccatcaagttcagcgcagtggatcgtgggacagatttcatccctnaccatcagcagcctgcagcctgaagattcctgacaaccttatttattgtacaaactaatttaaggatttaaccctcttctccgtttacgggcggtacggggaacccaaagggtcggaaagactacgaaaacgaactggtcggcctgccaccta

SEQ ID NO: 309327 - DNA, 507 bp, Homo sapiens
  misc_feature: GZ8MTXP02G7W72.25.86.H09.1.454.CMB.2.raw
  modified_base (275)..(275): a, c, t, g, unknown or other
  misc_feature (275)..(275): n is a, c, g, or t
  modified_base (395)..(395): a, c, t, g, unknown or other
  misc_feature (395)..(395): n is a, c, g, or t
  modified_base (441)..(441): a, c, t, g, unknown or other
  misc_feature (441)..(441): n is a, c, g, or t
tcagactgtacagtcacgaccggtgctcgatttagtgctatagacttgggtttgggggagtcagacccactcaggacacagcatggacatgagggtccccgctcagctcctggggcttctgctgctctggctcccaggtgccaaatgtgccatccagttgacccagtctccatcctccctgtctgcctctgttcgagacatagtcaccatcacttgtcgggctagtcgggtcattggcagtgctttagcctggtatcagcagaaaccaggggaanctcctaagctcctgatctttgatgcctcgagtttggaagtggatccatcaagtcagcgcagtgatcgtgggacagtatttcactcctcaccatcagcagccctgcacgctagagtattcncgacaaccttattacttgtacaaactaagtttaacgacttaccctntctcgttcggacggaggaccagggtgaacagtaccgaaacgactggcgactacgcaacctctctcg

SEQ ID NO: 309328 - DNA, 516 bp, Homo sapiens
  misc_feature: GZ8MTXP02IDZ94.25.86.H09.1.454.CMB.2.raw
  modified_base (482)..(482): a, c, t, g, unknown or other
  misc_feature (482)..(482): n is a, c, g, or t
tcagactgtacagtcacgaccggtgctcgatttagtgctatagacttgggtttgggggagtcagacccactcaggacacagcatggacatgagggtccccgctcagctcctggggcttctgctgctctggctcccaggtgccaaatgtgccatccagttgacccagtctccatcctccctgtctgcctctgttcgagacatagtcaccatcacttgtcgggctagtcgggtcattggcagtgctttagcctggtatcagcagaaccggggagctcctaagctcctgatctttgatgcctcagtttggaaagtggagtcccatcaaggttccagcggcagtggatctggggacagtatttcatcctcaccatcagcagcctgcagcctagaagattctgacctaaaccttatttattagtactaaacctaatttaaggactttaccctcttctccttcgggcggacgggaccaaggtcggaanacgtacaaacgtactgtgctacgcacatcagttc

SEQ ID NO: 309329 - DNA, 603 bp, Homo sapiens
  misc_feature: GZ8MTXP02I1OG2.25.86.H09.1.454.CMB.2.raw
tcagactgtacagtcacgaccggtgctcgatttagtgctatagacttgggtttgggggcaggagtcagacccactcaggacacagcatggacatgagggtccccgctcagctcctggggcttctgctgctctggctcccaggtgccaaatgtgccatccagttgacccagtctccatcctccctgtctgcctctgttcgagacatagtcaccatcacttgtcgggctaggtcgggtcagttggcagtgtctttagccgtggtatcagcaagaaaccgaggggaagcctacctaagctcctgacttctttgatcgcccttccgtagtttaggaaagtggacgtcccatcgaagttcaggtcggcagtggatcgtggggacagtactttcactccctcacctatcagcacgcctacgctagccctagaaacgtacttccgtacgtactaaccttatttacgttagtaacctaaacttaagtttaaacggtacctttaccctcttacccgttccggttacggggaccggggtaacgggaaaccgtaggggtaggaacgtaactaaccgaaaacgtaccgtaggtcggactacggaccctaacttcg

SEQ ID NO: 309330 - DNA, 591 bp, Homo sapiens
  misc_feature: GZ8MTXP02IXVDO.25.86.H09.1.454.CMB.2.raw
  modified_base (276)..(276): a, c, t, g, unknown or other
  misc_feature (276)..(276): n is a, c, g, or t
  modified_base (282)..(282): a, c, t, g, unknown or other
  misc_feature (282)..(282): n is a, c, g, or t
tcagactgtacagtcacgaccggtgctcgatttagtgctatagacttgggtttgggggagtcagacccactcaggacacagcatggacatgagggtccccgctcagctcctggggcttctgctgctctggctcccaggtgccaaatgtgccatccagttgacccagtctccatcctccctgtctgcctctgttcgagacatagtcaccatcacttgtcgggctagtcgggtcattggcagtgctttagcctggtatcagcagaaaccaggggaacnctacanctctgtattcttgatcgcctcgtagttaggaagtgacgtccagtacgtacgtcgaggcgacgtaggtggatcggtagggaactagttactttccactcctaccaaccacgtacacgcacgtcctagacacgctagaagtacttcgacgtacctaaactttattattacgtaaactaaacttaacgtttaacgtaccttacccttcgttccgtaccgttacgggacgggtaacgggtaccgtaagggtacggaacgtaacgtaacgtaaacgtacgtggtacggtactacgacctacgtacgtacgtacg

SEQ ID NO: 309331 - DNA, 501 bp, Homo sapiens
  misc_feature: GZ8MTXP02F5Q6T.25.86.H09.1.454.CMB.2.raw
  modified_base (274)..(274): a, c, t, g, unknown or other
  misc_feature (274)..(274): n is a, c, g, or t
  modified_base (437)..(437): a, c, t, g, unknown or other
  misc_feature (437)..(437): n is a, c, g, or t
tcagactgtacagtcacgaccggtgctcgatttagtgctatagacttgggtttggggagtcagacccactcaggacacagcatggacatgagggtccccgctcagctcctggggcttctgctgctctggctcccaggtgccaaatgtgccatccagttgacccagtctccatcctccctgtctgcctctgttcgagacatagtcaccatcacttgtcgggctagtcgggtcattggcagtgctttagcctggtatcagcagaaaccaggggaanctccaagctcctgatctttgatgcctcagtttggaaagtggagtccatcaaggttcagcgcagtggatcgtgggacagatttcatcctcaccatcagcagcctgcagcctgaagattctgctaacctattacttgtacaaactaatttaaggatttacccctnttctccttcggcgagggaccaagggtgagactacaaacgaactgtcggctgactaccgatctcg

SEQ ID NO: 309332 - DNA, 587 bp, Homo sapiens
  misc_feature: GZ8MTXP02GUMWJ.25.86.H09.1.454.CMB.2.raw
  modified_base (286)..(286): a, c, t, g, unknown or other
  misc_feature (286)..(286): n is a, c, g, or t
  modified_base (299)..(299): a, c, t, g, unknown or other
  misc_feature (299)..(299): n is a, c, g, or t
  modified_base (388)..(388): a, c, t, g, unknown or other
  misc_feature (388)..(388): n is a, c, g, or t
tcagactgtacagtcacgaccggtgctcgatttagtgctatagacttgggtttgggggcaggagtcagacccactcaggacacagcatggacatgagggtccccgctcagctcctggggcttctgctgctctggctcccaggtgccaaatgtgccatccagttgacccagtctccatcctccctgtctgcctctgttcgagacatagtcaccatctacttggtcgggctaggtcgggtctagttggcagtgctttagcctggtatcagcaagaaaccgaggggaanctactaagctccngattcttgatcgccctcgtaggtttagaaagtggacgtccatacgaagttcagcggcagtcggatcgtagggacagtatttcacttccncaaccatcagcacgcctgcagcctagaaagtctttcacgtactaaaccttagttattacgtaactaaaacttaagtttaaacggtacctttaacccgtcttcccttacgttaccggggacggtaacgggaaaccgtaaggggttagaacggtaactaacgaaaacggtaacgtaggtcggactcggaaccacgttaacg

SEQ ID NO: 309333 - DNA, 550 bp, Homo sapiens
  misc_feature: GZ8MTXP02GR0CU.25.86.H09.1.454.CMB.2.raw
  modified_base (276)..(276): a, c, t, g, unknown or other
  misc_feature (276)..(276): n is a, c, g, or t
  modified_base (340)..(340): a, c, t, g, unknown or other
  misc_feature (340)..(340): n is a, c, g, or t
  modified_base (376)..(376): a, c, t, g, unknown or other
  misc_feature (376)..(376): n is a, c, g, or t
tcagactgtacagtcacgaccggtgctcgatttagtgctatagacttgggtttgggggagtcagacccactcaggacacagcatggacatgagggtccccgctcagctcctggggcttctgctgctctggctcccaggtgccaaatgtgccatccagttgacccagtctccatcctccctgtctgcctctgttcgagacatagtcaccatcacttgtcgggctaggtcggtcattggcagtgctttagcctggtatcagcaagaaaccaggggaanctctaagctcctgatcttgatgcctcagtttggaaagtggacgtcccatacaaggttcagcganagtgatcgtgggactagtatttcatcctacacctancagcacgcctgcagactagaatcttcagacctaaactttattatacgtaactaaacttaagtttaacgtacctttacctcttccgtaccggtacgggacgggaacggacgtaagggtacgaacgtacgtaacgaaacgtacgtcggtcgactacgacctaccgtacgttcttcg

SEQ ID NO: 309334 - DNA, 575 bp, Homo sapiens
  misc_feature: GZ8MTXP02JR9O8.25.86.H09.1.454.CMB.2.raw
  modified_base (400)..(400): a, c, t, g, unknown or other
  misc_feature (400)..(400): n is a, c, g, or t
tcagactgtacagtcacgaccggtgctcgatttagtgctatagacttgggtttgggggagtcatacccactcaggacacagcatggacatgagggtccccgctcagctcctggggcttctgctgctctggctcccaggtgccaaatgtgccatccagttgacccagtctccatcctccctgtctgcctctgttcgagacatagtcaccatcacttgtcgggctagtcgggtcattggcagtgctttagcctggtatcagcagaaaccaggggaagctcctaagctcctgatcttgatgcctcgagtttggaaagtggacgtcccatcaagttcagcggcagtggatcgtgggacagtattcatcctcaccatcagcagcctgcagcctagagtattccgnactaaccttatttactgtactaaactaagtttaaacggactttacccctcgttaccgtcccgttccggggaccggaaggggacccttaaggggtacggaaagtacgttaaccgaaaaccgtaaccgtggttaacgggaccttcggaaccgttacccgtaagtttacccgtttacg

SEQ ID NO: 309335 - DNA, 612 bp, Homo sapiens
  misc_feature: GZ8MTXP02JL797.25.86.H09.1.454.CMB.2.raw
  modified_base (276)..(276): a, c, t, g, unknown or other
  misc_feature (276)..(276): n is a, c, g, or t
tcagactgtacagtcacgaccggtgctcgatttagtgctatagacttgggtttgggggagtcagacccactcaggacacagcatggacatgagggtccccgctcagctcctggggcttctgctgctctggctcccaggtgccaaatgtgccatccagttgacccagtctccatcctccctgtctgcctctgttcgagacatagtcaccatcacttgtcgggctagtcgggtcattggcagtgctttagcctggtatcagcagaaaccaggggaacnctactagctctgtattcttgatcgcctcgtaggttaggaagtggacgtccagtacgtacgtcaggcgacgtaggtggtatcggtagggaactagttacttccactccctaccaacctactacacgcacgtccgtcgcgacgacgtacgtacgtacgttactacgtacctaacttacttattacgtaactaaacttaaacgttaacgttacttaccttaccttaccgttccgttaccgggtaccgggtacgggtaaccggtaacgggtacggtaacgtaacgtaacgtaacgtaacgtaacggtacggtacgtacgtacgtaccgtacgttacgtcg

SEQ ID NO: 309336 - DNA, 535 bp, Homo sapiens
  misc_feature: GZ8MTXP02GSN62.25.86.H09.1.454.CMB.2.raw
tcagactgtacagtcacgaccggtgctcgatttagtgctatagacttgggtttgggggagtcagacccactcaggacacagcatggacatgagggtccccgctcagctcctggggcttctgctgctctggctcccaggtgccaaatgtgccatccagttgacccagtctccatcctccctgtctgcctctgttcgagacatagtcaccatcacttgtcgggctagtcgggtcattggcagtgctttagcctggtatcagcagaaaccaggggaagctcctaagctcctgatctttgatgcctcagtttggaagtggagtcccatcaaggttcagcgcagtggatcgtgggacagatttcatcctcaccatcagcagcctgcagcctagagtattctgacctaaccttattattagtactaaactaatttaaggtactttaccctctcgttccgttacggacggacgggtaccgaaagggttggaacgacgtaccgaaacgtaacgtggtacggctacgaccacctacttcgttcg

SEQ ID NO: 309337 - DNA, 534 bp, Homo sapiens
  misc_feature: GZ8MTXP02IZ7VS.25.86.H09.1.454.CMB.2.raw
  modified_base (366)..(366): a, c, t, g, unknown or other
  misc_feature (366)..(366): n is a, c, g, or t
  modified_base (389)..(389): a, c, t, g, unknown or other
  misc_feature (389)..(389): n is a, c, g, or t
tcagactgtacagtcacgaccggtgctcgatttagtgctatagacttgggtttgggggagtcagacccactcaggacacagcatggacatgagggtccccgctcagctcctggggcttctgctgctctggctcccaggtgccaaatgtgccatccagttgacccagtctccatcctccctgtctgcctctgttcgagacatagtcaccatcacttgtcgggctagtcgggtcattggcagtgctttagcctggtatcagcagaaaccgaggggaagctcctaagctcctgatctttgatgcctcagtttggaagtgatccatcaagttcagcgcagtggatgtgggacagtatttcatcctcaccntcagcagcctgcagcctagaagnttctgacctaaacttattagttagtactaaactaagtttaaaggactttacccttcttcctccgtttcgggaccggaggggaaccaggggtagacggactaaccgaaaacggtaactggtacggtacgtcgacaacctactctcg

SEQ ID NO: 309338 - DNA, 496 bp, Homo sapiens
  misc_feature: GZ8MTXP02FKEQO.25.86.H09.1.454.CMB.2.raw
  modified_base (279)..(279): a, c, t, g, unknown or other
  misc_feature (279)..(279): n is a, c, g, or t
tcagactgtacagtcacgaccggtgctcgatttagtgctatagacttgggtttgggggcaggagtcagacccactcaggacacagcatggacatgagggtccccgctcagctcctggggcttctgctgctctggctcccaggtgccaaatgtgccatccagttgacccagtctccatcctccctgtctgcctctgttcgagacatagtcaccatcacttgtcgggctagtcgggtcattggcagtgctttagcctggtatcagcagaaaccaggggaanctcctaagctcctgatctttgatgcctccagtttgaaagtggagtccatcaagttcagcggcagtggatctgggacagatttcatcctcaccatcagcagcctgcagcctgaagatctgcaacctattatgtcaacaatttaaggattaccctctctccttcggcggagggaccaaggtcggagatacaaaacgtaacgtgtacggctggacaccta

SEQ ID NO: 309339 - DNA, 526 bp, Homo sapiens
  misc_feature: GZ8MTXP02FI8ON.25.86.H09.1.454.CMB.2.raw
  modified_base (281)..(281): a, c, t, g, unknown or other
  misc_feature (281)..(281): n is a, c, g, or t
tcagactgtacagtcacgaccggtgctcgatttagtgctatagacttgggtttgggggcaggagtcagacccactcaggacacagcatggacatgagggtccccgctcagctcctggggcttctgctgctctggctcccaggtgccaaatgtgccatccagttgacccagtctccatcctccctgtctgcctctgttcgagacatagtcaccatcacttgtcgggctagtcgggtcattggcagtgctttagcctggtatcagcaagaaaccgaggggaanctcctaagctcctgatctttgatgcctcagtttggaaagtggacgtccatcaagtcagcggcagtgatcgtgggacagtatttcatcctcaccatcagcagcctgacagcctagaacgtattctcgactaaccttattattacgtactaaactaaatttaacggacttaccctctcttaccgttcgggacggtacgggacgaagggtcggacgactacaaacggactggacgcgtcgacacgtac

SEQ ID NO: 309340 - DNA, 654 bp, Homo sapiens
  misc_feature: GZ8MTXP02ITD22.25.86.H09.1.454.CMB.2.raw
  modified_base (279)..(279): a, c, t, g, unknown or other
  misc_feature (279)..(279): n is a, c, g, or t
tcagactgtacagtcacgaccggtgctcgatttagtgctatagacttgggtttgggggcaggagtcagacccactcaggacacagcatggacatgagggtccccgctcagctcctggggcttctgctgctctggctcccaggtgccaaatgtgccatccagttgacccagtctccatcctccctgtctgcctctgttcgagacatagtcaccatcacttgtcgggctagtcgggtcattggcagtgctttagcctggtatcagcagaaaccaggggaanctactaagctctgatctttgatgcctcagtttaggaaaagtggagtcccaatacgaagttcagcggacagtggatcgtaggacgagtattactactacctccaccaactacacgacacgaccgtcgacgacgacctacgtaaagtaacttacttacgtacctaaacccttaaactttaaatttaacgttaactaaaacttaaaaacgtttaaaacggttaaacgtttaaccccttacccttacccgttacccgtttacccgggtaccgggggtaaacgggggaaacccggtaaaacggggtaacgggtaacggtaaacgtaaaccgtaaaaaccgtaaaaccgtaacggtacggtacgtacgtaccgaacctaac

SEQ ID NO: 309341 - DNA, 546 bp, Homo sapiens
  misc_feature: GZ8MTXP02H6MHA.25.86.H09.1.454.CMB.2.raw
  modified_base (279)..(279): a, c, t, g, unknown or other
  misc_feature (279)..(279): n is a, c, g, or t
  modified_base (402)..(402): a, c, t, g, unknown or other
  misc_feature (402)..(402): n is a, c, g, or t
  modified_base (407)..(407): a, c, t, g, unknown or other
  misc_feature (407)..(407): n is a, c, g, or t
tcagactgtacagtcacgaccggtgctcgatttagtgctatagacttgggtttgggggcaggagtcagacccactcaggacacagcatggacatgagggtccccgctcagctcctggggcttctgctgctctggctcccaggtgccaaatgtgccatccagttgacccagtctccatcctccctgtctgcctctgttcgagacatagtcaccatcacttgtcgggctagtcgggtcattggcagtgctttagcctggtatcagcagaaaccaggggaanctcctaagctcctgatctttgatgcctctagttggaaagtggagtccatcaaggttcagcggcagtggatcgtgggacagtatttcatccctacaccatcagcagcctagcagccagaaagtnttcgngacaacttatttattgtacaaactaatttaaggactttaccctacttccttaccgttcgggaccgggtaacgggacccgtaaagggttggaacgtactaacgaaaacgtacgttaggtacggactacggacctaacctc

SEQ ID NO: 309342 - DNA, 602 bp, Homo sapiens
  misc_feature: GZ8MTXP02IQMBD.25.86.H09.1.454.CMB.2.raw
  modified_base (275)..(275): a, c, t, g, unknown or other
  misc_feature (275)..(275): n is a, c, g, or t
  modified_base (395)..(395): a, c, t, g, unknown or other
  misc_feature (395)..(395): n is a, c, g, or t
tcagactgtacagtcacgaccggtgctcgatttagtgctatagacttgggtttgggggagtcagacccactcaggacacagcatggacatgagggtccccgctcagctcctggggcttctgctgctctggctcccaggtgccaaatgtgccatccagttgacccagtctccatcctccctgtctgcctctgttcgagacatagtcaccatcacttgtcgggctagtcgggtcattggcagtgctttagcctggtatcagcagaaaccaggggaanctcctaagctcctgatctttgatgcctcagtttggaagtggatccatcaaggttcagcggcagtggatcgtgggacagtatttcattcctcaccatcagcagcctgccagcctagaaagnttctacgtacctaaacctttatttacgtttacgtaacctaaacttaaagtttaacggtactttaaccccttctttaccgttcccgtttccgggaccggggtaacggggtaacccgtaaaggggttacgggaaacgtaacgtaaccgtaaaaccggtaacgttcgggtacggtaccgttacggacctaacccgtactttaccgtttcg

SEQ ID NO: 309343 - DNA, 636 bp, Homo sapiens
  misc_feature: GZ8MTXP02ILP3L.25.86.H09.1.454.CMB.2.raw
  modified_base (274)..(274): a, c, t, g, unknown or other
  misc_feature (274)..(274): n is a, c, g, or t
tcagactgtacagtcacgaccggtgctcgatttagtgctatagacttgggtttggggagtcagacccactcaggacacagcatggacatgagggtcccgctcagctcctggggcttctgctgctctggctcccaggtgccaaatgtgccatccagttgacccagtctccatcctccctgtctgcctctgttcgagacatagtcaccatcacttgtcgggctagtcgggtcattggcagtgctttagctggtatcagcaagaaaccaggggaacnctacagctctgtattcttgatcgtcctacgtaggtttaggaagtggactccagtacgtaacggtcagcggactaggtaggactcggtagggaactagtacttccactcctacacatacacgacacgctacgacgacgtacgtagaagtacttactacgtaactaaacttaactttaacttacgttaaactaaaacgttaaaacgttaaacgttaacttacccttaccttaccgttaccggttaccggggtaaccggggtaaacggggtaaaccggtaaacgggtaacgggtaaacggtaacgtaaacgtaaaacgtaaacgtaacggtacggtacgtacgtaccgtacctacgttacgtacg

SEQ ID NO: 309344 - DNA, 518 bp, Homo sapiens
  misc_feature: GZ8MTXP02HMURA.25.86.H09.1.454.CMB.2.raw
  modified_base (343)..(343): a, c, t, g, unknown or other
  misc_feature (343)..(343): n is a, c, g, or t
  modified_base (397)..(397): a, c, t, g, unknown or other
  misc_feature (397)..(397): n is a, c, g, or t
  modified_base (400)..(400): a, c, t, g, unknown or other
  misc_feature (400)..(400): n is a, c, g, or t
  modified_base (415)..(415): a, c, t, g, unknown or other
  misc_feature (415)..(415): n is a, c, g, or t
tcagactgtacagtcacgaccggtgctcgatttagtgctatagacttgggtttgggggagtcagacccactcaggacacagcatggacatgagggtccccgctcagctcctggggcttctgctgctctggctcccaggtgccaaatgtgccatccagttgacccagtctccatcctccctgtctgcctctgttcgagacatagtcaccatcacttgtcgggctagtcgggtcattggcagtgctttagcctggtatcagcaagaaaccgaggggaagctacctaagctcctgattcttgatcgcctcaggtttggaagtggacgtccatcgaaggtcagcggnagtggatcgtgggactagtattcatcctcaccatcagcagctgcagctagaatntcngactaacttattatntaacaactaattaacgtacttacctcttcgtccgttcggacggtacgggacaagggtgagactacgaaacgtacgtggtcggactcgactacctagttcttcg

SEQ ID NO: 309345 - DNA, 513 bp, Homo sapiens
  misc_feature: GZ8MTXP02JJA9U.25.86.H09.1.454.CMB.2.raw
  modified_base (347)..(347): a, c, t, g, unknown or other
  misc_feature (347)..(347): n is a, c, g, or t
  modified_base (401)..(401): a, c, t, g, unknown or other
  misc_feature (401)..(401): n is a, c, g, or t
  modified_base (405)..(405): a, c, t, g, unknown or other
  misc_feature (405)..(405): n is a, c, g, or t
  modified_base (508)..(508): a, c, t, g, unknown or other
  misc_feature (508)..(508): n is a, c, g, or t
tcagactgtacagtcacgaccggtgctcgatttagtgctatagacttgggtttgggggagtcagacccactcaggacacagcatggacatgagggtccccgctcagctcctggggcttctgctgctctggctcccaggtgccaaatgtgccatccagttgacccagtcctccatcctccctgtctgcctctgttcgagacatagtcaccatcacttggtcgggctagtcgggtcattggcagtgctttagcctggtatcagcaagaaaccgaggggagctcctaagcctcctgtattctttgatgcctcgagtttggaaagtggacgtccatcgaaggtcagcggcngtgatcgtgggacagtattcatcctacacatcagcagccctgccagcctagagnttcngacctactattatagtacaataagttaagtacttacctctctaccgtcggacggagaccgaaggtgagtactacgaaacgactaagtcggactcgccaacctntctcg

SEQ ID NO: 309346 - DNA, 537 bp, Homo sapiens
  misc_feature: GZ8MTXP02GAQ69.25.86.H09.1.454.CMB.2.raw
  modified_base (423)..(423): a, c, t, g, unknown or other
  misc_feature (423)..(423): n is a, c, g, or t
  modified_base (532)..(532): a, c, t, g, unknown or other
  misc_feature (532)..(532): n is a, c, g, or t
tcagactgtacagtcacgaccggtgctcgatttagtgctatagacttaggtttggggagctctgggaaaggagccccagccctgagattcccaggtgattccattcggtgatcagcactgaacacagaactcaccatggagtttggactgagctgggttttccttgttgccattttaaaaggtgtccagtgtgaagtgcaactggtggagtcgtgggggagccgtggtacaggccggggggtccctgagactctcctgtgtagcctctggattcatgtttgatgattatgccatgcactgggtccgtcaagggtccggggaagggtctgggagtgggtctctcttatgacttggggatggggagaacgaacctactatgcagactcgtgtagaagggtcgattccaccactccagacgacaanatacaaagactccctgtatctgacaatgacagtctgacactgatgacacgtcttgtattattgtgtagaaggcggtgttaggaagtgaagtcgaccgtcggaaccccgngtacg

SEQ ID NO: 309347 - DNA, 566 bp, Homo sapiens
  misc_feature: GZ8MTXP02JRSOV.25.86.H09.1.454.CMB.2.raw
  modified_base (325)..(325): a, c, t, g, unknown or other
  misc_feature (325)..(325): n is a, c, g, or t
tcagactgtacagtcacgaccggtgctcgatttagtgctatagacttgggtttgggggagtcagacccactcaggacacagcatggacatgagggtccccgctcagctcctggggcttctgctgctctggctcccaggtgccaaatgtgccatccagttgacccagtctccatcctccctgtctgcctctgttcgagacatagtcaccatcacttgtcgggctagtcgggtcattggcagtgctttagcctggtatcagcagaaaccaggggaagctcctaagctcctgatcttgatgcctcagtttgaagtgatccatcaagtnagcgcagtggatcgtgggacagattcatcctcaccatcagcagcctgcacgcctagaagtattctagacctaaccttatttattacgtactaaactaaaagtttaacggtaactttacccctcttaccgtcccgttacggggtaccgggtaacggggaaacccgtaaacggggtaggtaaacggtacttaaccgaaaaccgtaacgtggtacggcgtacggacctaccgtacttctttacg

SEQ ID NO: 309348 - DNA, 496 bp, Homo sapiens
  misc_feature: GZ8MTXP02JYC98.25.86.H09.1.454.CMB.2.raw
  modified_base (267)..(267): a, c, t, g, unknown or other
  misc_feature (267)..(267): n is a, c, g, or t
  modified_base (391)..(391): a, c, t, g, unknown or other
  misc_feature (391)..(391): n is a, c, g, or t
  modified_base (395)..(395): a, c, t, g, unknown or other
  misc_feature (395)..(395): n is a, c, g, or t
  modified_base (484)..(484): a, c, t, g, unknown or other
  misc_feature (484)..(484): n is a, c, g, or t
  modified_base (486)..(486): a, c, t, g, unknown or other
  misc_feature (486)..(486): n is a, c, g, or t
tcagactgtacagtcacgaccggtgctcgatttagtgctatagacttgggtttggggagtcagacccactcaggacacagcatggacatgagggtccccgctcagctcctggggcttctgctgctctggctcccaggtgccaaatgtgccatccagttgacccagtctccatcctccctgtctgcctctgttcgagacatagtcaccatcacttgtcgggctagtcgggtcattggcagtgctttagcctggtatcagcagaaaccnggggaagctcctaagctcctgatcttgatgcctcagtttggaatggagtccatcaaggttcagcggcagtggatcgtgggacagatttcatcctcaccatcagcagccctgcagcctgaacgtnttcngacaacttattattgtactaactaagtttaacgacttaccctctctcgtcgggcggacggacgacggtgagacacgaacgacgtgcgcncncactactctg

SEQ ID NO: 309349 - DNA, 540 bp, Homo sapiens
  misc_feature: GZ8MTXP02FR961.25.86.H09.1.454.CMB.2.raw
  modified_base (383)..(383): a, c, t, g, unknown or other
  misc_feature (383)..(383): n is a, c, g, or t
  modified_base (412)..(412): a, c, t, g, unknown or other
  misc_feature (412)..(412): n is a, c, g, or t
  modified_base (417)..(417): a, c, t, g, unknown or other
  misc_feature (417)..(417): n is a, c, g, or t
  modified_base (419)..(419): a, c, t, g, unknown or other
  misc_feature (419)..(419): n is a, c, g, or t
  modified_base (433)..(433): a, c, t, g, unknown or other
  misc_feature (433)..(433): n is a, c, g, or t
  modified_base (483)..(483): a, c, t, g, unknown or other
  misc_feature (483)..(483): n is a, c, g, or t
tcagactgtacagtcacgaccggtgctcgatttagtgctatagacttgggtttggggagctctgggaaaggagccccagccctgagattcccaggtgattccattcggtgatcagcactgaacacagaactcaccatggagtttggactgagctgggttttccttgttgccattttaaaaggtgtccagtgtgaagtgcaactggtggagtctgggggagccgtggtacaggccggggggtccctgagactctcctgtgtagcctctggattcatgtttgatgattatgccatgcactgggtccgcgaagggtccggggaaggtcgtggagtggggtctctctttatgcgttgggatgggagaagaactactatgcagacctntgtagaagggtcattcaccacctccaganacaanancaaagactccctanatctagacaaatggacaagtctacgacacctgactcgaccaccgtccttntattatgtgttagaacggtcgtgtgaaggtcaagtcgactcggaacccccggcgtcg

SEQ ID NO: 309350 - DNA, 499 bp, Homo sapiens
  misc_feature: GZ8MTXP02H8HAF.25.86.H09.1.454.CMB.2.raw
tcagactgtacagtcacgaccggtgctcgatttagtgctatagacttgggtttggggagtcagacccactcaggacacagcatggacatgagggtccccgctcagctcctggggcttctgctgctctggctcccaggtgccaaatgtgccatccagttgacccagtctccatcctccctgtctgcctctgttcgagacatagtcaccatcacttgtcgggctagtcgggtcattggcagtgctttagcctggtatcagcagaaaccaggggaagctcctaagctcctgatctttgatgcctccagtttggaaagtggagtcccatcaaggttcagcggcagtggatcgtgggacagatttcatcctcaccatcagcagcctgcagcctgagattctgcaaacctattattgtacaactaatttaaggattaccctcttctccttcggcggagggaccaaggtcggagactacaaacgaactgtaggctcgcaccatctg

SEQ ID NO: 309351 - DNA, 550 bp, Homo sapiens
  misc_feature: GZ8MTXP02JR51I.25.86.H09.1.454.CMB.2.raw
  modified_base (407)..(407): a, c, t, g, unknown or other
  misc_feature (407)..(407): n is a, c, g, or t
tcagactgtacagtcacgaccggtgctcgatttagtgctatagacttgggtttgggggcaggagtcagacccactcaggacacagcatggacatgagggtccccgctcagctcctggggcttctgctgctctggctcccaggtgccaaatgtgccatccagttgacccagtctccatcctccctgtctgcctctgttcgagacatagtcaccatcacttgtcgggctagtcgggtcattggcagtgctttagcctggtatcagcagaaaccaggggaagctctaagctcctgatctttgatgcctccagtttggaaagtggagtccatcaaggttcagcggcagtggatcgtgggacagtatttcatccctcaccatcagcagccctagcagcctagaaagtattcngactaaccttattattcgtactaaactaaagtttaacggactttacccctctaccttccgttcgggacggggaacggtacccgaaaggggtgaacgtaactaccgaaaacggtacttggtacgggctacggacctaaccctag

SEQ ID NO: 309352 - DNA, 576 bp, Homo sapiens
  misc_feature: GZ8MTXP02GIP4M.25.86.H09.1.454.CMB.2.raw
  modified_base (279)..(279): a, c, t, g, unknown or other
  misc_feature (279)..(279): n is a, c, g, or t
tcagactgtacagtcacgaccggtgctcgatttagtgctatagacttgggtttgggggcaggagtcagacccactcaggacacagcatggacatgagggtccccgctcagctcctggggcttctgctgctctggctcccaggtgccaaatgtgccatccagttgacccagtctccatcctccctgtctgcctctgttcgagacatagtcaccatcacttgtcgggctagtcgggtcattggcagtgcttagcctggtatcagcagaaaccgaggggaanctccaagctcctgatctttgatgcctcagtttggaaagtggagtccatcaaggttcagcggcagtggatcgtgggacagtatttcatcctcaccatcagcacgcctgcacgcctagaagtattctcgactaaccttattattacgtactaaactaaagtttaaacggtaactttaaccctcttaccgggggttccttccggggtaccgggtacggggaaccggtaaacgggtagggtaacgtaacgttaaccgaaaaccggtaaacgtacggttacggaccgtcgaccgaccgtacg

SEQ ID NO: 309353 - DNA, 509 bp, Homo sapiens
  misc_feature: GZ8MTXP02HED2A.25.86.H09.1.454.CMB.2.raw
  modified_base (396)..(396): a, c, t, g, unknown or other
  misc_feature (396)..(396): n is a, c, g, or t
tcagactgtacagtcacgaccggtgctcgatttagtgctatagacttgggtttgggggagtcagacccactcaggacacagcatggacatgagggtccccgctcagctcctggggcttctgctgctctggctcccaggtgccaaatgtgccatccagttgacccagtctccatcctccctgtctgcctctgttcgagacatagtcaccatcacttgtcgggctagtcgggtcattggcagtgctttagcctggtatcagcaagaaaccaggggaagctacctaagctcctgatctttgatgcctcagtttggaaagtggagtccatcaaggtcagcgcagtgatcgtgggacagtattcatcctcaccatcagcagcctgcagcctgaagattccngaccaaactttattagttctaacaaactaagtttaagactttaccctcttcctccgttcggcggaagggtaccaggtgaagactacaaagactgtacggctcgcaccatcttg

SEQ ID NO: 309354 - DNA, 545 bp, Homo sapiens
  misc_feature: GZ8MTXP02FXKL4.25.86.H09.1.454.CMB.2.raw
  modified_base (281)..(281): a, c, t, g, unknown or other
  misc_feature (281)..(281): n is a, c, g, or t
tcagactgtacagtcacgaccggtgctcgatttagtgctatagacttgggtttgggggcaggagtcagacccactcaggacacagcatggacatgagggtccccgctcagctcctggggcttctgctgctctggctcccaggtgccaaatgtgccatccagttgacccagtctccatcctccctgtctgcctctgttcgagacatagtcaccatcacttgtcgggctagtcgggtcattggcagtgctttagcctggtatcagcaagaaaccgaggggaanctacctaagctcctgattctttgatcgcctccgtaggtttaggaaagtggacgtccatcgaagttcagcggcagtggatcgtgggacagtatttcactcctcaccatcagcacgcctgcagcctagaacgtattctgactaaccttattattacgactaaataatttaaacggactttaaccctctccgttaccgttcggacggtacggaccgaaaggtggaacgacttacgaaaacgtaacgtgtacggctcggactacctaa

SEQ ID NO: 309355 - DNA, 581 bp, Homo sapiens
  misc_feature: GZ8MTXP02JX4MH.25.86.H09.1.454.CMB.2.raw
  modified_base (280)..(280): a, c, t, g, unknown or other
  misc_feature (280)..(280): n is a, c, g, or t
  modified_base (409)..(409): a, c, t, g, unknown or other
  misc_feature (409)..(409): n is a, c, g, or t
  modified_base (413)..(413): a, c, t, g, unknown or other
  misc_feature (413)..(413): n is a, c, g, or t
tcagactgtacagtcacgaccggtgctcgatttagtgctatagacttgggtttgggggcaggagtcagacccactcaggacacagcatggacatgagggtccccgctcagctcctggggcttctgctgctctggctcccaggtgccaaatgtgccatccagttgacccagtctccatcctccctgtctgcctctgttcgagacatagtcaccatcacttgtcgggctagtcgggtcattggcagtgctttagcctggtatcagcaagaaaccaggggaanctcctaagcctcctgatctttgatcgcctcctagtttggaaagtggacgtccatcaaggttcaggcggcaggtggatcgtgggacagtatttcatccctcaccatcagcagcctgcagcctagaaagtnttcngacctaaccttatttacttagtacaaacttaagtttaacggacctttaccctacttaccgttcccgtttacggggaccggggaacgggtaaccgtaaacggggtggaacgtaacgtaacgaaaacggtaaccgttagggtcggtaccgttacggacctaacccgtacg

SEQ ID NO: 309356 - DNA, 452 bp, Homo sapiens
  misc_feature: GZ8MTXP02G2OJ5.25.86.H09.1.454.CMB.2.raw
  modified_base (218)..(218): a, c, t, g, unknown or other
  misc_feature (218)..(218): n is a, c, g, or t
  modified_base (442)..(452): a, c, t, g, unknown or other
  misc_feature (442)..(452): n is a, c, g, or t
tcagactgtacagtcacgaccggtgctcgatttagtgctatagacttgggtttgggagaagaacctactatgcagactctgtgaagggtcgattcaccacctccagagacaacatcaagaactccctgtatctgcaaatggacagtctgacacctgatgacaccgccttgtattattgtgtgaaaggcggtgttgaggtgaatgcctggaacccccgnggtcagcactacttctacatgggcgtcgtggggcaaaggggactacggtcatcgtctcctcagccctccaccgaacgggccccagtccggtccttcccccgtggccgccctgctccgaggacgccacctccgagacgcacacgccggccctgggctcgcctgggtcaacggctactccactgtacagtctggacggcggggctgggcgaagggccgacagtagnnnnnnnnnnn

SEQ ID NO: 309357 - DNA, 590 bp, Homo sapiens
  misc_feature: GZ8MTXP02GB88R.25.86.H09.1.454.CMB.2.raw
  modified_base (281)..(281): a, c, t, g, unknown or other
  misc_feature (281)..(281): n is a, c, g, or t
tcagactgtacagtcacgaccggtgctcgatttagtgctatagacttgggtttgggggcaggagtcagacccactcaggacacagcatggacatgagggtccccgctcagctcctggggcttctgctgctctggctcccaggtgccaaatgtgccatccagttgacccagtctccatcctccctgtctgcctctgttcgagacatagtcaccatcacttgtcgggctagtcgggtcattggcagtgctttagcctggtatcagcaagaaaccgaggggaanctacctaagctcctgattcttgatgccctctaggtttggaaagtggacgtccatcgaaggttcagcggcagtggatcgtaggggacagtatttcacttccctcaccctatcagcacgcctgacagacctagaaagtactttcgtacgacctaaccttatttacttacgtaacctaaacttaaagtttaacggtacctttacccgtaccttccttccgttaccggggaccggggtaacgggtacccgtaagggtcgggaacgtaacttaaccgaaaacgtacgttaggtcggaccttcgactaaccctag

SEQ ID NO: 309358 - DNA, 596 bp, Homo sapiens
  misc_feature: GZ8MTXP02IWN58.25.86.H09.1.454.CMB.2.raw
  modified_base (278)..(278): a, c, t, g, unknown or other
  misc_feature (278)..(278): n is a, c, g, or t
tcagactgtacagtcacgaccggtgctcgatttagtgctatagacttgggtttgggggagtcagacccactcaggacacagcatggacatgagggtccccgctcagctcctggggcttctgctgctctggctcccaggtgccaaatgtgccatccagttgacccagtctccatcctccctgtctgcctctgttcgagacatagtcaccatcacttggtcgggctagtcgggtcattggcagtgctttagcctggtatcagcaagaaaccgaggggaanctacctaagctcctgatctttgatcgtcctctaggtttggaaagtggacgtcccatacgaaggttcagcgcaggtggatcgtgggacagtattcatcctacacatcagcagcctgacagtccgtagaagtacttctacgtacctaaacctttatttattacgttaacctaaaacttaaagttttaaacggtactttaaccccgttcttacccgttccgtttaccggggtaccgggaacggggtaaacccgtaaaggggtaggaaacgtacgtaaaccgaaacgtaaccgtggtacggctacgactacctattcgttcg

SEQ ID NO: 309359 - DNA, 575 bp, Homo sapiens
  misc_feature: GZ8MTXP02JJWW6.25.86.H09.1.454.CMB.2.raw
  modified_base (385)..(385): a, c, t, g, unknown or other
  misc_feature (385)..(385): n is a, c, g, or t
tcagactgtacagtcacgaccggtgctcgatttagtgctatagacttgggtttggggagctctgggaaaggagccccagccctgagattcccaggtgattccattcggtgatcagcactgaacacagaactcaccatggagtttggactgagctgggttttccttgttgccattttaaaaggtgtccagtgtgaagtgcaactggtggagtcgtgggggagccgtggtacaggccgggggggtccctgagactctcctgtgtagcctctggattcatgtttgatgattatgccatgcacgtgggtccgtcgaagggtccggggaaggtcgtggaggtgggtctcgtcttatgtacgttgggatggggagaagaacctactatgcngactctgtgaagggtcgattccaccgacctccagagacaacatacaagaacctccctagtactctgactaaagtgacacgtctacgacacctgatcgaccacgtcctttagtattagttgtagtacggtaaggtcggtgttaggaagggttagaacgtcggtaccgtaccggaacccccgggcggtaccg

SEQ ID NO: 309360 - DNA, 529 bp, Homo sapiens
  misc_feature: GZ8MTXP02JSQAO.25.86.H09.1.454.CMB.2.raw
  modified_base (279)..(279): a, c, t, g, unknown or other
  misc_feature (279)..(279): n is a, c, g, or t
  modified_base (372)..(372): a, c, t, g, unknown or other
  misc_feature (372)..(372): n is a, c, g, or t
  modified_base (399)..(399): a, c, t, g, unknown or other
  misc_feature (399)..(399): n is a, c, g, or t
tcagactgtacagtcacgaccggtgctcgatttagtgctatagacttgggtttgggggcaggagtcagacccactcaggacacagcatggacatgagggtccccgctcagctcctggggcttctgctgctctggctcccaggtgccaaatgtgccatccagttgacccagtctccatcctccctgtctgcctctgttcgagacatagtcaccatcacttgtcgggctagtcgggtcattggcagtgctttagcctggtatcagcagaaaccaggggaanctctaagctcctgatctttgatgcctcagtttggaaagtggagtccatcaaggttcagcggcaggtggatctggggacagatttcattccctnaccatcagcagcctgcagcctgaaagnttcgtgctaaccttattattgtacaactaatttaaggacttaaccctctcttaccgttcgggacgggacgggaacctaagggtggaacgtatacgaaaacgtaacgttaggtcggtctacggacacctag

SEQ ID NO: 309361 - DNA, 432 bp, Homo sapiens
  misc_feature: GZ8MTXP02H4JBR.25.86.H09.1.454.CMB.2.raw
  modified_base (218)..(218): a, c, t, g, unknown or other
  misc_feature (218)..(218): n is a, c, g, or t
  modified_base (404)..(404): a, c, t, g, unknown or other
  misc_feature (404)..(404): n is a, c, g, or t
  modified_base (425)..(425): a, c, t, g, unknown or other
  misc_feature (425)..(425): n is a, c, g, or t
  modified_base (429)..(432): a, c, t, g, unknown or other
  misc_feature (429)..(432): n is a, c, g, or t
tcagactgtacagtcacgaccggtgctcgatttagtgctatagacttgggtttgggagaagaacctactatgcagactctgtgaagggtcgattcaccacctccagagacaacatcaagaactccctgtatctgcaaatggacagtctgacacctgatgacaccgccttgcattattgtgtgaaaggcggtgttgaggtgaatgcctggaacccccgnggtcagcactacttctacatgggcgtctggggacaaaggggactacggtcatcgtctcctcagcctccaaccaagggccccatccggtccttccccctggccgcccctgctccaggagcacctccgagacgcaccagccgccctgggctgccctgggtcaaaggacctacttccactgtacagtcngagcgggctggacaaggcganatannnn

SEQ ID NO: 309362 - DNA, 571 bp, Homo sapiens
  misc_feature: GZ8MTXP02H0YMK.25.86.H09.1.454.CMB.2.raw
tcagactgtacagtcacgaccggtgctcgatttagtgctatagacttgggtttgggggagtcagacccactcaggacacagcatggacatgagggtccccgctcagctcctggggcttctgctgctctggctcccaggtgccaaatgtgccatccagttgacccagtctccatcctccctgtctgcctctgttcgagacatagtcaccatcacttgtcgggctagtcgggtcattggcagtgctttagcctggtatcagcagaaaccaggggaagctctaagctcctgatcttgatgctcagttggaagtggatccatcaagtcagcgcagtgatcgtgggacagtattcatcctcacatcagcagccctgctagcctagaagtattctagctaaactttattattagtactaaacgtaatttaacggtactttaccctcttaccttcccgttacgggacggggaacggggtaacccgtaaaggggttcggaacgtaaacgtacccgtaaaaacggacgtttaacggcggggttacctacgggaccgtacccgtaatttaccgtttaccgg

SEQ ID NO: 309363 - DNA, 533 bp, Homo sapiens
  misc_feature: GZ8MTXP02JW42K.25.86.H09.1.454.CMB.2.raw
  modified_base (400)..(400): a, c, t, g, unknown or other
  misc_feature (400)..(400): n is a, c, g, or t
tcagactgtacagtcacgaccggtgctcgatttagtgctatagacttgggtttgggggagtcagacccactcaggacacagcatggacatgagggtccccgctcagctcctggggcttctgctgctctggctcccaggtgccaaatgtgccatccagttgacccagtctccatcctccctgtctgcctctgttcgagacatagtcaccatcacttgtcgggctagtcgggtcattggcagtgctttagcctggtatcagcagaaaccaggggaagctcctaagctcctgatctttgatgcctccagtttggaagtggacgtccatcaaggttcagcggcagtcggatcgtggggacagatttcatcctcaccatcagcagccctgcagcctagatattcngaccaacttattagttacgtacaaactaatttaaacggactttaccctcttcctaccgttcgggacgggaacgggtaccaaaggggtggaagtacgtacaaaaccgaactggtacggctcgacacctatctcg

SEQ ID NO: 309364 - DNA, 574 bp, Homo sapiens
  misc_feature: GZ8MTXP02GM8DW.25.86.H09.1.454.CMB.2.raw
  modified_base (344)..(344): a, c, t, g, unknown or other
  misc_feature (344)..(344): n is a, c, g, or t
  modified_base (380)..(380): a, c, t, g, unknown or other
  misc_feature (380)..(380): n is a, c, g, or t
tcagactgtacagtcacgaccggtgctcgatttagtgctatagacttgggtttggggagctctgggaaaggagccccagccctgagattcccaggtgattccattcggtgatcagcactgaacacagaactcaccatggagtttggactgagctgggttttccttgttgccattttaaaaggtgtccagtgtgaagtgcaactggtggagtcgtgggggagccgtggtacgaggccggggggtcctgagactctcctgtgtagcctctggattcatgtttgatgattatgccatgcactggggtccgtgaagggtccggggaagggtctgggagtgggtctctnttatgactggggatggggagaacgaactactatgcngactctgtgaagggtcattccaccacctaccagacgacaaacatacaaagaacctcccctattactactaggacctaaaagtggaaccaggttcacgacaccgtgatcgaaccaccgtcttagttatttattggtagtggaaaacggtcgggttagttggaaggtgatacggcctacggacccccgcggtaccg

SEQ ID NO: 309365 - DNA, 604 bp, Homo sapiens
  misc_feature: GZ8MTXP02GA3OO.25.86.H09.1.454.CMB.2.raw
tcagactgtacagtcacgaccggtgctcgatttagtgctatagacttgggtttgggggagtcagacccactcaggacacagcatggacatgagggtccccgctcagctcctggggcttctgctgctctggctcccaggtgccaaatgtgccatccagttgacccagtctccatcctccctgtctgcctctgttcgagacatagtcaccatcacttgtcgggctagtcgggtcattggcagtgctttagcctggtatcagcaagaaaccgaggggaagcctacctaagctcatgattctttgatcgcctccgtaggtttagggaaagtggacgtcccagtccgtaaggttcaggccggctaggtgggatcgtagggactagtactttcacttccctacaccctatcgagttacgcccgtagcgtacgtccgtagaaacgttcttacgtctaacctaacctttattacttacgtaactaaaccttaaagtttaacgtactttaccccttctaccgttccgttacgggacgggaacgggtaccgtaaggggtacggaagtacgtaacgaaacgtacgtggtacgacgtcggacaccgtactctttcg

SEQ ID NO: 309366 - DNA, 527 bp, Homo sapiens
  misc_feature: GZ8MTXP02JWBQT.25.86.H09.1.454.CMB.2.raw
  modified_base (279)..(279): a, c, t, g, unknown or other
  misc_feature (279)..(279): n is a, c, g, or t
  modified_base (409)..(409): a, c, t, g, unknown or other
  misc_feature (409)..(409): n is a, c, g, or t
  modified_base (414)..(414): a, c, t, g, unknown or other
  misc_feature (414)..(414): n is a, c, g, or t
tcagactgtacagtcacgaccggtgctcgatttagtgctatagacttgggtttgggggcaggagtcagacccactcaggacacagcatggacatgagggtccccgctcagctcctggggcttctgctgctctggctcccaggtgccaaatgtgccatccagttgacccagtctccatcctcctgtctgcctctgttcgagacatagtcaccatcacttgtcgggctagtcgggtcattggcagtgctttagcctggtatcagcagaaaccgaggggaanctctaagctcctgatcttgatgcctctagtttggaaagtggagtccatcaaggttcagtcggcaggtggatcgtggggacagtactttcgacttcctacaccatcagcacgccctgcagcctagaaagtnttcgnactaactattatgtacaactaatttaagacttacctctcctacgttcggacggacgggtaccaagggttggacgtaataccgaaacgtaacgtggtcggaccacgaccacgtc

SEQ ID NO: 309367 - DNA, 558 bp, Homo sapiens
  misc_feature: GZ8MTXP02ILQ72.25.86.H09.1.454.CMB.2.raw
  modified_base (281)..(281): a, c, t, g, unknown or other
  misc_feature (281)..(281): n is a, c, g, or t
tcagactgtacagtcacgaccggtgctcgatttagtgctatagacttgggtttgggggcaggagtcagacccactcaggacacagcatggacatgagggtccccgctcagctcctggggcttctgctgctctggctcccaggtgccaaatgtgccatccagttgacccagtctccatcctccctgtctgcctctgttcgagacatagtcaccatcacttgtcgggctagtcgggtcattggcagtgtctttagcctggtatcagcagaaaccgaggggaanctacctaagcctacctgatctttgatcgcctcgagtttaggaaagtggagtcccatacgtaaggttcaggcggacaggtgggatcgtagggactagtatttcatccctacaccatcaagcacgcctcgcagcctagaagtattctcgtactaaccttattattactactaaactaaattaacggttaacttaacccttcttccttccgttcggtacggacggaaccggaacggtacggagactaacgaaacgaacgtacgtcgtacgtcgacactac

SEQ ID NO: 309368 - DNA, 694 bp, Homo sapiens
  misc_feature: GZ8MTXP02IMKMU.25.86.H09.1.454.CMB.2.raw
  modified_base (267)..(267): a, c, t, g, unknown or other
  misc_feature (267)..(267): n is a, c, g, or t
tcagactgtacagtcacgaccggtgctcgatttagtgctatagacttgggtttggggagctctgggaaaggagccccagccctgagattcccaggtgattccattcggtgatcagcactgaacacagaactcaccatggagtttggactgagctgggttttccttgttgcctattttaaaaggtgtccagtgtgaagtgcaactggtggagtcgtgggggagccgtggtacgaggccggggggtcctgagctctcctgtgtagcctntggattcattgttgatgtattatgcctatcgctacgtgggtccgtacggtaacggggtccggggtaagggtcgtgggtaggttgggttccttcttcgttagtgtacggttggggagtaggggaagaaacgtaaccttactatcgcaggtacttcgtggtaggtacggggttcacttaccaccctacctaccaagaacgacaaactataccaaagtaccctcctagtactctagactaaagtcggactaggtacctagacctaccgtgaactcgtaacccgtaccgttacctttaggttaacgtttagtttacgggttacggttaaaggggtaaaacggggttcgggtttaggttagggtaaggggttacgaaacggtttcccggaacccgggttacccccggggaaacccccggttcgggtaacccg

SEQ ID NO: 309369 - DNA, 570 bp, Homo sapiens
  misc_feature: GZ8MTXP02JFCEB.25.86.H09.1.454.CMB.2.raw
  modified_base (422)..(422): a, c, t, g, unknown or other
  misc_feature (422)..(422): n is a, c, g, or t
tcagactgtacagtcacgaccggtgctcgatttagtgctatagacttgggtttgggggcaggagtcagacccactcaggacacagcatggacatgagggtccccgctcagctcctggggcttctgctgctctggctcccaggtgccaaatgtgccatccagttgacccagtctccatcctccctgtctgcctctgttcgagacatagtcaccatcacttgtcgggctagtcgggtcattggcagtgctttagcctggtatcagcagaaaccgaggggaagctacctaagctcctgattctttgatcgtccctccgtaggtttaggaaagtggacgtcccagtacgaaggttcagcggcaggtggatcgtgggacagtatttcactctcaccatcgagcagccctgaccaagcctagaaagtnttcacgtactaacccttatttacttacgtactaaacttaaattttaacggactttaccctcttccgttacgttcggggacggtaacgggaaccgtaagggtcgtaaagactaacgaaaacgtcgtaggtcggacttcggacctactac

SEQ ID NO: 309370 - DNA, 503 bp, Homo sapiens
  misc_feature: GZ8MTXP02JYE2E.25.86.H09.1.454.CMB.2.raw
  modified_base (278)..(278): a, c, t, g, unknown or other
  misc_feature (278)..(278): n is a, c, g, or t
  modified_base (398)..(398): a, c, t, g, unknown or other
  misc_feature (398)..(398): n is a, c, g, or t
tcagactgtacagtcacgaccggtgctcgatttagtgctatagacttgggtttgggggcaggagtcagacccactcaggacacagcatggacatgagggtccccgctcagctcctggggcttctgctgctctggctcccaggtgccaaatgtgccatccagttgacccagtctccatcctccctgtctgcctctgttcgagacatagtcaccatcacttgtcgggctagtcgggtcattggcagtgctttagcctggtatcagcagaaccgagggganctctaagctctgatcttgatgcctcagttggaaagtggacgtccatcaaggttcagcgcagtggatcgtggacagtatttcatcctcaccatcagcagcctgcagcctagaaagtcttcncgactaacctatttatgtacaataattaagacttacctctcgtcgttcggacggacggaccgaaggtcgagactaacgaaacgtacgtggtcgactcgacactac

SEQ ID NO: 309371 - DNA, 665 bp, Homo sapiens
  misc_feature: GZ8MTXP02H0E4Z.25.86.H09.1.454.CMB.2.raw
  modified_base (258)..(258): a, c, t, g, unknown or other
  misc_feature (258)..(258): n is a, c, g, or t
tcagactgtacagtcacgaccggtgctcgatttagtgctatagacttgggtttgggggagtcagacccactcaggacacagcatggacatgagggtcccccgctcagctcctggggcttctgctgctctggctcccaggtgccaaatgtgccatccagttgacccagtctccatcctcctgtctgcctctgttcgagacatagtcaccatcacttgtcgggctaggtcgggtcattggcagtgtctttagcctggtancagacaagaaacgagggaactcctacgtaagctcctagtacttcgttagatcgtccttacgtaggtttaggaaagtggtaaccgtccagtacgtaacggtcgagcggagtagtaggtagtcgtaggacgtagtattactactcctaccaccactacacgacgacgccgtacgacgacgtacgtacgtacgtactacgtacgtacctaacttaacttaattacgtaactaaacgttaaaacgtttaaacgttaaccgttaacccttaccttacccgttacccgttaccgggtaaccgggtaaaccggggtaaaccggtaaacgggtaacgggtaaacggtaaacgtaaaccgtaaaaccgtaaacgtaacggtacggtacgtacgtaccgtacctacgttacgttacg

SEQ ID NO: 309372 - DNA, 568 bp, Homo sapiens
  misc_feature: GZ8MTXP02ITG5O.25.86.H09.1.454.CMB.2.raw
  modified_base (406)..(406): a, c, t, g, unknown or other
  misc_feature (406)..(406): n is a, c, g, or t
  modified_base (418)..(418): a, c, t, g, unknown or other
  misc_feature (418)..(418): n is a, c, g, or t
  modified_base (424)..(424): a, c, t, g, unknown or other
  misc_feature (424)..(424): n is a, c, g, or t
tcagactgtacagtcacgaccggtgctcgatttagtgctatagacttgggtttgggggagtcagacccactcaggacacagcatggacatgagggtccccgctcagctcctggggcttctgctgctctggctcccaggtgccaaatgtgccatccagttgacccagtctccatcctccctgtctgcctctgttcgagacatagtcaccatcacttgtcgggctaggtcgggtcagttggcagtgctttagcctggtatcagcaagaaaccgaggggaagctacctaagctcctgtatctttgatcgcctcgtagtttaggaaagtggacgtcccagtacgaaggttcagcggacagtggatcgtgggacagtattcactcctcaccatcaagcacgcctgccgaanccgtagaaagtnttccgnacctaaacttattacttagtactaaaactaagtttaaacgaccttaaccctctaccgttccgttacgggcggtaagggaccgaaggtagggaataacgtacgaaaacgtacgtggtcggacgtacgacctacctagttccgtcg

SEQ ID NO: 309373 - DNA, 574 bp, Homo sapiens
  misc_feature: GZ8MTXP02F1EMS.25.86.H09.1.454.CMB.2.raw
  modified_base (377)..(377): a, c, t, g, unknown or other
  misc_feature (377)..(377): n is a, c, g, or t
  modified_base (408)..(408): a, c, t, g, unknown or other
  misc_feature (408)..(408): n is a, c, g, or t
tcagactgtacagtcacgaccggtgctcgatttagtgctatagacttgggtttgggggcaggagtcagacccactcaggacacagcatggacatgagggtccccgctcagctcctggggcttctgctgctctggctcccaggtgccaaatgtgccatccagttgacccagtctccatcctccctgtctgcctctgttcgagacatagtcaccatcacttgtcgggctagtcgggtcattggcagtgctttagcctggtatcagcagaaaccgaggggaagctcctaagctcctgattcttgatcgcctcagtttggaaagtggagtcccatcaaggttcaggcggcaggtggatcgtggggacagtatttcattccncaccatcagcagccctgcagcctagaaagtnttctgactaacctttaattattacgtaacaaacttaaagtttaaacggactttaaccctcttaccgttaccgttcgggaccgggtacgggtaaacccgaaaggggttcggaaagtacgttaaccgaaaacggtaacgtggtacgggcttacggaccctaacgtacg

SEQ ID NO: 309374 - DNA, 431 bp, Homo sapiens
  misc_feature: GZ8MTXP02IW9WZ.25.86.H09.1.454.CMB.2.raw
  modified_base (318)..(318): a, c, t, g, unknown or other
  misc_feature (318)..(318): n is a, c, g, or t
  modified_base (423)..(431): a, c, t, g, unknown or other
  misc_feature (423)..(431): n is a, c, g, or t
tcagactgtacagtcacgaccggtgctcgatttagtgctatagacttgggtttgggagaagaacctactatgcagactctgtgaagggtcgattcaccacctccagagacaacatcaagaactccctgtatctgcaaatggacagtctgacacctgatgacaccgccttgtattattgtgtgaaaggcggtgttgaggtgaatgcctggaacccccgcggtcagcactacttctacatgggcgtctggggcaaaggggactacggtcatcgtctcctcagcctccaccaagggccccatcggtccttccccctggccnccctgcctccgaggacgccacctccgagagcacacgccggccctgggctgcctggtcaaggctacttccactgtacagtctgagcgggctggcaaggcgcatagnnnnnnnnn

SEQ ID NO: 309375 - DNA, 529 bp, Homo sapiens
  misc_feature: GZ8MTXP02GXKRF.25.86.H09.1.454.CMB.2.raw
  modified_base (276)..(276): a, c, t, g, unknown or other
  misc_feature (276)..(276): n is a, c, g, or t
  modified_base (397)..(397): a, c, t, g, unknown or other
  misc_feature (397)..(397): n is a, c, g, or t
tcagactgtacagtcacgaccggtgctcgatttagtgctatagacttgggtttgggggagtcagacccactcaggacacagcatggacatgagggtccccgctcagctcctggggcttctgctgctctggctcccaggtgccaaatgtgccatccagttgacccagtctccatcctccctgtctgcctctgttcgagacatagtcaccatcacttgtcgggctagtcgggtcattggcagtgctttagcctggtatcagcagaaaccgaggggaanctcctaagctcctgatcttgatgcctctagtttggaaagtggacgtccatcaacggttcagcgcaggtgatcgtgggacagtattcatcctacaccatcagcagcctgcagcctagaagtnttcgagactaaccttattattgtaacaaactaatttaacggacttacctctactccgttcggacggacggaccgaagggtgaacgtactaacgaaacggtaacgtggtacggactcggactactactcttcg

SEQ ID NO: 309376 - DNA, 562 bp, Homo sapiens
  misc_feature: GZ8MTXP02IIBH7.25.86.H09.1.454.CMB.2.raw
  modified_base (404)..(404): a, c, t, g, unknown or other
  misc_feature (404)..(404): n is a, c, g, or t
  modified_base (409)..(409): a, c, t, g, unknown or other
  misc_feature (409)..(409): n is a, c, g, or t
tcagactgtacagtcacgaccggtgctcgatttagtgctatagacttgggtttgggggagtcagacccactcaggacacagcatggacatgagggtccccgctcagctcctggggcttctgctgctctggctcccaggtgccaaatgtgccatccagttgacccagtctccatcctccctgtctgcctctgttcgagacatagtcaccatcacttgtcgggctaggtcgggtcattggcagtgctttagcctggtatcagcaagaaaccgaggggaagctacctaagctcctgtatctttgatgcctcaggtttggaaagtggacgtccatcgaaggttcagcggacaggtgatcgagggacagtattcatcctcaccatcagcagcctgcagcctagaacgtntactnactaaccttattattcgaactaaacgtaattaaacggtactttacccctacttccgtaccgttccgggacggggtaacgggaaaccgtaaaggggtcggaaagtaacgtaccgaaaacggtaacgtggtacggctacgaccaccgtatcttcg

SEQ ID NO: 309377 - DNA, 594 bp, Homo sapiens
  misc_feature: GZ8MTXP02H9H4S.25.86.H09.1.454.CMB.2.raw
  modified_base (283)..(283): a, c, t, g, unknown or other
  misc_feature (283)..(283): n is a, c, g, or t
tcagactgtacagtcacgaccggtgctcgatttagtgctatagacttgggtttggggcaggagtcagacccactcaggacacagcatggacatgagggtccccgctcagctcctggggcttctgctgctctggctcccaggtgccaaatgtgccatccagttgacccagtctccatcctcctgtctgcctctgttcgagacatagtcaccatcacttgtcgggcttaggtcgggtcagttggctagtgtctttagcctggtatcagcaagaaaccgagggaanctcaagctctgatcttgatgcctctagttggaaagtggatccatcgaaggttcaggcgacgagtggatcgtaggggactagtactttacactccctcacccatcgaagcgacgccctgcacgcctagaacgtatttcacgtactaaccttatttacttacgtaactaaaacttaaagtttaaacggtaacctttaaccccttacgttacccgtttcccggtttacggggaccgggtaacgggaaacccgtaaaggggtcggaaagtacgtaacgaaaacgtacgacggtacggtactacgactaacctacg

SEQ ID NO: 309378 - DNA, 640 bp, Homo sapiens
  misc_feature: GZ8MTXP02HQU4N.25.86.H09.1.454.CMB.2.raw
tcagactgtacagtcacgaccggtgctcgatttagtgctatagacttgggtttgggggcaggagtcagacccactcaggacacagcatggacatgagggtccccgctcagctcctggggcttctgctgctctggctcccaggtgccaaatgtgccatccagttgacccagtctccatcctccctgtctgcctctgttcgagacatagtcaccatcacttgtcgggctaggtcgggtcagttggcagtgctttagcctggtatcgagcaagaaaccgaggggaagcctactaagcctcctgattcgttttgactcgtcccttacgtaaggtttcgggaaaagtcggacgtccccaagtccgaaaaggtttcgaacggcggacgaggttgggatcgtaggggactaggtatttcacttccacaccatccagcacgcctgcaacgccgtagaaacgtacttcgactactaaacctttattaacttcgtaacctaaaacgtaaagttttaaggaacctttccctacttccgtttaccggttccgggggaaccggggtaacgggtaaccgtaaacggggtacgggtaagtaacgtaaaccgaaaaccgttacgtaggtcggacttcggaccgtaacccgtttacg

SEQ ID NO: 309379 - DNA, 554 bp, Homo sapiens
  misc_feature: GZ8MTXP02I88EA.25.86.H09.1.454.CMB.2.raw
tcagactgtacagtcacgaccggtgctcgatttagtgctatagacttgggtttgggggagtcagacccactcaggacacagcatggacatgagggtccccgctcagctcctggggcttctgctgctctggctcccaggtgccaaatgtgccatccagttgacccagtctccatcctccctgtctgcctctgttcgagacatagtcaccatcacttgtcgggctagtcgggtcattggcagtgctttagcctggtatcagcagaaaccaggggaagctccaagctctgatcttgatcgcctctagtttggaaagtggagtccatcgaaggttcagcggcaggtggatcgtgggacagtatttcatcctacaccatcagcagcctgcagcctagaacgtcttctcgacctaacctttattagtttacgtacctaaactaatttaacggactttaaccctcttaccgttccgttacgggtacgggagggtaccgaagggttggaacggtactacgaaacgtaacgtggttcggacgtacggaccactactctttccg

SEQ ID NO: 309380 - DNA, 519 bp, Homo sapiens
  misc_feature: GZ8MTXP02HHC29.25.86.H09.1.454.CMB.2.raw
  modified_base (285)..(285): a, c, t, g, unknown or other
  misc_feature (285)..(285): n is a, c, g, or t
  modified_base (352)..(352): a, c, t, g, unknown or other
  misc_feature (352)..(352): n is a, c, g, or t
  modified_base (413)..(413): a, c, t, g, unknown or other
  misc_feature (413)..(413): n is a, c, g, or t
  modified_base (417)..(417): a, c, t, g, unknown or other
  misc_feature (417)..(417): n is a, c, g, or t
  modified_base (431)..(431): a, c, t, g, unknown or other
  misc_feature (431)..(431): n is a, c, g, or t
  modified_base (453)..(453): a, c, t, g, unknown or other
  misc_feature (453)..(453): n is a, c, g, or t
  modified_base (511)..(511): a, c, t, g, unknown or other
  misc_feature (511)..(511): n is a, c, g, or t
tcagactgtacagtcacgaccggtgctcgatttagtgctatagacttgggtttgggggcaggagtcagacccactcaggacacagcatggacatgagggtccccgctcagctcctggggcttctgctgctctggctcccaggtgccaaatgtgccatccagttgacccagtctccatcctccctgtctgcctctgttcgagacatagtcaccatcacttgtcgggctaggtcgggtcagttggcagtgctttagcctggtatcagacaagaaaccgaggggaacnctactaagctcctgattcttgatcgcctcgtagtttaggaaagtggacgtccatacgaagtcagcgnagtcgatctagggactagtatttacatcctacacctatcagcagcctgacagcctagaaanttcngtacaactattatntacaataagttagacttacctntcctcgtcggacggaacggacaaaggtcggatacgaacaaaacgacgttaggcggacncgacactg

SEQ ID NO: 309381 - DNA, 587 bp, Homo sapiens
  misc_feature: GZ8MTXP02JOHV5.25.86.H09.1.454.CMB.2.raw
  modified_base (331)..(331): a, c, t, g, unknown or other
  misc_feature (331)..(331): n is a, c, g, or t
tcagactgtacagtcacgaccggtgctcgatttagtgctatagacttgggtttgggggagtcagacccactcaggacacagcatggacatgagggtccccgctcagctcctggggcttctgctgctctggctcccaggtgccaaatgtgccatccagttgacccagtctccatcctccctgtctgcctctgttcgagacatagtcaccatcacttgtcgggctagtcgggtcattggcagtgctttagcctggtatcagcagaaacccagggaaacgttcctaacctcctcatctatgctgcatccactttgctaagtttcggggtccctntcgattcagcggctaggtgggtctggggacagtaattcactcacaccatcagcagcctgcagcctagaatatgtagactaaacttacttactagtaactaaaatttgaactacggtcgaacccggttggaacgttcggttacccgggaccgaacggggtacccgaaaggggttacgggaaacctaacgtaaccgtaaaaccggtaaagtcggtacgggtaccttacggaccgtaaccgttaacgttctttaaccgg

SEQ ID NO: 309382 - DNA, 511 bp, Homo sapiens
  misc_feature: GZ8MTXP02JBAX8.25.86.H09.1.454.CMB.2.raw
  modified_base (388)..(388): a, c, t, g, unknown or other
  misc_feature (388)..(388): n is a, c, g, or t
  modified_base (392)..(392): a, c, t, g, unknown or other
  misc_feature (392)..(392): n is a, c, g, or t
tcagactgtacagtcacgaccggtgctcgatttagtgctatagacttgggtttgggggagtcagacccactcaggacacagcatggacatgagggtccccgctcagctcctggggcttctgctgctctggctcccaggtgccaaatgtgccatccagttgacccagtctccatcctccctgtctgcctctgttcgagacatagtcaccatcacttgtcgggctagtcgggtcattggcagtgctttagcctggtatcagcagaaaccgaggggaagctcctaagctcctgatcttgatgcctcagtttgaagtgatccatcaaggtcagcgcagtggatcgtgggacagtatttcatcctcaccatcagcagcctgcagcctgaaagnttcngctaaacctattattgtacaaactaatttaacggactttaccctcttactccttcgggacggagggaccaaagggtgaagactaacgaaacgacgttgcggactcgacacctatcttcg

SEQ ID NO: 309383 - DNA, 580 bp, Homo sapiens
  misc_feature: GZ8MTXP02G4CXC.25.86.H09.1.454.CMB.2.raw
  modified_base (282)..(282): a, c, t, g, unknown or other
  misc_feature (282)..(282): n is a, c, g, or t
  modified_base (289)..(289): a, c, t, g, unknown or other
  misc_feature (289)..(289): n is a, c, g, or t
  modified_base (347)..(347): a, c, t, g, unknown or other
  misc_feature (347)..(347): n is a, c, g, or t
tcagactgtacagtcacgaccggtgctcgatttagtgctatagacttgggtttgggggcaggagtcagacccactcaggacacagcatggacatgagggtccccgctcagctcctggggcttctgctgctctggctcccaggtgccaaatgtgccatccagttgacccagtctccatcctccctgtctgcctctgttcgagacatagtcaccatcacttgtcgggctaggtcgggtcattggcagtgctttagcctggtatcagcagaaaccgaggggaacnctactanctctgtatcttgatcgcctcgtaggttaggaaagtggactccatcgtagtcaggcggngaggtggtatcggaggactagtacttcactcctacacctatacacgacacgcctgacgtacgtccgtagaacgtattacgtacgtacctaactttattacttacgtaactaaacttaacgtttaacgtacctttacctcttccgttaccggttacgggacgggtaacggaacgtagggtacgaacgtaacgtaacgtaaacggtacgtcggtacgtacgtacgacctactacg

SEQ ID NO: 309384 - DNA, 564 bp, Homo sapiens
  misc_feature: GZ8MTXP02F4J72.25.86.H09.1.454.CMB.2.raw
  modified_base (280)..(280): a, c, t, g, unknown or other
  misc_feature (280)..(280): n is a, c, g, or t
tcagactgtacagtcacgaccggtgctcgatttagtgctatagacttgggtttgggggcaggagtcagacccactcaggacacagcatggacatgagggtccccgctcagctcctggggcttctgctgctctggctcccaggtgccaaatgtgccatccagttgacccagtctccatcctccctgtctgcctctgttcgagacatagtcacatcacttgtcggctagtcgggtcagttggcagtgtcttagcctggtatcagcaagaaaccgaggggaanctaccaagctcctgattcttgatcgtccctcctaggtttaggaaagtggtacgtcccatactaaggttcaggcggcaggtgatcgtgggacagtatttcatcctacaccatcagcacgcctgacagacctggaaatcttcacgtacctaaccttattatacgtacaaacgttaaatttaaggtaccttaccctcttacctccggttacgggacggacgggaaccgtaagggtcggaacgtactaaacgaaaaccgtagtacggcggtacacggacctacttacg

SEQ ID NO: 309385 - DNA, 514 bp, Homo sapiens
  misc_feature: GZ8MTXP02F6ZAC.25.86.H09.1.454.CMB.2.raw
  modified_base (275)..(275): a, c, t, g, unknown or other
  misc_feature (275)..(275): n is a, c, g, or t
  modified_base (337)..(337): a, c, t, g, unknown or other
  misc_feature (337)..(337): n is a, c, g, or t
tcagactgtacagtcacgaccggtgctcgatttagtgctatagacttgggtttgggggagtcagacccactcaggacacagcatggacatgagggtccccgctcagctcctggggcttctgctgctctggctcccaggtgccaaatgtgccatccagttgacccagtctccatcctccctgtctgcctctgttcgagacatagtcaccatcacttgtcgggctagtcgggtcattggcagtgctttagcctggtatcagcagaaaccaggggaanctcctaagctcctgatctttgatgcctcagtttggaagtggagtccatcaaggttcagcgcngtggatcgtgggactagattcatcctcaccatcagcagcctgctagcctgaacgtattctgactaaccttattattagtactaaactaaatttaacggactttaaccctcttcctccgttcggtcggaggaccgtaaggtggaacagtacaaacgactgtcgctcgcacctatctcg

SEQ ID NO: 309386 - DNA, 591 bp, Homo sapiens
  misc_feature: GZ8MTXP02HHDZS.25.86.H09.1.454.CMB.2.raw
  modified_base (284)..(284): a, c, t, g, unknown or other
  misc_feature (284)..(284): n is a, c, g, or t
  modified_base (404)..(404): a, c, t, g, unknown or other
  misc_feature (404)..(404): n is a, c, g, or t
  modified_base (438)..(438): a, c, t, g, unknown or other
  misc_feature (438)..(438): n is a, c, g, or t
  modified_base (577)..(577): a, c, t, g, unknown or other
  misc_feature (577)..(577): n is a, c, g, or t
tcagactgtacagtcacgaccggtgctcgatttagtgctatagacttgggtttgggggcaggagtcagacccactcaggacacagcatggacatgagggtccccgctcagctcctggggcttctgctgctctggctcccaggtgccaaatgtgccatccagttgacccagtctccatcctccctgtctgcctctgttcgagacatagtcaccatcacttgtcgggctaggtcgggtcagttggcagtgtctttagcctggtatcagacagaaaccgaggggaancctactaagctcctgattcttgatcgccctctaggtttaggaaagttggacgtcccagtcgaaggttcaggcggacaggtggattcgtaggggacagtatttcactccctacaccatcancgacgcccgcacgacctagaacgtacttccgtanaccttaaaccttattactttacgaactaaacgttaaagtttaacgaacctttacccttcttccttcccggttacgggaccgggtaacggaccgtaaaggggtcggagtactaacgaaaacgtaacgttcggacgcgtanaccaaccttactcg

SEQ ID NO: 309387 - DNA, 583 bp, Homo sapiens
  misc_feature: GZ8MTXP02FIFVH.25.86.H09.1.454.CMB.2.raw
  modified_base (277)..(277): a, c, t, g, unknown or other
  misc_feature (277)..(277): n is a, c, g, or t
tcagactgtacagtcacgaccggtgctcgatttagtgctatagacttgggtttgggggagtcagacccactcaggacacagcatggacatgagggtccccgctcagctcctggggcttctgctgctctggctcccaggtgccaaatgtgccatccagttgacccagtctccatcctccctgtctgcctctgttcgagacatagtcaccatcacttgtcgggctagtcgggtcattggcagtgctttagcctggtatcagcaagaaaccaggggaacnctactaagctctgtattcttgatcgtcctacgtaggtttaggaaaggtggactacctatacgaacggtcaggcggcaggtgatcgagggactagtattcactccacacatacagcacgcctgcacgctagaaagtcttacacgactaaaccttagtttacttacgtaactaaaacttaaagtttaacgtacctttaccctcttccgttccgttacggggacgggaacgggaacgtaagggtaggaacgtaactaaccgaaaacgtaacgtggtcggtacgtacgaccctaaccgtacttacgttcg

SEQ ID NO: 309388 - DNA, 703 bp, Homo sapiens
  misc_feature: GZ8MTXP02GPGZ1.25.86.H09.1.454.CMB.2.raw
tcagactgtacagtcacgaccggtgctcgatttagtgctatagacttgggtttgggggagtcagacccactcaggacacagcatggacatgagggtccccgctcagctcctggggcttctgctgctctggctcccaggtgccaaatgtgccatccagttgacccagtctccatcctccctgtctgcctctgttcgagacatagtcaccatcacttgtcgggctagtcgggtcagttggcagtgcttagcctggtatcagcagaaaccgaggggaagctcctaagctcctgtatctttgatcgtccctccgtaggttttaggaaaaggttgggaacgttccccaagttacgaaacgggtttcacggcgggcgtaggtggacttcggtaggggactaggtaatttcacttaccctccaaccctataccgaagccgacggtccctggaccacggtaccctagggaaacgtactttaccgtcggtaaccctaaaccctttaatttacgtttaacggttaacctaaaaaccttaaaagtttttaaaacggtaacccttttaaccccttaccttacccgtttacccggtttccgggggaaaccggggtacgggggtaaacccgtaaacgggggttaggaacggtaactaaccgaaaacgtaacgttaaggttcgggacttacggaccgaaacccttacgttacgttacg

SEQ ID NO: 309389 - DNA, 580 bp, Homo sapiens
  misc_feature: GZ8MTXP02I8W61.25.86.H09.1.454.CMB.2.raw
  modified_base (275)..(275): a, c, t, g, unknown or other
  misc_feature (275)..(275): n is a, c, g, or t
tcagactgtacagtcacgaccggtgctcgatttagtgctatagacttgggtttgggggagtcagacccactcaggacacagcatggacatgagggtccccgctcagctcctggggcttctgctgctctggctcccaggtgccaaatgtgccatccagttgacccagtctccatcctccctgtctgcctctgttcgagacatagtcaccatcacttgtcgggctagtcgggtcattggcagtgctttagcctggtatcagcagaaaccaggggaanctctaagctcctgatcttgatgcctcgagtttaggaaagtggacgtcccatcaaggttcagcgacagtgatcgtgggacagtactttcacttccctcaacccatcaacgcagccctgcaacgcctaggaaatcttcctagacctaaaccttatttaactttcgaactaaaactaaagtttaaacggtacttaaccctcttaccgtaccgttcgggacgggtaacgggaccgtaaagggtacggaacgacttaaaccgaaacgtaaccgtggtacggactacggacctaacccgtacttaccgtcg

SEQ ID NO: 309390 - DNA, 418 bp, Homo sapiens
  misc_feature: GZ8MTXP02GC6X9.25.86.H09.1.454.CMB.2.raw
  modified_base (323)..(323): a, c, t, g, unknown or other
  misc_feature (323)..(323): n is a, c, g, or t
  modified_base (411)..(418): a, c, t, g, unknown or other
  misc_feature (411)..(418): n is a, c, g, or t
tcagactgtacagtcacgaccggtgctcgatttagtgctatagacttgggtttgggagaagaacctactatgcagactctgtgaagggtcgattcaccacctccagagacaacatcaagaactccctgtatctgcaaatggacagtctgacacctgatgacaccgccttgtattattgtgtgaaaggcggtgttgaggtgaatgcctggaacccccgcggtcagcactacttctacatgggcgtctggggcaaaggggctacggtcatcgtctcctcagcctccaccaaggcccatcggtctcccctgcgcctgctccaggancacctccgagcgcacacgcggccctggggcctgcctggcaaggctacttccactgtacagtctgagcgggctggcaaggcgcagtagnnnnnnnn

SEQ ID NO: 309391 - DNA, 518 bp, Homo sapiens
  misc_feature: GZ8MTXP02F0L1V.25.86.H09.1.454.CMB.2.raw
  modified_base (341)..(341): a, c, t, g, unknown or other
  misc_feature (341)..(341): n is a, c, g, or t
  modified_base (387)..(387): a, c, t, g, unknown or other
  misc_feature (387)..(387): n is a, c, g, or t
tcagactgtacagtcacgaccggtgctcgatttagtgctatagacttgggtttgggggagtcagacccactcaggacacagcatggacatgagggtccccgctcagctcctggggcttctgctgctctggctcccaggtgccaaatgtgccatccagttgacccagtctccatcctccctgtctgcctctgttcgagacatagtcaccatcacttgtcgggctagtcgggtcattggcagtgctttagctggtatcagcagaaaccgaggggaagctcctaagctcctgatcttgatgcctcagtttgaagtgagtccatcaagtcagcggcagtgatcgngggacagtattcatcctacaccatcagcagcctgcagctagaagtnttcagactaacttattatagtacaaactaattaagacttacctctacctcgttacgggacggacgggaccgaagggtgaacgtaacgtacgaaacgtaacgtggtacggactacggactaccattacttcg

SEQ ID NO: 309392 - DNA, 539 bp, Homo sapiens
  misc_feature: GZ8MTXP02IG80A.25.86.H09.1.454.CMB.2.raw
  modified_base (282)..(282): a, c, t, g, unknown or other
  misc_feature (282)..(282): n is a, c, g, or t
  modified_base (370)..(370): a, c, t, g, unknown or other
  misc_feature (370)..(370): n is a, c, g, or t
  modified_base (404)..(404): a, c, t, g, unknown or other
  misc_feature (404)..(404): n is a, c, g, or t
tcagactgtacagtcacgaccggtgctcgatttagtgctatagacttgggtttgggggcaggagtcagacccactcaggacacagcatggacatgagggtccccgctcagctcctggggcttctgctgctctggctcccaggtgccaaatgtgccatccagttgacccagtctccatcctccctgtctgcctctgttcgagacatagtcaccatcacttgtcgggctaggtcgggtcattggcagtgctttagcctggtatcagcaagaaaccgaggggaanctacctaagctcctgatctttgatgcctcagttgaaagtgatccatcaagtcagcggcagtggatcgtggggacagtatttcatcctnaccatcagcagcctgcagcctagaaagtacttcncgactaaaccttatttaattcgtactaaactaagtttaaacggactttaccctcttccttccgttacgggacggtacgggaccaaagggtggaaacgtagtaacaaacgtaacgtggtacggtctcgacaactcg

SEQ ID NO: 309393 - DNA, 720 bp, Homo sapiens
  misc_feature: GZ8MTXP02HC7U9.25.86.H09.1.454.CMB.2.raw
  modified_base (587)..(587): a, c, t, g, unknown or other
  misc_feature (587)..(587): n is a, c, g, or t
tcagactgtacagtcacgaccggtgctcgatttagtgctatagacttgggtttggggagctctgggaaaggagccccagccctgagattcccaggtgattccattcggtgatcagcactgaacacagaactcaccatggagtttggactgagctgggttttccttgttgcctattttaaaaggtgtccagtgtgaagtgcaactggtggagtcgtgggggagccggtggtacgaggccggggggtccctgagactctcctgtgtagcctctggtattcattgtttgatgtattatgccatgctacgtcgggtccgtacggtaacggggtccggggaagggttcgtgggtagggttcgggttccttcgttacgtttagtcggtacggttggggtagtacggggaaagtaaacggtaaacccttacgtaagtcgcgtagtccttgtaggtagggtaacggggttctacttacccaaccctacccgtacccaaggaacaaacaaacctaataaccgaaactaaccccttcccttagtactaccgtaggacctaaagttcgggaaactcgttacgacgacctaaccggtanacgtaccgaacctaccgttacgtttagttagtttagttacggttaggtaagggtaccggggttggttaggttagggaacggttaggtaaccggtccggtaccccggtacccgggtacccccggtacggtaccg

SEQ ID NO: 309394 - DNA, 663 bp, Homo sapiens
  misc_feature: GZ8MTXP02HYYQA.25.86.H09.1.454.CMB.2.raw
  modified_base (294)..(294): a, c, t, g, unknown or other
  misc_feature (294)..(294): n is a, c, g, or t
tcagactgtacagtcacgaccggtgctcgatttagtgctatagacttgggtttgggggcaggagtcagacccactcaggacacagcatggacatgagggtccccgctcagctcctggggcttctgctgctctggctcccaggtgccaaatgtgccatccagttcgacccagtcctccatcctccctgtctgcctctgttcgagacatacgtccaccatcacttggtcgggctaggtcgggtcagttggctagtgtctttagcctggtatcagacaacgaaaccggaggggaacncctaccgtaagccttccgtgtattcgtttagactcgtcccttacgtaaggtttaggaaagttcggacgtccctaagtacgtaaaggttcaacgggtcggacgtagggtgggattacggtaggggacctaagtactttcaacttccctacacctatcgagcacgtcctgacgacgccgtagaaattcttacctacgaaccttaaacctttatttaacgttacgtaactaaaacgtttaagttaaaccggtacctttaacccgtcgttaccgtttaccggtacgggtaacgggaacgggtaaacggtaaagggtcgaaacgtaacgtaaacgaaaaccggttagtcgggtacggactacggacctaactcg

SEQ ID NO: 309395 - DNA, 568 bp, Homo sapiens
  misc_feature: GZ8MTXP02HEEAI.25.86.H09.1.454.CMB.2.raw
  modified_base (277)..(277): a, c, t, g, unknown or other
  misc_feature (277)..(277): n is a, c, g, or t
  modified_base (398)..(398): a, c, t, g, unknown or other
  misc_feature (398)..(398): n is a, c, g, or t
  modified_base (402)..(402): a, c, t, g, unknown or other
  misc_feature (402)..(402): n is a, c, g, or t
tcagactgtacagtcacgaccggtgctcgatttagtgctatagacttgggtttgggggagtcagacccactcaggacacagcatggacatgagggtccccgctcagctcctggggcttctgctgctctggctcccaggtgccaaatgtgccatccagttgacccagtctccatcctccctgtctgcctctgttcgagacatagtcaccatcacttgtcgggctaggtcgggtcattggcagtgctttagcctggtatcagcagaaaccgaggggaanctacctaagctcctgatctttgatcgcctctagtttaggaaagtggatccatcaagtcagcgcagtggatcgtgggacagtatttcactcctcaccatcagcagcctgcagctagaaagtnttcngactaacttattattagtaacctaaaattaaatttaacggtactttaaccccttcttccgttacccggttcgggaacgggtacgggtaacccgaaaggggttcggaaagtacgtaaccgaaaacggtaacgtggtacgacgttacgacctaccgtagttactttcg

SEQ ID NO: 309396 - DNA, 597 bp, Homo sapiens
  misc_feature: GZ8MTXP02HZ190.25.86.H09.1.454.CMB.2.raw
  modified_base (195)..(195): a, c, t, g, unknown or other
  misc_feature (195)..(195): n is a, c, g, or t
  modified_base (273)..(273): a, c, t, g, unknown or other
  misc_feature (273)..(273): n is a, c, g, or t
  modified_base (374)..(374): a, c, t, g, unknown or other
  misc_feature (374)..(374): n is a, c, g, or t
tcagactgtacagtcacgaccggtgctcgatttagtgctatagacttgggtttggggagtcagacccactcaggacacagcatggacatgagggtccccgctcagctcctggggcttctgctgctctggctcccaggtgccaaatgtgccatccagttgacccagtctccatcctcctgtctgcctctgttcganacatagtcaccatcacttgtcgggctagtcgggtcattggcagtgcttagcctggtatcagcagaaaccaggggaacnctactagctctgtatcttgatcgcctcgtagttaggaagtggactccatacgaacggtcagcgataggtggatcgtaggacagtattcactcctacaccanacagcacgcctgccacgccgtaagtaagtacttctacgtaacctaaactttattattacgtaactaaaacttaaacgtttaaacgtaaccttacccttaccttacccgtacccggttaccgggaccggggaaacgggtaccggtaaaagggtacggaaacgtaacgtaaaccgtaaaaccgtaacgtcggtacggacgtacgacctaaccgtacttacgttcg

SEQ ID NO: 309397 - DNA, 726 bp, Homo sapiens
  misc_feature: GZ8MTXP02GIRV2.25.86.H09.1.454.CMB.2.raw
tcagactgtacagtcacgaccggtgctcgatttagtgctatagacttgggtttgggggcaggagtcagacccactcaggacacagcatggacatgagggtccccgctcagctcctggggcttctgctgctctggctcccaggtgccaaatgtgccatccagttgacccagtctccatcctcctgtctgcctctgttcgagacatagtccacatcacttggtcggctaggtcggtcagttggcagtgtctttagcctggtatcagacaaggaaaccgaggggaagcctaccgtaaagcctccgtagattcttaggactcggcccttccgtaaggttttaggaaaaggtggtaacgtcccaataccgtaaacggttcaacggtcggactagggtgggaactcggtagggggacctaggttactttacacttaccctaccaaccacgttacaacggtccaacgccccgtagccgtaacgtacccgttagggaaaacgttcttaccgttacgtaaccttaaaacccttttaagtttaagtttaaccgttaacccgtaaaatttaaaacggtttaaaacggttacctttaacccccgttacttccccgtttacccgggtttaccggggaacggggttaaacgggaaacccggtaaacgggttacgggtaaacaacgttaaacgaaaacccggtaacgtggttaaccgggcgtacgaccgtacccttaacgg

SEQ ID NO: 309398 - DNA, 640 bp, Homo sapiens
  misc_feature: GZ8MTXP02G3DI4.25.86.H09.1.454.CMB.2.raw
  modified_base (539)..(539): a, c, t, g, unknown or other
  misc_feature (539)..(539): n is a, c, g, or t
tcagactgtacagtcacgaccggtgctcgatttagtgctatagacttgggtttggggagctctgggaaaggagccccagccctgagattcccaggtgattccattcggtgatcagcactgaacacagaactcaccatggagtttggactgagctgggttttccttgttgccattttaaaaggtgtccagtgtgaagtgcaactggtggagtcgtgggggagccggtggtacaggccggggggtcctgagactctcctgtgtagcctctggattcatgtttgatgattatgccatgcacgtggggtccgtacgaagggtccggggaagggtctgggagttggggtccttcgttcttacgtgtacgttggggataggggagaacgtaacctacgtatggcagtacctcgtgtaggtaagggtcgtattccaaccctacctccgaagagaaccaacgatacaaagtaaccctccctagtactacctggaacaacgttggaacctaggtactacgacctacgtggactcgacgaccccgtttnttagttacgttagttcggtaggtaacgggtaacgggtcggttaggttaggaacggttagaccggttccggacccggtacccgggtaccccggtacgtaccg

SEQ ID NO: 309399 - DNA, 443 bp, Homo sapiens
  misc_feature: GZ8MTXP02I9CA0.25.86.H09.1.454.CMB.2.raw
  modified_base (362)..(362): a, c, t, g, unknown or other
  misc_feature (362)..(362): n is a, c, g, or t
  modified_base (405)..(405): a, c, t, g, unknown or other
  misc_feature (405)..(405): n is a, c, g, or t
  modified_base (434)..(443): a, c, t, g, unknown or other
  misc_feature (434)..(443): n is a, c, g, or t
tcagactgtacagtcacgaccggtgctcgatttagtgctatagacttgggtttgggagaagaacctactatgcagactctgtgaagggtcgattcaccacctccagagacaacatcaagaactccctgtatctgcaaatggacagtctgacacctgatgacaccgccttgtattattgtgtgaaaggcggtgttgaggtgaatgcctggaacccccgcggtcagcactacttctacagtgggcgtcgtggggacaaaggggctacggtcatcgtctcctcagccctccaccgaacgggccccagtccggtccttcccccgtggccgcccctgcctccgaggacgccacctccgagacgcacncgccggccctgggctgccctggtcaggctacttccactgtacngtctgagcgggctggcgaaggcgcatagnnnnnnnnnn

SEQ ID NO: 309400 - DNA, 537 bp, Homo sapiens
  misc_feature: GZ8MTXP02FL5YY.25.86.H09.1.454.CMB.2.raw
  modified_base (397)..(397): a, c, t, g, unknown or other
  misc_feature (397)..(397): n is a, c, g, or t
tcagactgtacagtcacgaccggtgctcgatttagtgctatagacttgggtttgggggagtcagacccactcaggacacagcatggacatgagggtccccgctcagctcctggggcttctgctgctctggctcccaggtgccaaatgtgccatccagttgacccagtctccatcctccctgtctgcctctgttcgagacatagtcaccatcacttgtcgggctagtcgggtcattggcagtgctttagcctggtatcagcagaaaccgaggggaagctcctaagctcctgatctttgatgcctcagttggaaagtggagtccatcaaggttcagcggcagtggatcgtggggactagtatttcactcctcaccatcgagcagcctgcagcctgaatnttctcgactaacctatttattacgtactaaactaatttaacggactttaccctcttcctccgttcgggacgggtaggaccgtaaagggtcggaagtacgtaacaacgtaacgtggtacggtactcgaccacctatcttcg

SEQ ID NO: 309401 - DNA, 601 bp, Homo sapiens
  misc_feature: GZ8MTXP02G96CK.25.86.H09.1.454.CMB.2.raw
  modified_base (222)..(222): a, c, t, g, unknown or other
  misc_feature (222)..(222): n is a, c, g, or t
  modified_base (248)..(248): a, c, t, g, unknown or other
  misc_feature (248)..(248): n is a, c, g, or t
tcagactgtacagtcacgaccggtgctcgatttagtgctatagacttgggtttgggctcaactctcttgacctcctgtgcaagaacatgaagcacctgtggttcttcctcctgctggtggcggcgcccagatgggtcctgtcccagctgcgtctgcaggagtcgagcccagggcaggtgaagccttcggagaccctgtccctcacctgctctgtctctggtnactccatcacagtatgctcattacgnggggctggcctccgccacgcccccgagggtaacgggcctggagtggtattggcgtattgtcttcagttaggtgggagtgcctaactctacgtccctcccctacaagagtcgacgtcaaccgtgtttcgtgactacgtccacgcagctagttgtctctgacacgtcgacgtctcgacaccggccgaccgacacggtccgttactagttacgtcgtgacggagacggtcgaacggtccgggtaaccgtaaaaccccctaccgtaaaccccttacgtttacgaaaccgtccggtaccggggaccgtaacggggtaaccgtcggtaccgacccgtacgtaacccgtcacgtaccccg

SEQ ID NO: 309402 - DNA, 648 bp, Homo sapiens
  misc_feature: GZ8MTXP02JEU8L.25.86.H09.1.454.CMB.2.raw
tcagactgtacagtcacgaccggtgctcgatttagtgctatagacttgggtttgggggcaggagtcagacccactcaggacacagcatggacatgagggtccccgctcagctcctggggcttctgctgctctggctcccaggtgccaaatgtgccatccagttgacccagtctccatcctccctgtctgcctctgttcgagacatagtcaccatcacttgtcgggctagtcgggtcattggcagtgctttagcctggtatcagcagaaaccaggggaagctacctaagctcctgatctttgatcgcctcctagtttaggaaagtggacgtcccatcaaggttcaggcggcaggtggatcgtgggacagtatttcattccctcacccatcagcagccctgctacgcctagaaagtactttcgtacgacctaaaccctttatttaactttagtaacctaaaacgttaaagttttaaaacgggtaaccttttaacccccgttccttacccgtttcccgggttttaccgggggacgggggttaaaccgggggtaaaccgtaaaagggggtttccgggaaaacgggtaacttaaaccggaaaaaccggtaaacgttagggttacggggcctttacggtaccgaaccgtttacg

SEQ ID NO: 309403 - DNA, 535 bp, Homo sapiens
  misc_feature: GZ8MTXP02FTM12.25.86.H09.1.454.CMB.2.raw
  modified_base (278)..(278): a, c, t, g, unknown or other
  misc_feature (278)..(278): n is a, c, g, or t
tcagactgtacagtcacgaccggtgctcgatttagtgctatagacttgggtttgggggcaggagtcagacccactcaggacacagcatggacatgagggtccccgctcagctcctggggcttctgctgctctggctcccaggtgccaaatgtgccatccagttgacccagtctccatcctccctgtctgcctctgttcgagacatagtcaccatcacttgtcggctagtcgggtcattggcagtgctttagcctggtatcagcagaaaccaggggaanctcctaagctcctgatcttgatgcctcagtttggaaagtgagtccatcaaggtcaggcgacagtggatcgtgggacagtatttcatcctcaccatcagcacgcctgacagacctgaaagtacttctagacctaacctattattacgtactaaactaaacgttttaaaggactttaccctcgttctaccgtcggtacgggacggaccgaaggtcggaacgtacgtacaaacgtaacgtggtacgacgtcgacactacg

SEQ ID NO: 309404 - DNA, 629 bp, Homo sapiens
  misc_feature: GZ8MTXP02IBAJ0.25.86.H09.1.454.CMB.2.raw
  modified_base (284)..(284): a, c, t, g, unknown or other
  misc_feature (284)..(284): n is a, c, g, or t
  modified_base (367)..(367): a, c, t, g, unknown or other
  misc_feature (367)..(367): n is a, c, g, or t
tcagactgtacagtcacgaccggtgctcgatttagtgctatagacttgggtttgggggagtcagacccactcaggacacagcatggacatgagggtccccgctcagctcctggggcttctgctgctctggctcccaggtgccaaatgtgccatccagttgacccagtctccatcctccctgtctgcctctgttcgagacatagtcaccatcacttggtcgggctaggtcgggtctagttggcagtgtctttagcctggtatcagacaggaaaccgaggggaacnctacctaagctcctgattctttagatcgccctccgtaggtttaggaaaggtggacgtcccaagtcgtaacggttcaggcggtnaggtggatcggtagggacagtattcacgtccctcacctatacacgcacgcccgtgccacggtcctagaagtacttacgtacgacctaacccttattactttacgtaactaaaccgttaaagtttaaacggtacctttaaccctccgttaccgttaccggttaccgggacggggtaaccggaccggtaaacgggtacgggaaagtacgtaaaccgtaaacgtacgttaaggtacgtacgtacgacctacctacgtactttccg

SEQ ID NO: 309405 - DNA, 572 bp, Homo sapiens
  misc_feature: GZ8MTXP02IKAD1.25.86.H09.1.454.CMB.2.raw
  modified_base (258)..(258): a, c, t, g, unknown or other
  misc_feature (258)..(258): n is a, c, g, or t
  modified_base (279)..(279): a, c, t, g, unknown or other
  misc_feature (279)..(279): n is a, c, g, or t
  modified_base (371)..(371): a, c, t, g, unknown or other
  misc_feature (371)..(371): n is a, c, g, or t
  modified_base (382)..(382): a, c, t, g, unknown or other
  misc_feature (382)..(382): n is a, c, g, or t
  modified_base (414)..(414): a, c, t, g, unknown or other
  misc_feature (414)..(414): n is a, c, g, or t
  modified_base (471)..(471): a, c, t, g, unknown or other
  misc_feature (471)..(471): n is a, c, g, or t
tcagactgtacagtcacgaccggtgctcgatttagtgctatagacttgggtttgggggagtcagacccactcaggacacagcatggacatgagggtcccccgctcagctcctggggcttctgctgctctggctcccaggtgccaaatgtgccatccagttgacccagtctccatcctccctgtctgcctctgttcgagacatagtcaccatcacttgcgggctagtcgggtcattggcagtgtctttagccttggtancagcaagaaaccgagggaacnctactaagctctgtatcttagatcgcctacgtaggtttaggaaagtggtacgtccatcgagtcagcgcgagtgatgtgggactagtatttcntcctacactancgagcagcctgacagtcctagaagtcttacgngtacctaaactttattacttacgtaacctaaactaaagtttaacgtactttaccctnttaccgtccgttacgggacggtaagggtaaaccgaaagggtagaactaacgtaacaaaacggtacgtaaggtcggactacgaacctactactttacgtacg

SEQ ID NO: 309406 - DNA, 525 bp, Homo sapiens
  misc_feature: GZ8MTXP02GCEP3.25.86.H09.1.454.CMB.2.raw
  modified_base (482)..(482): a, c, t, g, unknown or other
  misc_feature (482)..(482): n is a, c, g, or t
tcagactgtacagtcacgaccggtgctcgatttagtgctatagacttgggtttggggagctctgggaaaggagccccagccctgagattcccaggtgattccattcggtgatcagcactgaacacagaactcaccatggagtttggactgagctgggttttccttgttgccattttaaaaggtgtccagtgtgaagtgcaactggtggagtcgtgggggagccgtggtacaggccggggggtccctgagactctcctgtgcaacatctggattcgccttcagtaactttggcatccactggtccgcaggctccaggcaagggactagagtgggtgacttttagtgggcatgatggcagtgataagcctatgcagactccgtcaagggccgtcttctccatctccagagacacgcaagacgacgtctttagacaaatagaaacgctagacgacccgaggacacggactatagtatactgtcgngacgagcagtgagagtggcgagcggacgtggacgtcgtcgggg

SEQ ID NO: 309407 - DNA, 829 bp, Homo sapiens
  misc_feature: GZ8MTXP02HBGYX.25.86.H09.1.454.CMB.2.raw
tcagactgtacagtcacgaccggtgctcgatttagtgctatagacttgggtttgggggagtcagacccactcaggacacagcatggacatgagggtccccgctcagctcctggggcttctgctgctctggctcccaggtgccaaatgtgccatccagttgacccagtctccatcctccctgtctgcctctgttcgagacatagtcaccatcacttggtcggcttaggtcggtctagttggctaggtgtactttagccgtggtactcgagacgaacggaaaacccggaggggaaactccttaccgtaaaggtccttaccgtggtaactttccgttttggaactcgtacccttaccggtaagggttttacggggaaacgttcggaacgttcccccgaagtttaccggtaaaaccggggtttccgaacggcccggggtacgtaacggggttaggtaaccgttccgggttaagggggaaacccttaaagggtttacccttttacccgacgtttacccccgttaaccctaaacccagttaacccggacgtacccgtaaccgggaccctttcggacccgtaacggttaaccccgtaagggtaaaccgttcgtttaacctaccgggtaaacctttaaacccctttaagtttaagtttaccgttaaaccttaaaaacgttaacgttttaaaccggtacctttaacccctccgttaacgtttcccggtaccgggggaaggtaaccgggaccgttaaacggggtaggaaactacgttaaaccgaaacggtaaccgttggggacgttactaccggactaaaccgtacttccggtttaacc

SEQ ID NO: 309408 - DNA, 529 bp, Homo sapiens
  misc_feature: GZ8MTXP02GZXRY.25.86.H09.1.454.CMB.2.raw
  modified_base (272)..(272): a, c, t, g, unknown or other
  misc_feature (272)..(272): n is a, c, g, or t
  modified_base (388)..(388): a, c, t, g, unknown or other
  misc_feature (388)..(388): n is a, c, g, or t
  modified_base (392)..(392): a, c, t, g, unknown or other
  misc_feature (392)..(392): n is a, c, g, or t
tcagactgtacagtcacgaccggtgctcgatttagtgctatagacttgggtttgggggagtcagacccactcaggacacagcatggacatgagggtccccgctcagctcctggggcttctgctgctctggctcccaggtgccaaatgtgccatccagttgacccagtctccatcctccctgtctgcctctgttcgagacatagtcaccatcacttgtcgggctagtcgggtcattggcagtgcttagcctggtatcagcagaaccagggaanctctaagctctgatcttgatgcctctagtttggaagtggatccatcaacgtcagcgcagtgatcgtgggacagtattcgatcctacaccatcagcagcctgccagcctagaacgtnttcngactaacttattattgtaactaaacgtaatttaacggtacttaccctctacgttccgttacgggacggaacggacctaaagggtcggaagtacgtaaccgaaacgtactggtcgacgtacgaccacctatcgtttcg

SEQ ID NO: 309409 - DNA, 629 bp, Homo sapiens
  misc_feature: GZ8MTXP02GBCTB.25.86.H09.1.454.CMB.2.raw
  modified_base (280)..(280): a, c, t, g, unknown or other
  misc_feature (280)..(280): n is a, c, g, or t
tcagactgtacagtcacgaccggtgctcgatttagtgctatagacttgggtttgggggcaggagtcagacccactcaggacacagcatggacatgagggtccccgctcagctcctggggcttctgctgctctggctcccaggtgccaaatgtgccatccagttgacccagtctccatcctccctgtctgcctctgttcgagacatagtcaccatcacttgtcggctaggtcgggtcattggcagtgtcttagcctggtatcagcagaaaccgaggggaanctcctaagctcctgattcttgatcgcctcgtaggtttaggaagtggacgtccatacgtaaggttcaggcggctaggtggtacgtcgtagggactagtactttcaacttcccactacctatcgagcgacgcctgccacgacctaggtaaactctttaccgcgtaacctaacctttagtttacttacgtaactaaaacttaagttttaaacgacctttaaccctctttacccgttaccggtttacgggacggggtaaacgggtaaccggtaaggggtacgggtaaacgtaacgttaaaccgaaacggtaaccgttgggtacggtaccttaccggaaccctaccgtttaccg

SEQ ID NO: 309410 - DNA, 622 bp, Homo sapiens
  misc_feature: GZ8MTXP02HCPZF.25.86.H09.1.454.CMB.2.raw
tcagactgtacagtcacgaccggtgctcgatttagtgctatagacttgggtttggggagctctgggaaaggagccccagccctgagattcccaggtgattccattcggtgatcagcactgaacacagaactcaccatggagtttggactgagcttgggttttccttgttgcctaattttaaaaggtgtccagtgtgaagtgcaactggtggagtcgtgggggagccggtggtacgaggccggggggtcctgagactctcctgtgtagcctctggattcattgttgatgattatgccatgcacgtgggtcccgtacgaacggggtccggggaaggtcgtggaggttcgggtcttcgttcttagtgtacgttggggagtaggggaagaaacgtaacctacgtagtcgacaggtaccttgtggttaggaaacgggggttctaactttcccaaccctaccctacccgaagaacgaaccaaacaataccaaacgtaacctccctagtactactgaacaaagtgactagtctagacacctgatcgacaccgtcttagtattagttgagttaggaaaggtcggtagtggtaaggtacgacgtcgaccgtaccggacccccgtggtaccg

SEQ ID NO: 309411 - DNA, 557 bp, Homo sapiens
  misc_feature: GZ8MTXP02FKTDN.25.86.H09.1.454.CMB.2.raw
  modified_base (306)..(306): a, c, t, g, unknown or other
  misc_feature (306)..(306): n is a, c, g, or t
  modified_base (358)..(358): a, c, t, g, unknown or other
  misc_feature (358)..(358): n is a, c, g, or t
  modified_base (370)..(370): a, c, t, g, unknown or other
  misc_feature (370)..(370): n is a, c, g, or t
  modified_base (408)..(408): a, c, t, g, unknown or other
  misc_feature (408)..(408): n is a, c, g, or t
tcagactgtacagtcacgaccggtgctcgatttagtgctatagacttgggtttggggagctctgggaaaggagccccagccctgagattcccaggtgattccattcggtgatcagcactgaacacagaactcaccatggagtttggactgagctgggttttccttgttgccattttaaaaggtgtccagtgtgaagtgcaactggtggagtctgggggagccgtggtacaggccggggggtccctggagactctcctgtgtagcctctggattcatgttgatgattatgccatgcactgggtcctnaaggtccggggaaggtctggagtgggtctcgtcttatgacttgggatggganagactatatgcngactctgtgaagggtcattcacacctcagtagacaacntcaagaactcccagtatctgactaaatgggacaggtctaggacacctgattcgacctaccggccctttaggtactttagttacgtgtacggaaacggtcggtgttaggaaggttgaacgtcggccttacgggaacccccgtggtacccg

SEQ ID NO: 309412 - DNA, 639 bp, Homo sapiens
  misc_feature: GZ8MTXP02GIWRO.25.86.H09.1.454.CMB.2.raw
  modified_base (277)..(277): a, c, t, g, unknown or other
  misc_feature (277)..(277): n is a, c, g, or t
tcagactgtacagtcacgaccggtgctcgatttagtgctatagacttggggtttgggggagtcagacccactcaggacacagcatggacatgagggtccccgctcagctcctggggcttctgctgctctggctcccaggtgccaaatgtgccatccagttgacccagtctccatcctccctgtctgcctctgttcgagacatagtcaccatcacttgtcgggctagtcgggtcattggcagtgctttagcctggtatcagcagaaaccgaggggaanctcctaagctcctgatctttgatgcctccagtttggaagtgagtccatcaaggtcagcgcaggtggatcgtaggggacagtatttcacttccctacacccatcagacagccctagcctagcccgtagaacgtacttcctaggaccttaaaccttatttaacttacggttaacctaaaacgttaaacgtttttaaacgggtaaccttttaacccccttacgtttcccgttacccggtttaccggggacgggggaaaccgggggtaacccggtaaagggggttaccgggaaagtaacgttaaaccgaaaaccggtaaaccgttgggtcggtacgttacggaccgtaacctacgttcctttccgg

SEQ ID NO: 309413 - DNA, 717 bp, Homo sapiens
  misc_feature: GZ8MTXP02I3AJU.25.86.H09.1.454.CMB.2.raw
  modified_base (632)..(632): a, c, t, g, unknown or other
  misc_feature (632)..(632): n is a, c, g, or t
tcagactgtacagtcacgaccggtgctcgatttagtgctatagacttgggtttggggagctctgggaaaggagccccagccctgagattcccaggtgattccattcggtgatcagcactgaacacagaactcaccatggagtttggactgagctgggttttccttgttgccattttaaaaggtgtccagtgtgaagtgcaactggtggagtcgtgggggagccggtggtacgaggccggggggtccctggagactcctcgtgtgtcgcctcgtgtattctagttgttgatgtattagtcgacctagtcgcgtacggtcgggtccgtacgggtacggggtacgggggtaaggtcggtagggtgggttcggttccttcgtttacttaggtacggttacggttaggggtaggtaggggtaacgtaaaccgtaaccttacgtagtcggacacggtactcggtaggtacgggtacggtacgtacttaccaaccccgtcctaacggaacgacgaaacaaactacaaaccgaaaacgttcccccttgtatcttacggacaaaaccgtaaggtacgaccggttattaccggaaaccaccgtacggtatacgacgtaaccccggtccctttgtttaagttntttaaggttcggtaggtaacggggtacggttggttgttaagaagggtataccggtcgtacccgggtaccccggaccggtactacg

SEQ ID NO: 309414 - DNA, 641 bp, Homo sapiens
  misc_feature: GZ8MTXP02IUQGO.25.86.H09.1.454.CMB.2.raw
  modified_base (286)..(286): a, c, t, g, unknown or other
  misc_feature (286)..(286): n is a, c, g, or t
  modified_base (381)..(381): a, c, t, g, unknown or other
  misc_feature (381)..(381): n is a, c, g, or t
tcagactgtacagtcacgaccggtgctcgatttagtgctatagacttgggtttggggagctctgggaaaggagccccagccctgagattcccaggtgattccattcggtgatcagcactgaacacagaactcaccatggagtttggactgagctgggttttccttgttgccattttaaaaggtgtccagtgtgaagtgcaactggtggagtcgtgggggagccgtggtacaggccggggggtcctgagctctcctgtgtagcctctggattcatgttgatgattangccatgcacgtgggtccgtcgaagggtccggggaaggtctggagtgggtctctcttatgtacgtggggatggggaagaagtaacctactatgacngacttcgtggtaggtaaggggtctacttcccaaccctacctaccgagaacgaacaaacaatacaaacgtaccctaccctagtaactctacgaacaaacgtgggaaccaggttaccacggaacctaccgtagactacgaccgtacccgttctttaggttattttaagttcggttaggttaaggtaaacggggtcgggtttaggttgggtaaggttgaaacgtttcggaccccggttacgggaacccccggtcggtaacccg

SEQ ID NO: 309415 - DNA, 552 bp, Homo sapiens
  misc_feature: GZ8MTXP02HPGYT.25.86.H09.1.454.CMB.2.raw
  modified_base (226)..(226): a, c, t, g, unknown or other
  misc_feature (226)..(226): n is a, c, g, or t
  modified_base (280)..(280): a, c, t, g, unknown or other
  misc_feature (280)..(280): n is a, c, g, or t
  modified_base (396)..(396): a, c, t, g, unknown or other
  misc_feature (396)..(396): n is a, c, g, or t
tcagactgtacagtcacgaccggtgctcgatttagtgctatagacttgggtttgggggcaggagtcagacccactcaggacacagcatggacatgagggtccccgctcagctcctggggcttctgctgctctggctcccagataccagatgtgacgtccagatgacccagtctccatcctccctgtctgcatctgttggagacagaatcagcatcacttgccgggngagtcgagggcattagctaattatttagcctggtatcaaacagaaaccaggganagttcctaagctcctgatctatgctgcctcctacgtacactccgacggggtccatctcggttcagcggcagtgaattcgtagggacagacgttcactctacatatcagcacgtccngcagtcctagaagtattgttacgactaactttattactagtaaataaaactattaaactacgtacctccccttactacctacgtttcggaccgggaacggggtaaccgaaggggtaaggacgaacttaacgaaaacggttaactggttaggacccg

SEQ ID NO: 309416 - DNA, 757 bp, Homo sapiens
  misc_feature: GZ8MTXP02G4IQF.25.86.H09.1.454.CMB.2.raw
tcagactgtacagtcacgaccggtgctcgatttagtgctatagacttgggtttgggggagtcagacccactcaggacacagcatggacatgagggtccccgctcagctcctggggcttctgctgctctggctcccaggtgccaaatgtgccatccagttgacccagtctccatcctccctgtctgcctctgttcgagacatagtcaccatcacttgtcgggctaggtcgggtcattggcagtgctttagcctggtatcagcaagaaaccgaggggaacgctacctaagcctcctgtacttctttagatcgccttaccgtagggttttagggaaaggttcggaacgtcccctaagttacgtaaaccggggttcgaacggcgggactaggggtacggtaacttccgggtagggggtaaacctaggttaccttttccgaaacgtttcccccttaaccgaaacccgtacttacccgaaacggtccgaaacgggtccccttaagggccaacggttacccgtaaggtaaacgttacttttaccacggtaacccttaaacctttatttaacgtttacggtaaactaaaaccgttaaagttttaacggtaaccttttaaccccgttctttccggttacccgtttaccggggaaccggggtaacggggtaacccgtaaacggggttaggggaaactaaccgttaaccgaaaacgtaaccggtggttaacggcgttacggacctaacccgttacgtttaccgttacg

SEQ ID NO: 309417 - DNA, 691 bp, Homo sapiens
  misc_feature: GZ8MTXP02IUBZT.25.86.H09.1.454.CMB.2.raw
tcagactgtacagtcacgaccggtgctcgatttagtgctatagacttgggtttggggagctctgggaaaggagccccagccctgagattcccaggtgattccattcggtgatcagcactgaacacagaactcaccatggagtttggactgagctgggttttccttgttgccattttaaaaggtgtccagtgtgaagtgcaactggtggagtcgtgggggagccgtggtacaggccggggggtccctgagactctcctgtgtagcctctgattcattgttgatgtattatgccatgcacgtgggtccgacgaacgggtccggggaaggtcgtggtaggtcgggtctcttcttagtgtacgttgggatggggaagaaacggtaacctactagtcgactagtacctgttaggtaggtaacggggttacgactttaccgaaccctacccgtaccgaagaacgaaaccaaactataccgaaaacgtaacccttcccgtagtactcgtacggaaacctaaaagttcggaaacctaggttacctaacggaacctaacccttggaaacttaccggaccctaacccggttcctttaggttaatttacgttagggttacgtacggtaaaaggggttcgggttggtttagggaaggttaccggtaaatcggtcccgtaaaccggggacccccgtggtaaccg

SEQ ID NO: 309418 - DNA, 616 bp, Homo sapiens
  misc_feature: GZ8MTXP02HIW0D.25.86.H09.1.454.CMB.2.raw
  modified_base (275)..(275): a, c, t, g, unknown or other
  misc_feature (275)..(275): n is a, c, g, or t
tcagactgtacagtcacgaccggtgctcgatttagtgctatagacttgggtttgggggcaggagtcagacccactcaggacacagcatggacatgagggtccccgctcagctcctggggcttctgctgctctggctcccaggtgccaaatgtgccatccagttgacccagtctccatcctccctgtctgcctctgttcgagacatagtcaccatcacttgtcgggctagtcggtcattggcagtgctttagcctggtatcagcagaaccaggganctctagctctgatcttgatgcctcagtttggaaagtggagtccatcgaagttcaggtcggcagtggagtcgtaggacagtactttcgactcctcaccatcagacagtccctgacgacgaccgtagtaaacgtactttcgacgtacctaaacccttatttaagttcgtaaacctaaacgttaaacgttttaaccgggaaccttttaacccctccgttaccgtttacccgggtttacccgggggacggggaaaccggggtaaacccgtaaggggtacgggacgtaacgttaaccgaaaaacggtccgtagggttcggtacgtaccggaccgtaacccgttacg

SEQ ID NO: 309419 - DNA, 562 bp, Homo sapiens
  misc_feature: GZ8MTXP02JGY67.25.86.H09.1.454.CMB.2.raw
  modified_base (349)..(349): a, c, t, g, unknown or other
  misc_feature (349)..(349): n is a, c, g, or t
  modified_base (382)..(382): a, c, t, g, unknown or other
  misc_feature (382)..(382): n is a, c, g, or t
  modified_base (555)..(555): a, c, t, g, unknown or other
  misc_feature (555)..(555): n is a, c, g, or t
tcagactgtacagtcacgaccggtgctcgatttagtgctatagacttgggtttggggagctctgggaaaggagccccagccctgagattcccaggtgattccattcggtgatcagcactgaacacagaactcaccatggagtttggactgagctgggttttccttgttgcctattttaaaaggtgtccagtgtgaagtgcaactggtggagtcgtgggggagccggtggtacaggccggggggtcctggagactctcctgtgtagcctctggattcatgtttgatgattatgccatgcacgtgggtccgtgaagggtccggggaaggtcgtggagtgggtctctcttangtacgtgggatggggagaagacctatatcgacngactctgtagaaggggtcattccaccacctccagagacaacatacaaagaaccttccctagtactctgactaaagtggacagtctagaccactgatcgaccaccgtcttagtattagtgtagtagaacggcggttgttagaaggttagaacgtggcccgtacggaacccccgnggtaccg

SEQ ID NO: 309420 - DNA, 561 bp, Homo sapiens
  misc_feature: GZ8MTXP02HVITV.25.86.H09.1.454.CMB.2.raw
  modified_base (405)..(405): a, c, t, g, unknown or other
  misc_feature (405)..(405): n is a, c, g, or t
  modified_base (409)..(409): a, c, t, g, unknown or other
  misc_feature (409)..(409): n is a, c, g, or t
  modified_base (455)..(455): a, c, t, g, unknown or other
  misc_feature (455)..(455): n is a, c, g, or t
tcagactgtacagtcacgaccggtgctcgatttagtgctatagacttgggtttgggggcaggagtcagacccactcaggacacagcatggacatgagggtccccgctcagctcctggggcttctgctgctctggctcccaggtgccaaatgtgccatccagttgacccagtctccatcctccctgtctgcctctgttcgagacatagtcaccatcacttgtcgggctagtcgggtcattggcagtgctttagcctggtatcagcagaaaccaggggaagctctaagctcctgatcttgatgcctctagtttggaaagtggagtccatcgaagttcagcgcagtgggatcgtggggactagtatttcgatccctacacctatccagcagccctgctagcctgaagnttcngactaacttattatagtacaaactaaatttaacggacttaaccctntaccgttccgttacgggaccgggtaagggacccgtaaaagggtcggaaacgtaacgttaccgaaaaacggtacttaggttcgggacttacggacctaccgttaacg

SEQ ID NO: 309421 - DNA, 879 bp, Homo sapiens
  misc_feature: GZ8MTXP02INRKU.25.86.H09.1.454.CMB.2.raw
tcagactgtacagtcacgaccggtgctcgatttagtgctatagacttgggtttgggggcaggagtcagacccactcaggacacagcatggacatgagggtccccgctcagctcctggggcttctgctgctctggctcccaggtgccaaatgtgccatccagttgacccagtctccatcctcctgtctgcctctgttcgagacatagtcaccatctacgttggcgggtctaggtcgggtctagttggctagtcgtacgtttacgccgtggtactacgacgacgaaacggaaaaccggaaggggaactaccttaaccgtaaacggccctttaccgtacggttactttacgttttacggtacttaccggttacccctttaccggtttaagggttttaaacggggtaaaacgggttaccgggtaaaccggttacccctaaacggttaaccggttaaaacggtttccgaaacggggtccggacgttagggttaggtacgttaccgggtaagggggtaaacctaacggtttaactttaccgtaaaccctttccccgtaaccaaacccttaaaggtcccaaaccgggtcccaaacggttccccgtaaggaaccgtaaccggtacccgtaaagggtaaaacgtttcgtttacccgaacgtaaaacccctttaaaacgtttttactttaaacgtaaaccgtaaaacttaaaaacggtttaaacgtttaacccggttaccccttttaaccccgtccgttacccggtttaccggggtacgggggaaaccggggtaaacggtaaaccgggtaaacggggtacgtaaaacgtaaaccgaaaaccggtaaacggttacggaccggttacgacccgtaacgtaccttaacgtcg

SEQ ID NO: 309422 - DNA, 427 bp, Homo sapiens
  misc_feature: GZ8MTXP02H099Y.25.86.H09.1.454.CMB.2.raw
  modified_base (419)..(427): a, c, t, g, unknown or other
  misc_feature (419)..(427): n is a, c, g, or t
tcagactgtacagtcacgaccggtgctcgatttagtgctatagacttgggtttgggagaagaacctactatgcagactctgtgaagggtcgattcaccacctccagagacaacatcaagaactccctgtatctgcaaatggacagtctgacacctgatgacaccgccttgtattattgtgtgaaaggcggtgttgaggtgaatgcctggaacccccgcggtcagcactacttctacatgggcgtctggggcaaaggggctacggtcatcgtctcctcagcctccaccaagggccccatcggtccttccccctggccgcccctgcctccaggacgcacctccgagagcacacgccggccctgggctgcctggtcaaggctacttccatgacagtctgacgcgggctggcaggcgcatagnnnnnnnnn

SEQ ID NO: 309423 - DNA, 572 bp, Homo sapiens
  misc_feature: GZ8MTXP02HE1NK.25.86.H09.1.454.CMB.2.raw
  modified_base (410)..(410): a, c, t, g, unknown or other
  misc_feature (410)..(410): n is a, c, g, or t
  modified_base (562)..(562): a, c, t, g, unknown or other
  misc_feature (562)..(562): n is a, c, g, or t
tcagactgtacagtcacgaccggtgctcgatttagtgctatagacttgggtttgggggcaggagtcagacccactcaggacacagcatggacatgagggtccccgctcagctcctggggcttctgctgctctggctcccaggtgccaaatgtgccatccagttgacccagtcctccatcctccctgtctgcctctgttcgagacatagtcaccatctacttggtcggctaggtcgggtctagttggctagtgtctttagcctggtatcagcaagaaaccgagggagctactaagctcctgacttcttgatcgtcctcgtaggttaggaaagtggtacgtccatcgtaagttcaggcgcgaggtggtatcgtaggggacagttaacttcactccttacaaccctatcgacncgacgcccgtgaccaggtccctagaaagtctttacggacaccttaaaccttagttacttagtaaccaaattaagttacgtactacccttcgtcctcgttacgggcggtacgaaccgtaggtcgactacgaacgtaaacgtacgtggcgtacncgacaacgtc

SEQ ID NO: 309424 - DNA, 579 bp, Homo sapiens
  misc_feature: GZ8MTXP02FM886.25.86.H09.1.454.CMB.2.raw
  modified_base (280)..(280): a, c, t, g, unknown or other
  misc_feature (280)..(280): n is a, c, g, or t
  modified_base (401)..(401): a, c, t, g, unknown or other
  misc_feature (401)..(401): n is a, c, g, or t
  modified_base (405)..(405): a, c, t, g, unknown or other
  misc_feature (405)..(405): n is a, c, g, or t
tcagactgtacagtcacgaccggtgctcgatttagtgctatagacttgggtttgggggcaggagtcagacccactcaggacacagcatggacatgagggtccccgctcagctcctggggcttctgctgctctggctcccaggtgccaaatgtgccatccagttgacccagtctccatcctccctgtctgcctctgttcgagacatagtcaccatcacttgtcgggctagtcgggtcattggcagtgctttagcctggtatcagcagaaaccgaggggaanctctaagctctgatcttgatgcctcagtttggaaagtggacgtccatcaaggtcagcggcaggtggatcgtgggacagtatttcatcctcaccatcagcagccctgcagccgtagaaagtnttcngacctaaccttatttacttacgtactaaacttaaagtttaaaggacctttaacccctcttccgttccgtttacgggaccggggtaacgggaacccgtaaaggggttacggaaagtacttaaaccgaaaacggtaaccgttaggtacgggtaccttacggacccaaccgttaacg

SEQ ID NO: 309425 - DNA, 527 bp, Homo sapiens
  misc_feature: GZ8MTXP02H29UB.25.86.H09.1.454.CMB.2.raw
  modified_base (334)..(334): a, c, t, g, unknown or other
  misc_feature (334)..(334): n is a, c, g, or t
  modified_base (358)..(358): a, c, t, g, unknown or other
  misc_feature (358)..(358): n is a, c, g, or t
tcagactgtacagtcacgaccggtgctcgatttagtgctatagacttgggtttgggggagtcagacccactcaggacacagcatggacatgagggtccccgctcagctcctggggcttctgctgctctggctcccaggtgccaaatgtgccatccagttgacccagtctccatcctccctgtctgcctctgttcgagacatagtcaccatcacttgtcgggctagtcgggtcattggcagtgctttagcctggtatcagcagaaaccaggggaagctcctaagctcctgatctttgatgcctcagtttggaaagtggacgtccatcaacggttnagcggcaggtggatcgtgggaacngtatttcatcctcaccatcagcagcctgaccagcctagagattctgacctaacttattacttagtacaaataaatttaaggtacttaccctctctcgttcggacggagggtaaccaagggtacggaagtactaacaaaacgaagtcggaggctcgacaccgattcctag

SEQ ID NO: 309426 - DNA, 554 bp, Homo sapiens
  misc_feature: GZ8MTXP02FTSO6.25.86.H09.1.454.CMB.2.raw
  modified_base (280)..(280): a, c, t, g, unknown or other
  misc_feature (280)..(280): n is a, c, g, or t
  modified_base (514)..(514): a, c, t, g, unknown or other
  misc_feature (514)..(514): n is a, c, g, or t
tcagactgtacagtcacgaccggtgctcgatttagtgctatagacttgggtttgggggcaggagtcagacccactcaggacacagcatggacatgagggtccccgctcagctcctggggcttctgctgctctggctcccaggtgccaaatgtgccatccagttgacccagtctccatcctccctgtctgcctctgttcgagacatagtcaccatcacttgtcggctagtcgggtcattggcagtgtctttagcctggtatcagcagaaaccgaggggaanctctaagctctgatcttgatgcctcagtttggaaagtgacgtccatcaagtcagcgcagtgatcgtgggacagtactttcacttccctacaacctatcagcacgcctggacacgcctagaaagtacttctacgacctaaaccttattaacgttcgtaactaaactaagtttaaacgacctttaaccctcttaccttccgtacgggacgggacgggaaccgtaagggtcgggaanactaacgaaaacgtaactggtacggctaggacctactaac

SEQ ID NO: 309427 - DNA, 629 bp, Homo sapiens
  misc_feature: GZ8MTXP02GLIVF.25.86.H09.1.454.CMB.2.raw
  modified_base (282)..(282): a, c, t, g, unknown or other
  misc_feature (282)..(282): n is a, c, g, or t
tcagactgtacagtcacgaccggtgctcgatttagtgctatagacttggggtttgggggagtcagacccactcaggacacagcatggacatgagggtccccgctcagctcctggggcttctgctgctctggctcccaggtgccaaatgtgccatccagttgacccagtctccatcctccctgtctgcctctgttcgagacatagtcaccatcacttggtcgggctagtcgggtcagttggctagtgctttagcctggtatcagacaggaaaccgaggggaanctacctaagctcctgtattcttagatcgccttccgtagggtttaggaaagtcggacgtacccaagtacgaacggttcgacgtcggactaggtgactcggtgggactagtattcactcctcaacatacagtcacgccctgccacgtctaggaaactctttaccggacgtacccttaaacttatttacgttacttaaacctaaaacctttaaagttttaaaccggtacctttaaccccgtcctttacccgttacccgggttacggggaccgggttaacggggaaccgtaaggggtacgacgtaacaacgaaacgtacgtgtacggtacacgaccacgtacttacttccg

SEQ ID NO: 309428 - DNA, 605 bp, Homo sapiens
  misc_feature: GZ8MTXP02G0BWX.25.86.H09.1.454.CMB.2.raw
  modified_base (294)..(294): a, c, t, g, unknown or other
  misc_feature (294)..(294): n is a, c, g, or t
tcagactgtacagtcacgaccggtgctcgatttagtgctatagacttgggtttgggggagtcagacccactcaggacacagcatggacatgagggtccccgctcagctcctggggcttctgctgctctggctcccaggtgccaaatgtgccatccagttgacccagtctccatcctccctgtctgcctctgttcgagacatagtcaccatcacttgtcgggctaggtcgggtcagttggcagtgctttagcctggtatcagcaaggaaaccgaggggaagctacctaagctccngtatcttgatgcctcagttagaagtgacgtccatcaagtcagcgcagtggatcgtgggactagtatttcaactcctacaacactacgaacgcacgcccgtgaccgagcccgtagaaacgtattacctacgactaaaccttattacttagtaactaaaacttaaagtttaacggtaacctttaccctccgttaccgttccggttaccgggacggggaacggggtaacccgtaaaaggggtcgggaaacgtaactaacccgtaaaacgaaccgttggtacggacggttaccacgtaccctattccggtttacg

SEQ ID NO: 309429 - DNA, 574 bp, Homo sapiens
  misc_feature: GZ8MTXP02GTWQE.25.86.H09.1.454.CMB.2.raw
  modified_base (399)..(399): a, c, t, g, unknown or other
  misc_feature (399)..(399): n is a, c, g, or t
tcagactgtacagtcacgaccggtgctcgatttagtgctatagacttgggtttgggggagtcagacccactcaggacacagcatggacatgagggtccccgctcagctcctggggcttctgctgctctggctcccaggtgccaaatgtgccatccagttgacccagtctccatcctccctgtctgcctctgttcgagacatagtcaccatcacttgtcgggctagtcgggtcattggcagtgctttagcctggtatcagcagaaaccgaggggaagctactaagctcctgattcttgatgcctcagtttggaaagtggacgtccatcaaggtcagcgcagtggatcgtgggacagtatttcactcctcacatcagcagcctgcagcctagaagtcttcngtactaaccttatttacttcgtaactaaataaacgtttaaggacctttaacctcttcctacccgtttcggggaccgggtaaggggacccgtaaaggggtacggaaacggtaactaaccgtaaaacggtaacgttcggttacggcgttacggaccaaccgttacgttctttaccgg

SEQ ID NO: 309430 - DNA, 609 bp, Homo sapiens
  misc_feature: GZ8MTXP02FQQF0.25.86.H09.1.454.CMB.2.raw
  modified_base (383)..(383): a, c, t, g, unknown or other
  misc_feature (383)..(383): n is a, c, g, or t
  modified_base (399)..(399): a, c, t, g, unknown or other
  misc_feature (399)..(399): n is a, c, g, or t
tcagactgtacagtcacgaccggtgctcgatttagtgctatagacttgggtttgggggcaggagtcagacccactcaggacacagcatggacatgagggtccccgctcagctcctggggcttctgctgctctggctcccaggtgccaaatgtgccatccagttgacccagtctccatcctccctgtctgcctctgttcgagacatagtcaccatcacttgtcgggctaggtcgggtcattggcagtgctttagcctggtatcagcagaaaccgaggggaacgctacctaagctcctgattctttgatcgcctctaggtttaggaaagtggactccatacaggtcagcggcagtggatcgtgggacagtattcactcctcaccntcagctagcctgaccngacctagaagtacttctacgactaaaccttatttacgttacgtacctaaaactaaaagtttaacggtacctttaacccctcttaccgttccgttacggggaccggggtaaacggggaacccgttaaaggggtcgggtaaaacgtaacgttaacccggaaaaacggtaaccgtagggttacggacctttacgggaccctaacccgttaacg

SEQ ID NO: 309431 - DNA, 576 bp, Homo sapiens
  misc_feature: GZ8MTXP02J0OJ2.25.86.H09.1.454.CMB.2.raw
  modified_base (281)..(281): a, c, t, g, unknown or other
  misc_feature (281)..(281): n is a, c, g, or t
tcagactgtacagtcacgaccggtgctcgatttagtgctatagacttgggtttgggggcaggagtcagacccactcaggacacagcatggacatgagggtccccgctcagctcctggggcttctgctgctctggctcccaggtgccaaatgtgccatccagttgacccagtctccatcctccctgtctgcctctgttcgagacatagtcaccatcacttgtcgggctaggtcggtcattggcagtgctttagcctggtatcgagcaagaaccgaggggaanctctaagctctgatcttgatcgcctcgtaggtttaggaaagtggacgtccagtcgaaggttcaggcggacaggtggatcgtagggactagtatttcactcctacacatcagcagcctgacagccgtagtaaacgtcttcgtacgactaaccttatttacgttacgtactaaaacttaagtttaacgtactttaccctcgttacccgttccggttacggggacggtaaccggggaaccgtaacgggtagaacgacgttaacgaaacgtacgtggtacgtacgtacgtaccactacg

SEQ ID NO: 309432 - DNA, 486 bp, Homo sapiens
  misc_feature: GZ8MTXP02I6XYJ.25.86.H09.1.454.CMB.2.raw
  modified_base (269)..(269): a, c, t, g, unknown or other
  misc_feature (269)..(269): n is a, c, g, or t
  modified_base (346)..(346): a, c, t, g, unknown or other
  misc_feature (346)..(346): n is a, c, g, or t
  modified_base (474)..(486): a, c, t, g, unknown or other
  misc_feature (474)..(486): n is a, c, g, or t
tcagactgtacagtcacgaccggtgctcgatttagtgctatagacttgggtttgggagaagaacctactatgcagactctgtgaagggtcgattcaccacctccagagacaacatcaagaactccctgtatctgcaaatggacagtctgacacctgatgacaccgccttgtattattgtgtgaaaggcggtgtgaggtgaatgcctcggaacccccgcggtcagcacttacttctacatgggcgtcgtggggacaaaggggctacggtnatcgtctcctcacgccctccaaccgacgggccccagtccggtcccttcccccgtggcccgccctgcctccgaggacnccaccctccgaagcgccacgacggccggccccgtggggcctagcccgttgggtcgaaacggtcctaccgttccaacgttggtaaccaggttccgtaggcggcggggtcgtggaccgaaggcgcaatgnnnnnnnnnnnnn

SEQ ID NO: 309433 - DNA, 563 bp, Homo sapiens
  misc_feature: GZ8MTXP02HU5WQ.25.86.H09.1.454.CMB.2.raw
  modified_base (349)..(349): a, c, t, g, unknown or other
  misc_feature (349)..(349): n is a, c, g, or t
  modified_base (392)..(392): a, c, t, g, unknown or other
  misc_feature (392)..(392): n is a, c, g, or t
tcagactgtacagtcacgaccggtgctcgatttagtgctatagacttgggtttgggggagtcagacccactcaggacacagcatggacatgagggtccccgctcagctcctggggcttctgctgctctggctcccaggtgccaaatgtgccatccagttgacccagtctccatcctccctgtctgcctctgttcgagacatagtcaccatcacttgtcgggctagtcgggtcattggcagtgctttagcctggtatcagcagaaaccaggggaagctctaagctcctgatcttgatgcctcagtttggaagtggagtccatcaaggtcagcggcagtgatcgtgggacngatttcatcctcactatcagcagccctgcagcctgaagattcngacctaaaccttattacttgactaaactaatttaaacggactttaaccctctaccttccgttacgggacgggtacgggtaacccgaaaggggttcggaaagaacgttaaccgaaaacggtaaccgttaaggtacgggacccttaggaccctaaccctatttaccgtttacg

SEQ ID NO: 309434 - DNA, 552 bp, Homo sapiens
  misc_feature: GZ8MTXP02FE6VR.25.86.H09.1.454.CMB.2.raw
  modified_base (276)..(276): a, c, t, g, unknown or other
  misc_feature (276)..(276): n is a, c, g, or t
  modified_base (349)..(349): a, c, t, g, unknown or other
  misc_feature (349)..(349): n is a, c, g, or t
  modified_base (414)..(414): a, c, t, g, unknown or other
  misc_feature (414)..(414): n is a, c, g, or t
  modified_base (419)..(419): a, c, t, g, unknown or other
  misc_feature (419)..(419): n is a, c, g, or t
tcagactgtacagtcacgaccggtgctcgatttagtgctatagacttgggtttgggggagtcagacccactcaggacacagcatggacatgagggtcccgctcagctcctggggcttctgctgctctggctcccaggtgccaaatgtgccatccagttgacccagtctccatcctccctgtctgcctctgttcgagacatagtcaccatcacttgtcgggctagtcgggtcattggcagtgctttagcctggtatcagcagaaaccaggggtaacnctactaagcctctgtattcttgatcgtcctacgtaggttaggaaaggtggactccatacgaacggtcaggcgnaggtgatcgagggactagtacttcactccacacctatacacgcacgcctgacacgacgtagaatnttacncaactaacttattagttacaactaaacttaaagttaacgtacttaccctctccgtcgtacgggacgggacggaacgaagggtaggaacgaactaacgaaacgtacgtggacgtcgacgactaactactctacg

SEQ ID NO: 309435 - DNA, 556 bp, Homo sapiens
  misc_feature: GZ8MTXP02GCE9C.25.86.H09.1.454.CMB.2.raw
  modified_base (492)..(492): a, c, t, g, unknown or other
  misc_feature (492)..(492): n is a, c, g, or t
  modified_base (550)..(550): a, c, t, g, unknown or other
  misc_feature (550)..(550): n is a, c, g, or t
tcagactgtacagtcacgaccggtgctcgatttagtgctatagacttgggtttggggagctctgggaaaggagccccagccctgagattcccaggtgattccattcggtgatcagcactgaacacagaactcaccatggagtttggactgagctgggttttccttgttgccattttaaaaggtgtccagtgtgaagtgcaactggtggagtctgggggagccgtggtacaggccggggggtccctgagactctcctgtgtagcctctggattcatgtttgatgattatgccatgcactggggtccctgaaggtcccggggaagggtctgggaggtggggtctcgtcttagtgtacgttggggatggggagaagaaccgtactatggcagtactctggtagaagggtcgtattccaccacctcccagagacaacatcaaacgaacctccctagtatacctgaccaaatggacagtctagaccactgatgaccnccgcttagtacttattgtgtgaaaggtcggtgtgaaggtgaatcgcgtcggaccccgngtaccg

SEQ ID NO: 309436 - DNA, 642 bp, Homo sapiens
  misc_feature: GZ8MTXP02GN8WO.25.86.H09.1.454.CMB.2.raw
  modified_base (277)..(277): a, c, t, g, unknown or other
  misc_feature (277)..(277): n is a, c, g, or t
  modified_base (415)..(415): a, c, t, g, unknown or other
  misc_feature (415)..(415): n is a, c, g, or t
tcagactgtacagtcacgaccggtgctcgatttagtgctatagacttgggtttgggggagtcagacccactcaggacacagcatggacatgagggtccccgctcagctcctggggcttctgctgctctggctcccaggtgccaaatgtgccatccagttgacccagtctccatcctccctgtctgcctctgttcgagacatagtcaccatcacttgtcgggctagtcgggtcagttggcagtgctttagcctggtatcagcagaaaccgaggggaanctcctaagctcctgatcttgatcgcctcgagtttaggaaagtggacgtccatcaaggtcagcggcaggtaggatcgtggggactaggtatttcatcctacacccatacagcagtcctggctacgccgttaggaaactnttacctacgaacctaaccttatttacgttacgtaactaaaactttaaagtttaaacggtaccttttaaccccgtccgtttaccgttaccccggttaccgggggtaccggggtaacggggtaaacccggtaaaggggtttacggggaaacgttaacgtaaaccggtaaaacggttaaccgtggtttaaccgggcttacgggacctaacccgtactttaccggtttccg

SEQ ID NO: 309437 - DNA, 654 bp, Homo sapiens
  misc_feature: GZ8MTXP02GO7RQ.25.86.H09.1.454.CMB.2.raw
  modified_base (400)..(400): a, c, t, g, unknown or other
  misc_feature (400)..(400): n is a, c, g, or t
tcagactgtacagtcacgaccggtgctcgatttagtgctatagacttgggtttggggagctctgggaaaggagccccagccctgagattcccaggtgattccattcggtgatcagcactgaacacagaactcaccatggagtttggactgagctgggttttccttgttgcctaattttaaaaggtgtccagtgtgaagtgcaactggtggagtcgtgggggagccggtggtacgagggcccggggggtcctggacgactctcctgtgtagcctctggattcattgtttgatgattatgccatgcacgtgggtccgcgaagggtccggggaaggtcgtggaggttggggtctcttcgttatgtagttggggataggggaagaaagaaaccctataatgacngacttcgtggtaggaaggggttcaattcccgaacctaccctaccgaaaggacaaacaacaataccaaagtaaaccctcctatactacgtagacaaaagtggacctaaggtcctacgaacctactgacttagaccgtaccccgtactttaggttaatttagttggtacgtaagggaaaaccggtcgggttagtttagggaaaggtttgaaaacgtttcggtaccgtaacccggggaacccccgttggggaaaccc

SEQ ID NO: 309438 - DNA, 580 bp, Homo sapiens
  misc_feature: GZ8MTXP02IJQWP.25.86.H09.1.454.CMB.2.raw
  modified_base (286)..(286): a, c, t, g, unknown or other
  misc_feature (286)..(286): n is a, c, g, or t
  modified_base (306)..(306): a, c, t, g, unknown or other
  misc_feature (306)..(306): n is a, c, g, or t
  modified_base (394)..(394): a, c, t, g, unknown or other
  misc_feature (394)..(394): n is a, c, g, or t
tcagactgtacagtcacgaccggtgctcgatttagtgctatagacttgggtttgggggcaggagtcagacccactcaggacacagcatggacatgagggtcccccgctcagctcctggggcttctgctgctctggctcccaggtgccaaatgtgccatccagttgacccagtctccatcctccctgtctgcctctgttcgagacatagtcaccatcacgttgtcgggctaggtcgggtctagttggctagtgtctttagcctggtatcagacaagaacgagggaanctactagctctgattcttgntcgtcctcgtagttaggaaagtgactcctatacgaagtcgagcgacgtagtggtatcgtaggacgtagtacttacactcctacacctntcagcacgtcacgtcacgactagaacttacgttcacgttactaactttagttactagttaacctaaaagttaactttaacggtaccttacctcttaccgtttccggtacgggacgggaaacgtaacggtaggtacgtaacgtacgaaccgtaaaacgtcgttcggtacgacgtcgaactacgttac

SEQ ID NO: 309439 - DNA, 741 bp, Homo sapiens
  misc_feature: GZ8MTXP02FUOTN.25.86.H09.1.454.CMB.2.raw
  modified_base (257)..(257): a, c, t, g, unknown or other
  misc_feature (257)..(257): n is a, c, g, or t
tcagactgtacagtcacgaccggtgctcgatttagtgctatagacttgggtttgggggagtcagacccactcaggacacagcatggacatgagggtccccgctcagctcctggggcttctgctgctctggctcccaggtgccaaatgtgccatccagttgacccagtctccatcctccctgtctgcctctgttcgagacatagtcaccatcacttgtcgggctaggtcgggtcagttggcagtgctttagctggtancagcaagaaaccgaggggaacgcctaccgtaagcctcctgtacttcttgatcgcctacgtaggtttaggaaaggtcggtacgtcctagtacgtaacggttcgagcggacgaggtggatcgtagggactagtacttcctactccctccactactccgaagccgacggtccctgaccgtacgtccgtaaggtaaacgtcttacccggtacgtaaaccctttaaacctttaaagttttaagtttaccgttaaaaccctaaaaacgttttaaaacggttttaaaccgggttaaccccttttaaaccccctttccgtttaccccgggtttaccccgggttacccgggggtaaacgggggtacccgggggttaaaaccggtaacgggggtaaggtaaaaccggtaacgttaaaacccggaaaacggtaacgttccgggggtaccggtaccttaacgggaccctaaaacccgtttactaccggttttaccg

SEQ ID NO: 309440 - DNA, 532 bp, Homo sapiens
  misc_feature: GZ8MTXP02J3IPS.25.86.H09.1.454.CMB.2.raw
  modified_base (281)..(281): a, c, t, g, unknown or other
  misc_feature (281)..(281): n is a, c, g, or t
  modified_base (374)..(374): a, c, t, g, unknown or other
  misc_feature (374)..(374): n is a, c, g, or t
  modified_base (404)..(404): a, c, t, g, unknown or other
  misc_feature (404)..(404): n is a, c, g, or t
  modified_base (410)..(410): a, c, t, g, unknown or other
  misc_feature (410)..(410): n is a, c, g, or t
tcagactgtacagtcacgaccggtgctcgatttagtgctatagacttggggtttgggggagtcagacccactcaggacacagcatggacatgagggtccccgctcagctcctggggcttctgctgctctggctcccaggtgccaaatgtgtcatccagttgacccagtcctccatccctcctgtctgcctctgttcgagacatagtcaccatcacttgtcgggctaggtcgggtcattggctagtgctttagcctggtatcagcaagaaaccgaggggaanctacctaagctcctgatcttgatcgcctcagtttgaagtggactccatcgaagtcaggcggcagtcggatcgagggacagtatttcacttccnaccatcagcagcctgcaagcctaggaactntcctanactaacttattagtactaactaattaacgtttaacgtaccttacctctaccgtcggtcgggtacggacgggacgacggtagaacacaacgtaaacgacgtggcgacacgaccactactctcg

SEQ ID NO: 309441 - DNA, 567 bp, Homo sapiens
  misc_feature: GZ8MTXP02F9QT8.25.86.H09.1.454.CMB.2.raw
  modified_base (275)..(275): a, c, t, g, unknown or other
  misc_feature (275)..(275): n is a, c, g, or t
  modified_base (369)..(369): a, c, t, g, unknown or other
  misc_feature (369)..(369): n is a, c, g, or t
  modified_base (396)..(396): a, c, t, g, unknown or other
  misc_feature (396)..(396): n is a, c, g, or t
tcagactgtacagtcacgaccggtgctcgatttagtgctatagacttgggtttgggggagtcagacccactcaggacacagcatggacatgagggtccccgctcagctcctggggcttctgctgctctggctcccaggtgccaaatgtgccatccagttgacccagtctccatcctccctgtctgcctctgttcgagacatagtcaccatcacttgtcgggctagtcgggtcattggcagtgctttagcctggtatcagcagaaaccaggggaanctctaagctcctgatcttgatgcctcagttggaagtggagtccatcaacggttcagcggcaggtggatcgtgggacagtatttcatcctcaccntcagcagctgcagcctgaaagattcgnacaaccttattattagtactaaactaatttaaggactttaccctcttccgtccgttacggggaccggtaacggggtaaccgtaaaggggttacgggaacgaacgttaaccgaaaacgtaaccgtaagggttacggtaccgttacggaccgtaaacctcgttaccgtttccg

SEQ ID NO: 309442 - DNA, 445 bp, Homo sapiens
  misc_feature: GZ8MTXP02GK1AM.25.86.H09.1.454.CMB.2.raw
  modified_base (406)..(406): a, c, t, g, unknown or other
  misc_feature (406)..(406): n is a, c, g, or t
  modified_base (430)..(430): a, c, t, g, unknown or other
  misc_feature (430)..(430): n is a, c, g, or t
  modified_base (434)..(445): a, c, t, g, unknown or other
  misc_feature (434)..(445): n is a, c, g, or t
tcagactgtacagtcacgaccggtgctcgatttagtgctatagacttgggtttgggagaagaacctactatgcagactctgtgaagggtcgattcaccacctccagagacaacatcaagaactccctgtatctgcaaatggacagtctgacacctgatgacaccgccttgtattattgtgtgaaaggcggtgttgaggtgaatgcctggaacccccgcggtcagcactacttctacatgggcgtcgtggggcaaagggactacggtcatcgtctcctcacgccctccaccaacgggccccagtccggtccttcccccgtggccgtccctgcctccgaggcgccaccgtcgagagcacacggccgcctgggctcgccttggcaacgactacttccactgtacagtcngacggcgggctggcaagggtccanatgnnnnnnnnnnnn

SEQ ID NO: 309443 - DNA, 567 bp, Homo sapiens
  misc_feature: GZ8MTXP02HH5IU.25.86.H09.1.454.CMB.2.raw
  modified_base (187)..(187): a, c, t, g, unknown or other
  misc_feature (187)..(187): n is a, c, g, or t
  modified_base (215)..(215): a, c, t, g, unknown or other
  misc_feature (215)..(215): n is a, c, g, or t
  modified_base (533)..(567): a, c, t, g, unknown or other
  misc_feature (533)..(567): n is a, c, g, or t
tcagactgtacagtcacgaccggtgctcgatttagtgctatagacttgggtttgggagaagaacctactatgcagactctgtgaagggtcgattcaccacctccagagacaacatcaagaacctccctgtatctgcaaatggacagtctgacacctgatgacaccgcttgtattatgtgtgaaaggngtgtgaggtgaatgcctcggaaccccgnggtcagcatacttctacatgggcgtcgtggggacaaaggggctaacggtcatcgtctcctcacgccctaccgaaccaaagggtcccccaagttccgggtcccttttccccccccggtcggccccgtcccgtacgcccgtaccggaaggaccgaccgtaacccgtaccggaaacgaaaccgaccggacggtcccccgggcccggtcggtccgtcggtccggtacggtaacgtaaccgttaccttaaccttaccgtacgttacgtaacgtacgttacgaggacgggtcggtacgtaggacggaacgacgacgaacgtagnnnnnnnnnnnnnnnnnnnnnnnnnnnnnnnnnnn

SEQ ID NO: 309444 - DNA, 655 bp, Homo sapiens
  misc_feature: GZ8MTXP02JMUYJ.25.86.H09.1.454.CMB.2.raw
  modified_base (317)..(317): a, c, t, g, unknown or other
  misc_feature (317)..(317): n is a, c, g, or t
  modified_base (646)..(646): a, c, t, g, unknown or other
  misc_feature (646)..(646): n is a, c, g, or t
tcagactgtacagtcacgaccggtgctcgatttagtgctatagacttgggtttggggagctctgggaaaggagccccagccctgagattcccaggtgattccattcggtgatcagcactgaacacagaactcaccatggagtttggactgagctgggttttccttgttgcctaattttaaaaggtgtccagtgtgaagtgcaactggtggagtcgtgggggagccggtggtacgagggccggggggtcctggacgactctcctgtgtacgcctctggattcattgtttgatgattatcgccatgcacgtggggtccncgaaggtccggggaaggtcgtggaggtggtctcgtcttagtgacgttgggatcggggagaacgaacctatagtgctagtctcgtggtgaaggggtcactttccaacccgcctacccgaagacgaacaacactaccaaacggtaaaccctcccgtagtaacttctacggaactaaagtcgggactaggttaccgagacccgtacgttagacgtaccgaaccgtaccgtccgttttaggttactttagttcggtaggggtaacggtaaagggtcggggttagtaggtaaggtcgtaacgtcggtacccccggtaccgggtaaacccccggngttaacccg

SEQ ID NO: 309445 - DNA, 512 bp, Homo sapiens
  misc_feature: GZ8MTXP02FH0ZH.25.86.H09.1.454.CMB.2.raw
  modified_base (345)..(345): a, c, t, g, unknown or other
  misc_feature (345)..(345): n is a, c, g, or t
tcagactgtacagtcacgaccggtgctcgatttagtgctatagacttgggtttgggggcaggagtcagacccactcaggacacagcatggacatgagggtccccgctcagctcctggggcttctgctgctctggctcccaggtgccaaatgtgccatccagttgacccagtctccatcctccctgtctgcctctgttcgagacatagtcaccatcacttgtcgggctagtcgggtcattggcagtgctttagcctggtatcagcagaaaccaggggaagctcctaagctcctgatctttgatgccctccaggtttggaaagtggagtcccatcaaggtcagcggnagtggatcgtgggacagtatttcatcctcaccatcagcagcctgcagcctagaagtattctgactaaccttattattgtacaactaatttaaggacttaccctctactccgttcggcggacgggaccaagggtcgacgatacaaaacgactggtggctagacactac

SEQ ID NO: 309446 - DNA, 573 bp, Homo sapiens
  misc_feature: GZ8MTXP02HLIP0.25.86.H09.1.454.CMB.2.raw
  modified_base (280)..(280): a, c, t, g, unknown or other
  misc_feature (280)..(280): n is a, c, g, or t
tcagactgtacagtcacgaccggtgctcgatttagtgctatagacttgggtttgggggagtcagacccactcaggacacagcatggacatgagggtccccgctcagctcctggggcttctgctgctctggctcccaggtgccaaatgtgccatccagttgacccagtctccatcctccctgtctgcctctgttcgagacatagtcaccatcacttggtcgggctaggtcgggtcagttggcagtgtctttagcctggtatcagcaagaaaccgagggganctactaagctcctgattcttgactcgtcctcgtaggtttaggaaagtggacgtacccagttacgaacggttcaggcggactaggtggatcgtagggactagtactttcactcctacacatcagcacgcctgcagcctagactattcgtacactaaactttatttacttgtaactaaacttaagtttaacgtaccttacccttcttaccgtccgttacgggacggtaacgggacgaaggggtaggaactacgtaaacaacgtacgtggtcggtactcgactacctattcgttcc

SEQ ID NO: 309447 - DNA, 564 bp, Homo sapiens
  misc_feature: GZ8MTXP02IWDV5.25.86.H09.1.454.CMB.2.raw
  modified_base (371)..(371): a, c, t, g, unknown or other
  misc_feature (371)..(371): n is a, c, g, or t
  modified_base (400)..(400): a, c, t, g, unknown or other
  misc_feature (400)..(400): n is a, c, g, or t
  modified_base (407)..(407): a, c, t, g, unknown or other
  misc_feature (407)..(407): n is a, c, g, or t
tcagactgtacagtcacgaccggtgctcgatttagtgctatagacttgggtttgggggagtcagacccactcaggacacagcatggacatgagggtccccgctcagctcctggggcttctgctgctctggctcccaggtgccaaatgtgccatccagttgacccagtctccatcctccctgtctgcctctgttcgagacatagtcaccatcacttgcgggctagtcgggtcattggcagtgctttagcctggtatcagcagaaaccaggggaagctcctaagctcctgatcttgatgcctcaccgtttgaagtgagtcccatcaaggttcagcggcaggtggatcgtgggactagtattcatcctacaccntccagcgagccctagccagcctagaagtnttacgtnacctaaccttattacttgtaccaaactaaagtttaaacggtacttaaccctcgttacctccgttacggggacggaacgggtaccgtaaacggggtgaacgtaacttaccgaaaacgtacgttcggtagggacctacggtaccaccctaattccttcg

SEQ ID NO: 309448 - DNA, 727 bp, Homo sapiens
  misc_feature: GZ8MTXP02FX5UN.25.86.H09.1.454.CMB.2.raw
  modified_base (319)..(319): a, c, t, g, unknown or other
  misc_feature (319)..(319): n is a, c, g, or t
  modified_base (340)..(340): a, c, t, g, unknown or other
  misc_feature (340)..(340): n is a, c, g, or t
  modified_base (355)..(355): a, c, t, g, unknown or other
  misc_feature (355)..(355): n is a, c, g, or t
tcagactgtacagtcacgaccggtgctcgatttagtgctatagacttgggtttggggagctctgggaaaggagccccagccctgagattcccaggtgattccattcggtgatcagcactgaacacagaactcaccatggagtttggactgagctgggttttccttgttgcctattttaaaaggtgtccagtgtgaagtgcaacgtggtggagtcgtgggggagccggtggtacgacgggccgggggggtccctggacgacctctccgtgtgtagcctcgtggattcattgttgatgattatgccatgcacgtgggtccngaaggtccggggaggtctggngtggtctctcttagngtcgttaggggagtgggaagtaacgaacctactaagtgactagtactcgtggtacggtaacggggttctacttcccaaccctacccttaccgaagaacgaaccgaaactaaacgttaacccaaaacggtaacccttccccgttaagtacgttacctacgtaaacgtaaacgttagggaccttaacggttaccgttacggaacccgttactacggttaacgaccgtaacccgtacccgtacccgtttacggtttaaatttaagtttcgggtaaagttacggggttaaaacggggttccgggtaggttttaggaacgggttaggtaaacgttccgggtacccggttaaccgggaaccccccggtgggtaacccg

SEQ ID NO: 309449 - DNA, 549 bp, Homo sapiens
  misc_feature: GZ8MTXP02FFF1F.25.86.H09.1.454.CMB.2.raw
tcagactgtacagtcacgaccggtgctcgatttagtgctatagacttgggtttggggagctctgggaaaggagccccagccctgagattcccaggtgattccattcggtgatcagcactgaacacagaactcaccatggagtttggactgagctgggttttccttgttgccattttaaaaggtgtccagtgtgaagtgcaactggtggagtctgggggagccgtggtacaggccggggggtccctgagactctcctgtgtagcctctggattcatgttgatgattatgccatgcactgggtccgtcgaaggtccgggggaaggtcgtggaggttgggtctctctttatgacttggggatggggagaagaacctactatgcagactctgtgaaggtcgattcaccacctccagagacaaacatacaaagtaaacctccctagtactacgtacgacaaatggaacaggtctgacactgatgacacgctagtattattgtgtagaaaggtcggtgttgaaggtgaatcgcctcggaacccccgtcggtaccg

SEQ ID NO: 309450 - DNA, 646 bp, Homo sapiens
  misc_feature: GZ8MTXP02JHXZ7.25.86.H09.1.454.CMB.2.raw
  modified_base (257)..(257): a, c, t, g, unknown or other
  misc_feature (257)..(257): n is a, c, g, or t
  modified_base (275)..(275): a, c, t, g, unknown or other
  misc_feature (275)..(275): n is a, c, g, or t
  modified_base (295)..(295): a, c, t, g, unknown or other
  misc_feature (295)..(295): n is a, c, g, or t
  modified_base (367)..(367): a, c, t, g, unknown or other
  misc_feature (367)..(367): n is a, c, g, or t
  modified_base (401)..(401): a, c, t, g, unknown or other
  misc_feature (401)..(401): n is a, c, g, or t
  modified_base (407)..(407): a, c, t, g, unknown or other
  misc_feature (407)..(407): n is a, c, g, or t
tcagactgtacagtcacgaccggtgctcgatttagtgctatagacttgggtttgggggagtcagacccactcaggacacagcatggacatgagggtccccgctcagctcctggggcttctgctgctctggctcccaggtgccaaatgtgccatccagttgacccagtctccatcctccctgtctgcctctgttcgagacatagtcaccatcacttgtcgggctagtcgggtcattggcagtgctttagcctggtatnagcaagaaccaggggaanctcctaagctcctgatcttnatgcctcagtttggaagtggatccatcaaggtcagcgcagtgatcgtagggacagtatttcatcctcaaccntcagcaggccctagcgacgtaccctagaaacgtntttacncgtaacctaacctttatttacgttacgttaacctaaaacgtttaaaacgttttaacggtaaccttttaacccccgttccgttacccgttaccccggtttacggggaccggggttaaacggggaaaccccggtaaaagggggtacggtaaacggtaaaccgttaaacccgtaaaaccggttaccggtaaggttccggtaccgttacggacccctaaccgtaactttccggttttaacccg

SEQ ID NO: 309451 - DNA, 635 bp, Homo sapiens
  misc_feature: GZ8MTXP02GHIKO.25.86.H09.1.454.CMB.2.raw
  modified_base (280)..(280): a, c, t, g, unknown or other
  misc_feature (280)..(280): n is a, c, g, or t
tcagactgtacagtcacgaccggtgctcgatttagtgctatagacttgggtttgggggagtcagacccactcaggacacagcatggacatgagggtccccgctcagctcctggggcttctgctgctctggctcccaggtgccaaatgtgccatccagttgacccagtctccatcctccctgtctgcctctgttcgagacatagtcaccatcacttgtcgggctagtcgggtcattggcagtgctttagcctggtatcgagacaagaaaccgaggggaacncgtacctaagcctcctgtattctttgatcgtccttccgtaggttttaggaaaggttcgggacgtccccaattacgtaaacggtttcgaggcgggactaggtacggtagtccggtaggggaactaggttactttacaacttccctaccaacctatacagccaagccctacgcgacgccgttaggaatacttctacgtaacctaacctttaattattacgtaactaaaacgttaaacgtttaaacgtacctttaaccctcttccgttaccgttcgggaaccggtacgggaccgtaaagggtacggaagtacgtaacgaaaacgtaacgtggtacgcgtacaccgacctagtacttcg

SEQ ID NO: 309452 - DNA, 605 bp, Homo sapiens
  misc_feature: GZ8MTXP02JSDUH.25.86.H09.1.454.CMB.2.raw
  modified_base (482)..(482): a, c, t, g, unknown or other
  misc_feature (482)..(482): n is a, c, g, or t
tcagactgtacagtcacgaccggtgctcgatttagtgctatagacttgggtttggggagctctgggaaaggagccccagccctgagattcccaggtgattccattcggtgatcagcactgaacacagaactcaccatggagtttggactgagctgggttttccttgttgccattttaaaaggtgtccagtgtgaagtgcaactggtggagtcgtgggggagccgtggtacaggccggggggtccctgagactctcctgtgtagcctctggattcatgttgatgattatgccatgcacgtgggtcccgtcgaagggtccgggggaaggtcgtgggaggttggggtctcttcttatgtacgttggggatcggggagaagaacctatatgcagactctgtagaagggtcgattccaccaccctccgagacgaacaacatacaaagtaacctccctagtactcctgaacaaagtggactagttacngacacctgactggacctaccgtcctttagtatttagttcggtaggttaggtaaacggggtcgggttagtttaggaaggttagaaccgttcggacccgttaccggggaacccccgtcggtaccg

SEQ ID NO: 309453 - DNA, 603 bp, Homo sapiens
  misc_feature: GZ8MTXP02IAGR3.25.86.H09.1.454.CMB.2.raw
  modified_base (277)..(277): a, c, t, g, unknown or other
  misc_feature (277)..(277): n is a, c, g, or t
  modified_base (380)..(380): a, c, t, g, unknown or other
  misc_feature (380)..(380): n is a, c, g, or t
tcagactgtacagtcacgaccggtgctcgatttagtgctatagacttgggtttgggggagtcagacccactcaggacacagcatggacatgagggtccccgctcagctcctggggcttctgctgctctggctcccaggtgccaaatgtgccatccagttgacccagtctccatcctcctgtctgcctctgttcgagacatagtcaccatcacttgtcgggctaggtcgggtcattggcagtgtctttagcctggtatcagcagaaaccgaggggaanctacctaagctcctgatcttgatgcctctaggttaggaagtgacgtcccatcaggtcagcgcgagtggatcgagggactagtactttcactcctacaccctanacgacgcacgcctagacacgtacgtagtactctacgtactactaactttattactacgtaaactaaacttaaagttaccgtaccttacccttacgtaccgttaccgggtacgggaacggggtaacggtaacggtaaacgggtacggaaacgtaaccgtaaacgtaaacggtacgttaacggtccggtaccgtacggtaaccctaccgttacgtttaccgttcg

SEQ ID NO: 309454 - DNA, 504 bp, Homo sapiens
  misc_feature: GZ8MTXP02I3XP4.25.86.H09.1.454.CMB.2.raw
  modified_base (298)..(298): a, c, t, g, unknown or other
  misc_feature (298)..(298): n is a, c, g, or t
  modified_base (389)..(389): a, c, t, g, unknown or other
  misc_feature (389)..(389): n is a, c, g, or t
  modified_base (391)..(392): a, c, t, g, unknown or other
  misc_feature (391)..(392): n is a, c, g, or t
  modified_base (396)..(396): a, c, t, g, unknown or other
  misc_feature (396)..(396): n is a, c, g, or t
  modified_base (398)..(398): a, c, t, g, unknown or other
  misc_feature (398)..(398): n is a, c, g, or t
  modified_base (481)..(481): a, c, t, g, unknown or other
  misc_feature (481)..(481): n is a, c, g, or t
  modified_base (496)..(496): a, c, t, g, unknown or other
  misc_feature (496)..(496): n is a, c, g, or t
  modified_base (499)..(499): a, c, t, g, unknown or other
  misc_feature (499)..(499): n is a, c, g, or t
tcagactgtacagtcacgaccggtgctcgatttagtgctatagacttgggtttgggggagtcagacccactcaggacacagcatggacatgagggtccccgctcagctcctggggcttctgctgctctggctcccaggtgccaaatgtgccatccagttgacccagtctccatcctccctgtctgcatctgttggagacagaatcagcatcacttgccgggcgagtcagggcattagctaattattagcctggtactacaacaagaaaccgagggagtacgttacctaagctccgtanatctatgctcgcctaccacgttaccactcgacgggtccagtcgtcggttcagcgcagtggtatcgtgggacagtacgttcactctcatacnanncgcncncacgacagagatgtatatacttattatataataataataactactctacctctactacgtcggacggacggacgacgagaganaacgaacgacgacgngcncacac

SEQ ID NO: 309455 - DNA, 491 bp, Homo sapiens
  misc_feature: GZ8MTXP02HSBOK.25.86.H09.1.454.CMB.2.raw
  modified_base (431)..(431): a, c, t, g, unknown or other
  misc_feature (431)..(431): n is a, c, g, or t
  modified_base (476)..(491): a, c, t, g, unknown or other
  misc_feature (476)..(491): n is a, c, g, or t
tcagactgtacagtcacgaccggtgctcgatttagtgctatagacttgggtttgggagaagaacctactatgcagactctgtgaagggtcgattcaccacctccagagacaacatcaagaactccctgtatctgcaaatggacagtctgacacctgatgacaccgccttgtattattgtgtgaaaggcggtgttgaggtgaatgcctcggaaccccgcggtcagcactacttctacagtgggcgtcgtggggacaaagggactacggtcatcgtctcctcacgccctaccaccgaaacgggccccagttcccggtccctttccccccgtggccgcccctcggcctccgaggacgccacctccgagacgcacgaccgccggcccgtgggctcgcccgttggtccgaaaggactaccttcctactcgtaaccnggttctaggacggcggggctgggacgtaaagggccgaacagtagnnnnnnnnnnnnnnnn

SEQ ID NO: 309456 - DNA, 588 bp, Homo sapiens
  misc_feature: GZ8MTXP02JDDVH.25.86.H09.1.454.CMB.2.raw
  modified_base (381)..(381): a, c, t, g, unknown or other
  misc_feature (381)..(381): n is a, c, g, or t
  modified_base (389)..(389): a, c, t, g, unknown or other
  misc_feature (389)..(389): n is a, c, g, or t
tcagactgtacagtcacgaccggtgctcgatttagtgctatagacttgggtttgggggcaggagtcagacccactcaggacacagcatggacatgagggtccccgctcagctcctggggcttctgctgctctggctcccaggtgccaaatgtgccatccagttgacccagtctccatcctccctgtctgcctctgttcgagacatagtcaccatcacttgtcgggctaggtcgggtcagttggcagtgctttagcctggtatcagcaagaaaccgaggggaacgctcctaagctcctgattcttgatgccctctaggtttggaaagtggacgtccatcgaaggttcagcggcagtggatcgtgggacagtatttcatcccnaccatcancacgcctgcagcctagaaacgtcttcgtacgacctaaacctttatttaacgttcgtaaacctaaaacgttaaagttttaaacggacctttaacccgtccttccgttacccggtttacggggaaccgggtaacgggaaccgtaaaggggtgaaacgtactaaccgaaaacgacgttggacggtactacggacctactacg

SEQ ID NO: 309457 - DNA, 574 bp, Homo sapiens
  misc_feature: GZ8MTXP02H190Y.25.86.H09.1.454.CMB.2.raw
  modified_base (213)..(213): a, c, t, g, unknown or other
  misc_feature (213)..(213): n is a, c, g, or t
  modified_base (292)..(292): a, c, t, g, unknown or other
  misc_feature (292)..(292): n is a, c, g, or t
  modified_base (543)..(543): a, c, t, g, unknown or other
  misc_feature (543)..(543): n is a, c, g, or t
tcagactgtacagtcacgaccggtgctcgatttagtgctatagacttgggtttgggggcaggagtcagacccactcaggacacagcatggacatgagggtccccgctcagctcctggggcttctgctgctctggctcccaggtgccaaatgtgccatccagttcgacccagtcctccatcctcctgtctgcctctgttcgagacatagtcacntcacgttgtcgggctaggtcgggtcagttggctagtgtctttacgcctggtactcgagacaaggaaaccggaggggacncctacctaagccttacctgagttctttgattcgccgtacgttaggttaggaaagtcggactccagtacgtaaggtcaaggtcggacaggtggaacttcggtaggtacacgttacttcaaccgttcccacgactagccagactacgcctagacgacgtctagagtacttcgagtactaaactattactagtaactaacttaagttacgacttacgtctacgtcgtacggcggacgtaacgagtacgacgtanaacgtaagacgttcggacgacgtcactacag

SEQ ID NO: 309458 - DNA, 672 bp, Homo sapiens
  misc_feature: GZ8MTXP02FS38P.25.86.H09.1.454.CMB.2.raw
tcagactgtacagtcacgaccggtgctcgatttagtgctatagacttggggtttggggagctctgggaaaggagccccagccctgagattcccaggtgattccattcggtgatcagcactgaacacagaactcaccatggagtttggactgagctgggttttccttgttgcctattttaaaaggtgtccagtgtgaagtgcaacgtggtggagtcgtgggggagccggtggtacgagggccggggggtcctgagactctcctgtgtacgcctcgtgattcattgttgatgtattatgcctatgctacgtggggtccgtacggaacggggtaccgggggaagggtcgtagggtaggtcggggttcttctcgtttagtgtaacgtttggggagttacggggaagaaacgtaaacgtactagtgacgagtactcgttaggtagtaacggggttcattcccaaccctacccgtcccaaaggaacgaacaaactacaccaaaactaaacccttccctaagtaactccttagaacaaagtaggaactacggttcacgaactaccgtagacacgacctaacccggtctttagttatttattaggtacggttaggaaacgggtcggtggtaggtaagggtacgtaaagtccgaccgtacgggaacccccgtggtaacccg

SEQ ID NO: 309459 - DNA, 435 bp, Homo sapiens
  misc_feature: GZ8MTXP02JLMMX.25.86.H09.1.454.CMB.2.raw
  modified_base (218)..(218): a, c, t, g, unknown or other
  misc_feature (218)..(218): n is a, c, g, or t
  modified_base (411)..(411): a, c, t, g, unknown or other
  misc_feature (411)..(411): n is a, c, g, or t
  modified_base (414)..(435): a, c, t, g, unknown or other
  misc_feature (414)..(435): n is a, c, g, or t
tcagactgtacagtcacgaccggtgctcgatttagtgctatagacttgggtttgggagaagaacctactatgcagactctgtgaagggtcgattcaccacctccagagacaacatcaagaactccctgtatctgcaaatggacagtctgacacctgatgacaccgccttgtattattgtgtgaaaggcggtgttgaggtgaatgcctggaacccccgnggtcagcactacttctacatgggcgtcgtggggcaaaggggactacggtcatcgtctcctcagcctccaccaagggcccatcggtctcccccgtggccgcctgctccgaggacgcacctccgagagcacacgcgcccgtggctgcctggtcaaggctacttccactgacagtctgagcgggctggcagccganagnnnnnnnnnnnnnnnnnnnnnn

SEQ ID NO: 309460 - DNA, 520 bp, Homo sapiens
  misc_feature: GZ8MTXP02GAE95.25.86.H09.1.454.CMB.2.raw
  modified_base (396)..(396): a, c, t, g, unknown or other
  misc_feature (396)..(396): n is a, c, g, or t
tcagactgtacagtcacgaccggtgctcgatttagtgctatagacttgggtttgggggagtcagacccactcaggacacagcatggacatgagggtccccgctcagctcctggggcttctgctgctctggctcccaggtgccaaatgtgccatccagttgacccagtctccatcctccctgtctgcctctgttcgagacatagtcaccatcacttgtcgggctagtcgggtcattggcagtgctttagcctggtatcagcagaaaccaggggaagctcctaagctcctgatctttgatgcctcagtttggaaagtggagtccatcaaggttcagcggcagtggatctgggacagatttcatcctcaccatcagcagccctgcagcctgaagattcngacctaaccttattattgtctaaaactaatttaaacggatttaacccctctctaccttcgggaccggagggtaccaaggggtgaagactacaaaacggactggtacggctgcaccaactcttag

SEQ ID NO: 309461 - DNA, 624 bp, Homo sapiens
  misc_feature: GZ8MTXP02HZFB0.25.86.H09.1.454.CMB.2.raw
  modified_base (277)..(277): a, c, t, g, unknown or other
  misc_feature (277)..(277): n is a, c, g, or t
  modified_base (395)..(395): a, c, t, g, unknown or other
  misc_feature (395)..(395): n is a, c, g, or t
tcagactgtacagtcacgaccggtgctcgatttagtgctatagacttgggtttgggggagtcagacccactcaggacacagcatggacatgagggtccccgctcagctcctggggcttctgctgctctggctcccaggtgccaaatgtgccatccagttgacccagtctccatcctcctgtctgctctgttcgagacatagtcaccatcacttgtcgggctaggtcgggtcagttggcagtgtctttaggcctggtatcagcagaaaccgagggganctacctaagctcctgactctttagatgccttctagtttggaaagtggagtcccataccgaaggttcaggcggcgtagtcgggatcgtagggactagtatttcactcctaccactaacncgacgctacgccgtcgacgacgtacgtacgtacgtacgtacgtacgtaaccttaacttaatttaacgttaacgtaactaaacgttaaacgttaaacgttaaccttaccttaccgttaccgttaccggttaccggtaccgggtaacgggaaccggtaaacggtacggtaacgtaacgtaaacgtaaacgtaacgtaacggtacggtacgtacgactacctacgtacgtcg

SEQ ID NO: 309462 - DNA, 626 bp, Homo sapiens
  misc_feature: GZ8MTXP02HYLNG.25.86.H09.1.454.CMB.2.raw
  modified_base (245)..(245): a, c, t, g, unknown or other
  misc_feature (245)..(245): n is a, c, g, or t
  modified_base (260)..(260): a, c, t, g, unknown or other
  misc_feature (260)..(260): n is a, c, g, or t
  modified_base (282)..(282): a, c, t, g, unknown or other
  misc_feature (282)..(282): n is a, c, g, or t
  modified_base (377)..(377): a, c, t, g, unknown or other
  misc_feature (377)..(377): n is a, c, g, or t
tcagactgtacagtcacgaccggtgctcgatttagtgctatagacttgggtttgggggagtcagacccactcaggacacagcatggacatgagggtccccgctcagctcctggggcttctgctgctctggctcccaggtgccaaatgtgccatccagttgacccagtctccactcctccctgtcctgcctctgttcgagacatagtcaccatcacttgtcgggctaggtcgggtcattggcagtntctttagcctggtancagcaagaaaccgaggggaacnctacaagctcctgtattcttgactcgtccttacgtaggtttaggaaagtcggactacccatacggtaacggttcacggcggctaggtggatcggngggtactagtactttcactcctacactatcgagcacgctgcagctagatctacgtctaactaactttatacttacgtaactaaacgttaaactttaacggttaccttaaccccgttcttaccgtacccggtttaccgggacgggtaaccggggtaaaccgtaacggggtaggaaacgtaccgttaaaccgaaaacgttaccggttggtacggtaccttaccggaacctacccgttatttaccggttccg

SEQ ID NO: 309463 - DNA, 527 bp, Homo sapiens
  misc_feature: GZ8MTXP02FF93K.25.86.H09.1.454.CMB.2.raw
  modified_base (326)..(326): a, c, t, g, unknown or other
  misc_feature (326)..(326): n is a, c, g, or t
  modified_base (499)..(527): a, c, t, g, unknown or other
  misc_feature (499)..(527): n is a, c, g, or t
tcagactgtacagtcacgaccggtgctcgatttagtgctatagacttgggtttgggagaagaacctactatgcagactctgtgaagggtcgattcaccacctccagagacaacatcaagaacctccctgtatctgcaaatggacagtctgacacctgatgacaccgccttgtattattgtgtgaaaggcggtgttgaggtgaatgcctcggaacccccgcggtcagcactacttctacatgggcgtcgtggggacaaaggggctacggtcatccgtctcctcacgccctcccaaccgaacgggccccagtccggtccttcccccgnggcccgccctgcctcccgaaggacgtccacccgtccggagacgccacgaccggcccggtccccgtggggcctcggcccgttgggtccaaacgggtaccttactttcccaacttgtaaccagtttcccaggacggccgggggactcgggaccgaaagggcccgtaacaagtagnnnnnnnnnnnnnnnnnnnnnnnnnnnnn

SEQ ID NO: 309464 - DNA, 768 bp, Homo sapiens
  misc_feature: GZ8MTXP02H0MWC.25.86.H09.1.454.CMB.2.raw
tcagactgtacagtcacgaccggtgctcgatttagtgctatagacttgggtttggggagctctgggaaaggagcccccagccctgagattcccaggtgattccattcggtgatcagcactgaacacagaactcaccatggagtttggactgagctgggttttccttgttgccattttaaaaggtgtccagtgtgaagtgcaactggtggagtcgtgggggagccgtggtacgaggccggggggtccctgagactctcctgtgtagcctctggtattcattgtttgatgattatgccatgccacgtcggggtccgtacggaacggggtccgggggaaagggtcgtggggtaggttcggggtcttcgttcgtttagtggtacgttggggagttaggggaagtaaacgtaaccgtacgttagtggaccaggtaaccttccgttaggggtacgggtaaacgggggttccgtaaacttttacccgaaacccctacccgttacccgaaggaacgaaacccgaaaactaatacccgaaaacgtaaccctaccccgttagtaaccttacgttacggaaacctaaaagttcgggaacctacgggttacctacggaaccctaccgtaggtaacttaccggaaaccgtaccccggtctttaacggttattttaaggttcggtaggttaagggtaaacggggtcggtttaggtagggaaaccggggttgtaaaacggtccggtacccggttacccggggaaccccccggtagggtacccg

SEQ ID NO: 309465 - DNA, 601 bp, Homo sapiens
  misc_feature: GZ8MTXP02FX6HN.25.86.H09.1.454.CMB.2.raw
  modified_base (280)..(280): a, c, t, g, unknown or other
  misc_feature (280)..(280): n is a, c, g, or t
  modified_base (355)..(355): a, c, t, g, unknown or other
  misc_feature (355)..(355): n is a, c, g, or t
  modified_base (375)..(375): a, c, t, g, unknown or other
  misc_feature (375)..(375): n is a, c, g, or t
  modified_base (379)..(379): a, c, t, g, unknown or other
  misc_feature (379)..(379): n is a, c, g, or t
tcagactgtacagtcacgaccggtgctcgatttagtgctatagacttgggtttgggggcaggagtcagacccactcaggacacagcatggacatgagggtccccgctcagctcctggggcttctgctgctctggctcccaggtgccaaatgtgccatccagttgacccagtctccatcctccctgtctgcctctgttcgagacatagtcaccatcacttgtcgggctaggtcgggtcattggcagtgctttagcctggtatcagcagaaaccaggggaanctctaagctcctgattctttgatcgccctcctaggtttaggaaagtgagtccatcaaggtcagcgcagtgatcgngggacagtatttcatccctnaccntcagcagccctgcacgacccgtagaaacggtacttcgtacgacctaaaccctttaatttacgttacgtaactaaaacttaaacgtttaaacggtacctttaacccctcttaccgttacccggttcggggaccgggtaacggggtaacccgtaaaggggttcggaaacggtacgttaaacgaaaacggtacgtaggtcggggaccttcggaccaccgttaacg

SEQ ID NO: 309466 - DNA, 580 bp, Homo sapiens
  misc_feature: GZ8MTXP02J0SF0.25.86.H09.1.454.CMB.2.raw
  modified_base (282)..(282): a, c, t, g, unknown or other
  misc_feature (282)..(282): n is a, c, g, or t
tcagactgtacagtcacgaccggtgctcgatttagtgctatagacttggggtttgggggcaggagtcagacccactcaggacacagcatggacatgagggtccccgctcagctcctggggcttctgctgctctggctcccaggtgccaaatgtgccatccagttgacccagtctccatcctcctgtctgcctctgttcgagacatagtcaccatcacttggtcgggctagtcgggtcattggcagtgctttagcctggtatcagcaagaaaccgaggggaanctaccgtaagctcctgatctttgatcgcctcgtagttggaaacgtggacgtcccagtcaaggttcacggtcggactagggtggactcgtaggggactagtactttcactcctacacatcagcacgcctgactagacctagaacgtacttcgtacacctaaaccttatttattcgtaacaaacttaagtttaaacggactttaccctacttccgttccgttcgggacgggaacgggtaaaccgaaggtacggaacgtaacgtaacgaaaaccgaagtggtacggctacgacctactacg

SEQ ID NO: 309467 - DNA, 683 bp, Homo sapiens
  misc_feature: GZ8MTXP02HDVT9.25.86.H09.1.454.CMB.2.raw
  modified_base (282)..(282): a, c, t, g, unknown or other
  misc_feature (282)..(282): n is a, c, g, or t
  modified_base (359)..(359): a, c, t, g, unknown or other
  misc_feature (359)..(359): n is a, c, g, or t
  modified_base (555)..(555): a, c, t, g, unknown or other
  misc_feature (555)..(555): n is a, c, g, or t
tcagactgtacagtcacgaccggtgctcgatttagtgctatagacttggggtttgggggagtcagacccactcaggacacagcatggacatgagggtccccgctcagctcctggggcttctgctgctctggctcccaggtgccaaatgtgccatccagttgacccagtctccatcctccctgtctgcctctgttcgagacatagtcaccatcacttggtcgggctaggtcgggtcagttggcagtgtctttagcctggtatcagcaagaaaccgaggggaanctcctaagctcctgattcttgatcgcctcgtaggtttaggaaagtggacgtcccagtacgtaaggttcaggtccggngtaaggtgggacttcgggtaggggaactaggttacttttaccaactccccttaccaaccctagtccgaaggccaacggtcctacggaccacggtcccttaggaaacgtctttaccggtacgtaaccttaaacccgtttatttacggtttacgaaacctaaaaccgttaaagtttaacgggtactttaacccccgtnttacccgttccgttacgggggacggtacggggaaccctaggggttacgaacgaacgttaaccgtaaacgggtaacgttcgggttacgaccgttaccgggacctaaccccgtttacgtttaccgttacg

SEQ ID NO: 309468 - DNA, 566 bp, Homo sapiens
  misc_feature: GZ8MTXP02HK254.25.86.H09.1.454.CMB.2.raw
  modified_base (328)..(328): a, c, t, g, unknown or other
  misc_feature (328)..(328): n is a, c, g, or t
  modified_base (332)..(332): a, c, t, g, unknown or other
  misc_feature (332)..(332): n is a, c, g, or t
  modified_base (389)..(389): a, c, t, g, unknown or other
  misc_feature (389)..(389): n is a, c, g, or t
tcagactgtacagtcacgaccggtgctcgatttagtgctatagacttgggtttgggggagtcagacccactcaggacacagcatggacatgagggtccccgctcagctcctggggcttctgctgctctggctcccaggtgccaaatgtgccatccagttgacccagtctccatcctccctgtctgcctctgttcgagacatagtcaccatcacttgtcgggctagtcggtcattggcagtgctttagcctggtatcagcagaaaccgaggggagctctaagctcctgatcttgatgctcagtttggaatgagtccatcaagtcagcgntagngatcgtgggacagtattcatcctcaccatcagcagcctgcagcctagaagacttacncgtacaaacctttattattacgtactaaactaagttttaaacggactttaaccccttcttaccgtttaccgttaccgggacgggacgggtaacccgtaaagggggtggaagtaacgttaaccgaaaacgtaaaccgtggttacggccgttacgaccgtacccgtaagtttcctttcg

SEQ ID NO: 309469 - DNA, 580 bp, Homo sapiens
  misc_feature: GZ8MTXP02I7QEG.25.86.H09.1.454.CMB.2.raw
  modified_base (280)..(280): a, c, t, g, unknown or other
  misc_feature (280)..(280): n is a, c, g, or t
  modified_base (356)..(356): a, c, t, g, unknown or other
  misc_feature (356)..(356): n is a, c, g, or t
  modified_base (369)..(369): a, c, t, g, unknown or other
  misc_feature (369)..(369): n is a, c, g, or t
  modified_base (375)..(375): a, c, t, g, unknown or other
  misc_feature (375)..(375): n is a, c, g, or t
  modified_base (404)..(404): a, c, t, g, unknown or other
  misc_feature (404)..(404): n is a, c, g, or t
tcagactgtacagtcacgaccggtgctcgatttagtgctatagacttggggtttgggggcaggagtcagacccactcaggacacagcatggacatgagggtcccgctcagctcctggggcttctgctgctctggctcccaggtgccaaatgtgccatccagttgacccagtctccatcctcctgtctgcctctgttcgagacatagtcaccatcacttgtcgggctagtcgggtcattggcagtgctttagcctggtatcagcaacgaaaccaggggaanctcctaagctcctgtatcttgatgcctctagtttacggaaagtggactccatcaaggttcaggcgcagtggatcgnggacagtactttnactccnaccatcagcaggctgcaacgcagaaagtnttacacgtactacccgttattagtacgtacgtaaacctaagtttaaacggtactttaacccgtcttaacccgttccgttcgggacgggttaacgggaacccgtaaggggttacggaaacgtaacgtaaccgaaaccggtaaaccgtggttaccggacgtcggacctaaccctttcg

SEQ ID NO: 309470 - DNA, 535 bp, Homo sapiens
  misc_feature: GZ8MTXP02G6Q2E.25.86.H09.1.454.CMB.2.raw
  modified_base (393)..(393): a, c, t, g, unknown or other
  misc_feature (393)..(393): n is a, c, g, or t
  modified_base (421)..(421): a, c, t, g, unknown or other
  misc_feature (421)..(421): n is a, c, g, or t
  modified_base (460)..(460): a, c, t, g, unknown or other
  misc_feature (460)..(460): n is a, c, g, or t
tcagactgtacagtcacgaccggtgctcgatttagtgctatagacttgggtttgggggagtcagacccactcaggacacagcatggacatgagggtccccgctcagctcctggggcttctgctgctctggctcccaggtgccaaatgtgccatccagttgacccagtctccatcctccctgtctgcctctgttcgagacatagtcaccatcacttgtcggctaggtcgggtcattggcagtgctttagcctggtatcagcaagaaaccgaggggaacgctacctaagctcctgtatctttgactgcctaccgtaggtttggaaagtcggacgttccccattcgaaacgttcgagcggcgagtcggatcgtgggacagtatttcatcctcaccntcagcagccctgcacgctagagattcgnacaacttattatgtaacaattaagttagtacttaccctnttactccgttcggacgggtaggaccgaaggtgagaactacgaaacgtacgtgtgcctagaccacctatcttaccg

SEQ ID NO: 309471 - DNA, 688 bp, Homo sapiens
  misc_feature: GZ8MTXP02FHB4M.25.86.H09.1.454.CMB.2.raw
  modified_base (330)..(330): a, c, t, g, unknown or other
  misc_feature (330)..(330): n is a, c, g, or t
  modified_base (356)..(356): a, c, t, g, unknown or other
  misc_feature (356)..(356): n is a, c, g, or t
tcagactgtacagtcacgaccggtgctcgatttagtgctatagacttgggtttgggggagtcagatccactcaggacacagcatggacatgagggtccccgctcagctcctggggcttctgctgctctggctcccaggtgccaaatgtgccatccagttgacccagtctccatcctccctgtctgcctctgttcgagacatagtcaccatcacttgtcgggctagtcgggtcattggcagtgctttagcctggtatcagcagaaaccaggggaacgctcctaagctcctgatctttgatcgcctacgtagttaggaagtgacgtacctanaccgtagtcgaggcgagtaggtggtntcgggtaggaacgtagttactttacacttccctaccgaaccttacgtaccgaacgtcgaccgtccgacgaccgaccgtacgtaaagtaacgttacgttaccgaaccgttaacccttaaacgtttaagtttaacgttaaccgttaaaaccgttaaaacgtttaaaacggtttaaaccgttaccccttaccccgttccgtttacccggttacccgggtaccggggaacggggtaaaccgggtaaaccggtaaggggtacgaaaccgtaaaccgtaaaccggaaaaccggtggttacgggtacgtaccgtaccgtaacctaaccgttacgttccg

SEQ ID NO: 309472 - DNA, 602 bp, Homo sapiens
  misc_feature: GZ8MTXP02GA97W.25.86.H09.1.454.CMB.2.raw
  modified_base (284)..(284): a, c, t, g, unknown or other
  misc_feature (284)..(284): n is a, c, g, or t
tcagactgtacagtcacgaccggtgctcgatttagtgctatagacttgggtttgggggagtcagacccactcaggacacagcatggacatgagggtccccgctcagctcctggggcttctgctgctctggctcccaggtgccaaatgtgccatccagttgacccagtctccatcctcctgtctgcctctgttcgagacatagtcaccatctacttgtcgggtctaggcggttttcagttggcagtgtctttagcctggtatcagacgaagaaaccgaggggaanctacctaagctcctgtatttcgttagacttcgccgttaccgtaaggtttaggaaacggtggtaccgtacctagtacgtaacggttcgacggcgacgtaggtgtaacgtcgtacggaacgtagttattcaactcctacaccctagcaaacgtcaacgccgtacgactacgaccttaaggaacttacgttactacgtaaacctaacgtttatattaaccgtataaacgtaagttaacgtcttacctctaccgtcgtacggacggtagacggtaggatacgacttaaacgacgtatggtcgcgacactacgtctcgttacg

SEQ ID NO: 309473 - DNA, 588 bp, Homo sapiens
  misc_feature: GZ8MTXP02FJOFM.25.86.H09.1.454.CMB.2.raw
  modified_base (347)..(347): a, c, t, g, unknown or other
  misc_feature (347)..(347): n is a, c, g, or t
tcagactgtacagtcacgaccggtgctcgatttagtgctatagacttggggtttgggggagtcagacccactcaggacacagcatggacatgagggtccccgctcagctcctggggcttctgctgctctggctcccaggtgccaaatgtgccatccagttgacccagtctccatcctccctgtctgcctctgttcgagacatagtcaccatcacttgcgggctagtcgggtcattggcagtgctttagcctggtatcagcaagaaaccgaggggaagctactaagctcctgattcttgatgcctcagtttggaagtgacgtccatcgaagtcagcgcagtggatcgngggacagtatttcactcctcacatcagcagcctgccaggcctagaaagtcttacgtcgacctaaacctttattaacttagtaacctaaaacgtaaagttttaaacggtacctttaacccctcttacccgttccggttaccggggaccgggtaaacggggaacccgtaaaagggggttggaaacgaacgtaaaccggaaaaccgtaacgtggtacggctacgacctaccgtatccgtttacg

SEQ ID NO: 309474 - DNA, 540 bp, Homo sapiens
  misc_feature: GZ8MTXP02GXMAL.25.86.H09.1.454.CMB.2.raw
  modified_base (336)..(336): a, c, t, g, unknown or other
  misc_feature (336)..(336): n is a, c, g, or t
  modified_base (339)..(339): a, c, t, g, unknown or other
  misc_feature (339)..(339): n is a, c, g, or t
  modified_base (344)..(344): a, c, t, g, unknown or other
  misc_feature (344)..(344): n is a, c, g, or t
  modified_base (348)..(348): a, c, t, g, unknown or other
  misc_feature (348)..(348): n is a, c, g, or t
  modified_base (355)..(355): a, c, t, g, unknown or other
  misc_feature (355)..(355): n is a, c, g, or t
  modified_base (365)..(365): a, c, t, g, unknown or other
  misc_feature (365)..(365): n is a, c, g, or t
  modified_base (367)..(367): a, c, t, g, unknown or other
  misc_feature (367)..(367): n is a, c, g, or t
  modified_base (369)..(369): a, c, t, g, unknown or other
  misc_feature (369)..(369): n is a, c, g, or t
  modified_base (371)..(371): a, c, t, g, unknown or other
  misc_feature (371)..(371): n is a, c, g, or t
  modified_base (374)..(374): a, c, t, g, unknown or other
  misc_feature (374)..(374): n is a, c, g, or t
  modified_base (376)..(376): a, c, t, g, unknown or other
  misc_feature (376)..(376): n is a, c, g, or t
tcagactgtacagtcacgaccggtgctcgatttagtgctatagacttgggtttgggggagtcagacccactcaggacacagcatggacatgagggtccccgctcagctcctggggcttctgctgctctggctcccaggtgccaaatgtgccatccagttgacccagtctccatcctccctgtctgcctctgttcgagacatagtcaccatcacttgtcgggctagtcgggtcattggcagtgctttagcctggtatcagcagaaaccaggggaagctctaagctcctgatcttgatgcctcagtttggaaagtgagtccatcaaggttcagcgganagngatgngganagtattntatctcacananananacncncgcacgactagagatactgtacaactaattattagtactaaactaaattaaagtaacttaaccttacctacctccgtacggtacggacgggaacggaaacggtaggaaggaacgtaacgaaaacgaaacgtaaggtacggtacgtacgacacctactacgtacg

SEQ ID NO: 309475 - DNA, 613 bp, Homo sapiens
  misc_feature: GZ8MTXP02JGRK0.25.86.H09.1.454.CMB.2.raw
  modified_base (276)..(276): a, c, t, g, unknown or other
  misc_feature (276)..(276): n is a, c, g, or t
  modified_base (288)..(288): a, c, t, g, unknown or other
  misc_feature (288)..(288): n is a, c, g, or t
  modified_base (363)..(363): a, c, t, g, unknown or other
  misc_feature (363)..(363): n is a, c, g, or t
tcagactgtacagtcacgaccggtgctcgatttagtgctatagacttgggtttgggggagtcagacccactcaggacacagcatggacatgagggtccccgctcagctcctggggcttctgctgctctggctcccaggtgccaaatgtgccatccagttgacccagtctccatcctccctgtctgcctctgttcgagacatagtcaccatcacttgtcgggctaggtcgggtctagttggcagtgctttagcctggtatcagcagaacgagggganctctaagctctntattcttgatcgtcctccgtaggtttaggaagtgacgtcccattacgacggttcaggcgtcgaggtggactcggngggactagttattccgacttccctacaccctagtaccgacgacacgtcccgtacgaccgaagtccctagaaacgttattaccgtacgtaacctaaccgttatttacttacggtaactaaaacgtaaatttacggtaacctttaccctccttacgttcccgttacggtcggtaacggtaccgtaagggtacgaacgtacgaacgaaacccgtaagtcggtacgtacctacggacctacgacgttctttacg

SEQ ID NO: 309476 - DNA, 713 bp, Homo sapiens
  misc_feature: GZ8MTXP02HSKVB.25.86.H09.1.454.CMB.2.raw
  modified_base (386)..(386): a, c, t, g, unknown or other
  misc_feature (386)..(386): n is a, c, g, or t
tcagactgtacagtcacgaccggtgctcgatttagtgctatagacttgggtttggggagctctgggaaaggagccccagccctgagattcccaggtgattccattcggtgatcagcactgaacacagaactcaccatggagtttggactgagctgggttttccttgttgcctattttaaaaggtgtccagtgtgaagtgcaactggtggagtcgtgggggagccggtggtacgaggccggggggtcctgagactctcctgtgtagcctctggattcattgttgatgattatgccatgctacgtcggggtcccgtagaacggggtccggggaagggtcgtgggaggttggggtcttcttcttagtgtacgttggggagtcggggaanaaacgtaacctagtatcgactacggaccttgtaggtagggtaacgggggtcctaacttcccaacccctaccgtaccccgaaggaaacgaaccaaacctaacttaaccgaaacgtaacccttaccccgttagttaaactccgttaggaacctaaagttacggaactaacgtcgtacgacctaccgtagactacggacctaccgtccgtttaggttatttagttaggtaggttaacgggtaaacggggtcgggtttaggttaggtaagggttaggtaaacggttccggacccggttacccggggaaacccccggttcggggttaacccg

SEQ ID NO: 309477 - DNA, 606 bp, Homo sapiens
  misc_feature: GZ8MTXP02FPQ2R.25.86.H09.1.454.CMB.2.raw
  modified_base (379)..(379): a, c, t, g, unknown or other
  misc_feature (379)..(379): n is a, c, g, or t
tcagactgtacagtcacgaccggtgctcgatttagtgctatagacttgggtttgggggcaggagtcagacccactcaggacacagcatggacatgagggtccccgctcagctcctggggcttctgctgctctggctcccaggtgccaaatgtgccatccagttgacccagtctccatcctccctgtctgcctctgttcgagacatagtcaccatcacttgtcgggctagtcgggtcattggcagtgctttagcctggtatcagcacgaaaccgaggggaagctacctaagctcctgattctttgatcgccttcctagtttggaaagtggacgtccatcgaagttcagtcggcagtggatcgtggacagtattcatcctnaccatcagcacgcctgactcgacctgtaagtacttcgcgtaacctaaccttaatttacttacgtaactaaaccttaaagtttaaaccggtactttaacccctttcttccctttcccggttaccgggacggggtaaacgggtaacccgaaagggttacgggaacgaacgtttaaaccgaaaaccggtacttacggggttacggaccgttacggaccctaacctttacg

SEQ ID NO: 309478 - DNA, 523 bp, Homo sapiens
  misc_feature: GZ8MTXP02FPEX8.25.86.H09.1.454.CMB.2.raw
  modified_base (293)..(293): a, c, t, g, unknown or other
  misc_feature (293)..(293): n is a, c, g, or t
  modified_base (390)..(390): a, c, t, g, unknown or other
  misc_feature (390)..(390): n is a, c, g, or t
  modified_base (397)..(397): a, c, t, g, unknown or other
  misc_feature (397)..(397): n is a, c, g, or t
tcagactgtacagtcacgaccggtgctcgatttagtgctatagacttgggtttgggggagtcagacccactcaggacacagcatggacatgagggtccccgctcagctcctggggcttctgctgctctggctcccaggtgccaaatgtgccatccagttgacccagtctccatcctccctgtctgcctctgttcgagacatagtcaccatcacttgtcgggctagtcgggtcattggcagtgctttagctggtatcagcagaaaccgaggggaagctacctaagctcctgatntttgatgcctcagttgaagtgatccatcaagtcagcgcagtggatcgtgggacagtatttcatccctcaccatcagcacgcctgcagcctagaacgntttacgnacctaactatttatgtacaaactaaatttaaggactttaccctcttacctcttcgggaccggtaggacccgaagggtggaagactaacgaaaacgtaacgtggtcggactggaccacctatcgtta

SEQ ID NO: 309479 - DNA, 613 bp, Homo sapiens
  misc_feature: GZ8MTXP02GWRRS.25.86.H09.1.454.CMB.2.raw
  modified_base (290)..(290): a, c, t, g, unknown or other
  misc_feature (290)..(290): n is a, c, g, or t
tcagactgtacagtcacgaccggtgctcgatttagtgctatagacttgggtttgggggcaggagtcagacccactcaggacacagcatggacatgagggtccccgctcagctcctggggcttctgctgctctggctcccaggtgccaaatgtgccatccagttgacccagtctccatcctccctgtctgcctctgttcgagacatagtcaccatctacttggtcgggctaggtcgggtcagttggctaggtgtctttagccgtggtatcagacaagaaaccgaggggacnctacctaagctcctgattcttgatcgtcctcgtaggtttaggaaagtggactccatcgaagttcaggcggcgaggtggatcgtagggactagtactttacacgttccctactaaaccctagtcacggccacgtcccctagaccacggtccctaaggtaaactcttccacgtacctaaacctttagtttactacgtaaactaaacgttaaagtttaacgtaccttccctactccgttccgttacgggaccgggtacggaacgtaacggggtacgaacgtaacttaacgaaaacggttcgtaggtcgcgtacgaccctaacgtcg

SEQ ID NO: 309480 - DNA, 721 bp, Homo sapiens
  misc_feature: GZ8MTXP02JTUNP.25.86.H09.1.454.CMB.2.raw
tcagactgtacagtcacgaccggtgctcgatttagtgctatagacttgggtttggggagctctgggaaaggagccccagccctgagattcccaggtgattccattcggtgatcagcactgaacacagaactcaccatggagtttggactgagctgggttttccttgttgccattttaaaaggtgtccagtgtgaagtgcaactggtggagtcgtgggggagccggtggtacgaggccggggggtccctgagactctcctgtgtagcctctggattcattgttgatgattatgccatgcacgtgggtccgtacggacgggtccggggaaggtcgtgggacggtggggttcctcgttcttagtcgtacgttggggtagtaggggaacgtaaacgtaaccttacgtagtcgacacggtacttcgtggtagggaacggggtcgtacttacccacccaccctaccgagaacgaacctaagactacgaaacgtacccttcccgtagttactaccgtagaaacctaaagtgggactagttaccacggaaaccctaccggtagaacgtacgaaccccgtacccgtaccgttttacgtaacgttttagttcgggttaacggtaaggggtaaaccggtcggggtttaaggttggggtaaaggggttacgtaaaacgggttccggtaacccccgggtacccggggttaaaccccccccggggtcggtacccg

SEQ ID NO: 309481 - DNA, 562 bp, Homo sapiens
  misc_feature: GZ8MTXP02HUYEE.25.86.H09.1.454.CMB.2.raw
  modified_base (284)..(284): a, c, t, g, unknown or other
  misc_feature (284)..(284): n is a, c, g, or t
  modified_base (294)..(294): a, c, t, g, unknown or other
  misc_feature (294)..(294): n is a, c, g, or t
  modified_base (302)..(302): a, c, t, g, unknown or other
  misc_feature (302)..(302): n is a, c, g, or t
  modified_base (321)..(321): a, c, t, g, unknown or other
  misc_feature (321)..(321): n is a, c, g, or t
  modified_base (372)..(372): a, c, t, g, unknown or other
  misc_feature (372)..(372): n is a, c, g, or t
tcagactgtacagtcacgaccggtgctcgatttagtgctatagacttgggtttgggggcaggagtcagacccactcaggacacagcatggacatgagggtccccgctcagctcctggggcttctgctgctctggctcccaggtgccaaatgtgccatccagttgacccagtctccatcctccctgtctgcctctgttcgagacatagtcaccatcacttgtcgggctaggtcgggtctagttggcagtgctttagcctggtatcagacaagaaccgaggggaanctcaagctcngatcttgntcgctctagttagaagtgntccatcagtcagcgcagtggatcgtgggactagtatttcactcctcaactntcagcacgcctgcacgctagagtattcacgtactaaccttatttaacttcgtaactaaacttaagtttaacgtaccttaccctcgttacccgttcgttaccggggacgggtaacggtaaccggtaacgggtacggtaactaacgaaccgtaaaacgtacgttacggtacggccgtacggacctaccgtag

SEQ ID NO: 309482 - DNA, 769 bp, Homo sapiens
  misc_feature: GZ8MTXP02ICLIL.25.86.H09.1.454.CMB.2.raw
  modified_base (197)..(197): a, c, t, g, unknown or other
  misc_feature (197)..(197): n is a, c, g, or t
  modified_base (284)..(284): a, c, t, g, unknown or other
  misc_feature (284)..(284): n is a, c, g, or t
tcagactgtacagtcacgaccggtgctcgatttagtgctatagacttgggtttgggggagtcagacccactcaggacacagcatggacatgagggtccccgctcagctcctggggcttctgctgctctggctcccaggtgccaaatgtgccatccagttgacccagtctccatcctccctgtctgcctctgttcganacatagtcacctatcacttgcgggctagtcgggtcagttggcagtgtctttagccttggtatcgagcaaggaaacccgaggggaacncctaccgtaaacgccttcccgtgtaactttccttttggaacttcggtaccccttacccgtaagggttttacggggaaaacggttcgggtaaccggtccccctaaagttaccggtaaacggggtttaccaacggggccgggtcgtaaggggtttcgggaactttccggggtacgggggtaaacctaagggttaacctttttcccgaaactttccccttaaccaaacccttagcccgtaagcccgtaacgggcccttacggccgaacggtacccgtaagtaaaaccggtctttaccgttacgaaaccttaaacccgtttaatttaacctttacggtaaaccttaaaacttaaagttttaaacggtacctttaacccctcgttacccgtcggttacccggggacgggacgggtaaaccgtagggtagggaacgtacgtaaacgaaaacgtacgtcggtacggactacggacctaacgtctcgtttacg

SEQ ID NO: 309483 - DNA, 700 bp, Homo sapiens
  misc_feature: GZ8MTXP02IOPCL.25.86.H09.1.454.CMB.2.raw
  modified_base (283)..(283): a, c, t, g, unknown or other
  misc_feature (283)..(283): n is a, c, g, or t
tcagactgtacagtcacgaccggtgctcgatttagtgctatagacttgggtttgggggcaggagtcagacccactcaggacacagcatggacatgagggtccccgctcagctcctggggcttctgctgctctggctcccaggtgccaaatgtgccatccagttgacccagtcctccatcctccctgtctgcctctgttcgagacatagtcaccatcacttgtcggctagtcgggtcagttggctagtgtctttagctggtatcagcaagaaaccgaggggaancctacctaagccttctgtacttcgtttagagtcgtccctacgttaaggtttagggaaaagtcggaacgttacccctagtaccgtaaggtttaccgacgggcggtacgaagggttcgggtaacttccggtagggggacctaaggttactttaccgaccttaccctacaaaccgtatacgacgactacgcccgttagaccgtacgtacccgtaggaaacgttcttaccgtaacgtaaccttaaactttacgtttattaccgtaaactaaaacgtttaaacgtttaaacgtacctttaccccttacgttcccgtttccggtacggggtaccgggtaaacggggtaaaccgtaaaggggttacgaacgtaacgtaaacggaaaacgttacgacggttcgaacgttcgaccctaaaccgttc

SEQ ID NO: 309484 - DNA, 667 bp, Homo sapiens
  misc_feature: GZ8MTXP02H6802.25.86.H09.1.454.CMB.2.raw
  modified_base (354)..(354): a, c, t, g, unknown or other
  misc_feature (354)..(354): n is a, c, g, or t
tcagactgtacagtcacgaccggtgctcgatttagtgctatagacttgggtttggggagctctgggaaaggagccccagccctgagattcccaggtgattccattcggtgatcagcactgaacacagaactcaccatggagtttggactgagctgggttttcctgttgccattttaaaaggtgtccagtgtgaagtgcaactggtggagtcgtgggggagccggtggtacaggccggggggtccctggagactctcctgtgtagcctctggtattcatgttgatgattatgccatgacacgtcggggtccgtcgaaggggtcggggaagggtcgtgggaggtgggtacctcttnttagtgtcgttggggagtggggaagaacggaaccctagtaagtggcaggtactcgtaggtagtaacgggggtcacttaccaccctccacccgaggacaactaaacactaccaaacgtaaccctccccgtagtactacgttacggacaaaacgttcggaacgtacgtacgttacggaaccaccgttaggatacgaacctaacccggttctttacgttaatttacgtggtaaccgggtaggtaaacgggtcggtttggtaggtaaggtacggtaaacgtcggtaccggttacccggaccccgggttacggtaccg

SEQ ID NO: 309485 - DNA, 642 bp, Homo sapiens
  misc_feature: GZ8MTXP02IT5JX.25.86.H09.1.454.CMB.2.raw
  modified_base (267)..(267): a, c, t, g, unknown or other
  misc_feature (267)..(267): n is a, c, g, or t
  modified_base (307)..(307): a, c, t, g, unknown or other
  misc_feature (307)..(307): n is a, c, g, or t
tcagactgtacagtcacgaccggtgctcgatttagtgctatagacttgggtttggggagctctgggaaaggagccccagccctgagattcccaggtgattccattcggtgatcagcactgaacacagaactcaccatggagtttggactgagctgggtttttcctgttgcctattttaaaaggtgtccagtgtgaagtgcaactgggtggagtcgtgggggagccgtggtacgaggccggggggtcctgagctctcctgtgtagctntggattcattgttgatgattatgccatgcacgtggtccgngaacggtccggggaaggtcgtgggaggttcgggtcttcttcttagtgtacgttaggggagtaggggaagaaagtacctaacttagtagacagtacttcgtaggtacggaacggggtcgtaagttcccaccgtacctccgaagaacgaaaccaaacactaccaaaggtaacccttcccgtagttactacgtacggaactaaagttcggaactgtacctacgaacaccgttgaaacgtcgaaccgtacccgtactttagtacgtttacgtggtacgtacggtaagggtcgttggtagtggtagacgtcgtaccggtaccggaacccggtcgtaaccg

SEQ ID NO: 309486 - DNA, 641 bp, Homo sapiens
  misc_feature: GZ8MTXP02IC12E.25.86.H09.1.454.CMB.2.raw
tcagactgtacagtcacgaccggtgctcgatttagtgctatagacttgggtttgggggcaggagtcagacccactcaggacacagcatggacatgagggtccccgctcagctcctggggcttctgctgctctggctcccaggtgccaaatgtgccatccagttcgacccagtctccatcctcctgtctgcctctgttcgagacatagtcaccatctacttggtcgggctaggtcgggtcagttggcaggtgtctttagcctggtatcagacaacggaaaccgaggggaatcctactaagcctcctgacttctttgactcgtccttacgtaggtttaggaaagtcggacgtcctaagtacgtaacggttcacggtcggacgtaggtggtaattcggtagggtacctaagttactttacactccctacacctatcacgcacgctgcacgctaggaaatctttaccagtaacctaaactttacgttaagttacggtaaacctaaaacgttaaacgtttacggtaaaccctttccctccgttaacccgtttccgggtaaccgggtcgggaaacggtaccgtaaagggttacgaacggtaactaaccggaaaacgtacgtcggtacggacctacgtaccacttacg

SEQ ID NO: 309487 - DNA, 581 bp, Homo sapiens
  misc_feature: GZ8MTXP02FJI6Z.25.86.H09.1.454.CMB.2.raw
  modified_base (280)..(280): a, c, t, g, unknown or other
  misc_feature (280)..(280): n is a, c, g, or t
tcagactgtacagtcacgaccggtgctcgatttagtgctatagacttggggtttgggggcaggagtcagacccactcaggacacagcatggacatgagggtccccgctcagctcctggggcttctgctgctctggctcccaggtgccaaatgtgccatccagttgacccagtctccatcctccctgtctgcctctgttcgagacatagtcacatcacttgtcgggctagtcgggtcattggcagtgctttagcctggtatcagcagaaaccgaggggaanctcctaagctcctgatctttgatgcctcagtttggaaagtggacgtccatcaggtcagcgcagtgatcgtgggacagtatttcatccctcaccatcagcacgcctgccagcctaggaacgtattctacgacctaaacctttatttattacgtactaaaacttaatttaaacggactttaaccccttcttcccgttaccggttcgggacgggtaacggggtaacccgtaacggggtaggtaacgtaacgttaaccgaaaaccggtaacgttacggtagggtaccttacggacctaccctacg

SEQ ID NO: 309488 - DNA, 638 bp, Homo sapiens
  misc_feature: GZ8MTXP02G0Q6Y.25.86.H09.1.454.CMB.2.raw
  modified_base (290)..(290): a, c, t, g, unknown or other
  misc_feature (290)..(290): n is a, c, g, or t
  modified_base (412)..(412): a, c, t, g, unknown or other
  misc_feature (412)..(412): n is a, c, g, or t
  modified_base (420)..(420): a, c, t, g, unknown or other
  misc_feature (420)..(420): n is a, c, g, or t
tcagactgtacagtcacgaccggtgctcgatttagtgctatagacttgggtttgggggcaggagtcagacccactcaggacacagcatggacatgagggtccccgctcagctcctggggcttctgctgctctggctcccaggtgccaaatgtgccatccagttcgacccagtcctccatcctccctgtctgcctctgttcgagacatacgtcaccatcacttggtcgggctaggtcgggtcagttggctagtgtctttagcctggtatcagacaagaaaccgaggggacnctacctaagcttcctgattcgtttgacttcgccctacgtaggtttaggaaagtggacgtaccatacgtaagttcgaggtcggactaggtggactcgtggggaactgtactttacacttcccncaacctancgacgcgacgtcctacgacacgtacgtaagtaacttcttaccgtacgtaaccttaaactttattacgttaacgtaaccttaaaagttaaacgtttaacgtacctttacccgttccgttaccgttaccgggtacgggaacgggtaacgggtaacgtaacgggtacgaaacgtaacgtaaaccgaacggttacgtcggtacgtactcgaacctacgtacg

SEQ ID NO: 309489 - DNA, 837 bp, Homo sapiens
  misc_feature: GZ8MTXP02GSBEE.25.86.H09.1.454.CMB.2.raw
tcagactgtacagtcacgaccggtgctcgatttagtgctatagacttggggtttgggggagtcagacccactcaggacacagcatggacatgagggtccccgctcagctcctggggcttctgctgctctggctcccaggtgccaaatgtgccatccagttgacccagtctccactcctccctgtctgcctctgtcgagacatagtcaccatctacttggtcgggctaggtcgggtctagttggctagtcgtctttaggccgttaggtactcgacgacaaacggaaaccgaaggggaacgtcctacctaaggtcccttacccgtggtactttcgtttacgaacgttcgtccccgttaccggtttagggtttacgggaaaacggttcgggtaaccgtccccgtaagttacgtaaccggttcgacgggtacggacgtggtacgggtactcggggtacgggaactaacgtttactttaccgtaaccttcccgtaaccctaccagttaaaccgccgtacggtaccgtcccggttagtacccgaacggttaaccgttaagggtaacctttaccgttaccgtaaacccggttaaaccctttaaacgtttaaggtttaacccttaaccggttaaaaaccggttaaacctttaaaaggtttaccccggttaccctttaacccggtccgtttaacccgggttcccgggggtaacggttacccgggggaaaaccggtttaacgggaaacgggggtaacgtaaacggtaaaccgtaaaccggttaaacggttaccgggaagtttacccgaacggttaccgaaaccctcgtttaacgtcccggtttaccc

SEQ ID NO: 309490 - DNA, 765 bp, Homo sapiens
  misc_feature: GZ8MTXP02H4ITS.25.86.H09.1.454.CMB.2.raw
  modified_base (310)..(310): a, c, t, g, unknown or other
  misc_feature (310)..(310): n is a, c, g, or t
  modified_base (448)..(448): a, c, t, g, unknown or other
  misc_feature (448)..(448): n is a, c, g, or t
  modified_base (455)..(455): a, c, t, g, unknown or other
  misc_feature (455)..(455): n is a, c, g, or t
  modified_base (496)..(496): a, c, t, g, unknown or other
  misc_feature (496)..(496): n is a, c, g, or t
  modified_base (502)..(502): a, c, t, g, unknown or other
  misc_feature (502)..(502): n is a, c, g, or t
tcagactgtacagtcacgaccggtgctcgatttagtgctatagacttgggtttggggagctctgggaaaggagccccagccctgagattcccaggtgattccattcggtgatcagcactgaacacagaactcaccatggagtttggactgagcttgggttttccttgttcgcctaattttaaaaggtgtcctagtgtgaagtgcaagtgggtggaggtcgtgggggacgccggtggtacgagggcccgggggggtcctggacgacctctcctggtgtagcctgtggtatcagttgtttgattgactttancgcctatcgacctacggttcggggtacccgtacggtaaacggggtcccgggggaaaggggttccgtggggtaggttggggttaccttcgttcttagtgtaacgttggggatccggggaaagaacgtaactacgttaancggtacnggtacctgtggtagacggggtcattccacccacctccaganaccaanaatacaaagtaccctcctatactacctggaaccaaagttacgacgtaacgttcgtacggtaccaaccgttggaactaaaccgggccctaacccggttaccttttacgggttaaaactttttacggtttcggttaaagggttaaacggggttaaaagggggttacccgggggttttggttaacggggtaaggggttaacgaaaacgggtttcccgggaacccggtacccgggtttaaaaccccccccgggggtacggtaacccg

SEQ ID NO: 309491 - DNA, 700 bp, Homo sapiens
  misc_feature: GZ8MTXP02IBYRF.25.86.H09.1.454.CMB.2.raw
tcagactgtacagtcacgaccggtgctcgatttagtgctatagacttgggtttgggggcaggagtcagacccactcaggacacagcatggacatgagggtccccgctcagctcctggggcttctgctgctctggctcccaggtgccaaatgtgccatccagttgacccagtcctccatcctccctgtctgctctgttcgagacatacgtcaccatcacttggtcggctaggtcgggtcagttggctaggtgtctttagcctggtatcgacgctaaacggaaaccgaggggactccgtacctaacgccttcctaggtaactttcgttaagtcgttcgtcccgttaccgtaaggtttagggaaaacggttcgggtaacgttaccccagttaccgtaaacggttcaacgggtaccggacgtagggttcgggtacgttcggtacgggtaacgtagttactttaccacttaccctacaacacttacgaagcccgtacgtccgtgaccgtaccgtacgtagtaaacgtacgtttccgaagtaccttaaaacccttagtttacttaaccgtaaacgtaaactttaagtttaacgtaccttaaccgttcctacccgtttccggtgggtaaccgggaacggtaaccggtaaagggtcgtaaacgtacgtaacgaaaacgtctagggtactcgtacgtaccctacgttcg

SEQ ID NO: 309492 - DNA, 670 bp, Homo sapiens
  misc_feature: GZ8MTXP02GU4N0.25.86.H09.1.454.CMB.2.raw
  modified_base (278)..(278): a, c, t, g, unknown or other
  misc_feature (278)..(278): n is a, c, g, or t
  modified_base (289)..(289): a, c, t, g, unknown or other
  misc_feature (289)..(289): n is a, c, g, or t
tcagactgtacagtcacgaccggtgctcgatttagtgctatagacttgggtttgggggagtcagacccactcaggacacagcatggacatgagggtccccgctcagctcctggggcttctgctgctctggctcccaggtgccaaatgtgccatccagttgacccagtctccatcctcctgtctgcctctgttcgagacatagtcaccatcacgttgtcgggctaggtcgggtctagttggctagtgtcttagcctggtatcagcagaaccgagggaanctacaagctcngtatcttgatgcctcgagtttaggaaaggtcggtactccatcgacggttcaggcgacagtggatcgtagggactagtattcactcctcacctatacgagccacgtcccgtagcccgaagtccttaacgggaactaactttccgtaacggtaacccttaaacccttttaagtttaacggtttaccgtaaacctaaaaccgtttaaaagttttaaaccgggtaacctttttaacccccgtccgtttaaccccggtttccgggttacgggggaaccgggggtaaaaccgggtacccggtaaagggggttgaaaaccgttaacgtaaaaccccgtaaagggtaccgtcggtcggtacttacggacctaacgtcggttctttaccg

SEQ ID NO: 309493 - DNA, 629 bp, Homo sapiens
  misc_feature: GZ8MTXP02GLIT2.25.86.H09.1.454.CMB.2.raw
  modified_base (282)..(282): a, c, t, g, unknown or other
  misc_feature (282)..(282): n is a, c, g, or t
  modified_base (406)..(406): a, c, t, g, unknown or other
  misc_feature (406)..(406): n is a, c, g, or t
tcagactgtacagtcacgaccggtgctcgatttagtgctatagacttgggtttgggggagtcagacccactcaggacacagcatggacatgagggtccccgctcagctcctggggcttctgctgctctggctcccaggtgccaaatgtgccatccagttgacccagtctccatcctccctgtctgcctctgttcgagacatagtcaccatcacgttgtcggctaggtcgggtcattggctagtgtctttagcctggtatcgagcgaagaaaccgaggggacnctacctaagctcctgtacttcttgatcgtcctcgtaggtttaggaaaggttcggtacgtacccattacgaacggttcgaggcggctaggtggatcggtagggactagtactttcactcctcacntcgagtcacgccgtgcgacgtaccgtagaactacttactactaaccttaacctttattaacttactaactaaacgttaaagtttaacgtacttaccctcttaccgttaccggttcgggaacggtaacggggtaccgtaaaggggttacgaaacgtaacgttaaaccgaaacggttacgtgggtaacggccgttacggaaccctaccttacgttaccgtttccg

SEQ ID NO: 309494 - DNA, 527 bp, Homo sapiens
  misc_feature: GZ8MTXP02FP7H2.25.86.H09.1.454.CMB.2.raw
  modified_base (274)..(274): a, c, t, g, unknown or other
  misc_feature (274)..(274): n is a, c, g, or t
  modified_base (341)..(341): a, c, t, g, unknown or other
  misc_feature (341)..(341): n is a, c, g, or t
  modified_base (392)..(392): a, c, t, g, unknown or other
  misc_feature (392)..(392): n is a, c, g, or t
  modified_base (440)..(440): a, c, t, g, unknown or other
  misc_feature (440)..(440): n is a, c, g, or t
  modified_base (527)..(527): a, c, t, g, unknown or other
  misc_feature (527)..(527): n is a, c, g, or t
tcagactgtacagtcacgaccggtgctcgatttagtgctatagacttgggtttgggggagtcagacccactcaggacacagcatggacatgagggtccccgctcagctcctggggcttctgctgctctggctcccaggtgccaaatgtgccatccagttgacccagtctccatcctccctgtctgcctctgttcgagacatagtcaccatcacttgtcgggctagtcgggtcattggcagtgctttagcctggtatcagcagaaaccagggaanctcctaagctctgatctttgatgcctcagtttggaaatggatccatcaagtcagcggcagtgatcgngggacagtattcatcctacaccatcagcagcctagcagctagaacgattcngactaacttgttaacttcgtacaaactaatttaacggactttaacccncttacctccgttcggaccgggaacgggtaaccagggtaggacgaacgttacaaacggtaactgtcggactcggacacctatccgttn

SEQ ID NO: 309495 - DNA, 663 bp, Homo sapiens
  misc_feature: GZ8MTXP02G374B.25.86.H09.1.454.CMB.2.raw
  modified_base (449)..(449): a, c, t, g, unknown or other
  misc_feature (449)..(449): n is a, c, g, or t
tcagactgtacagtcacgaccggtgctcgatttagtgctatagacttgggtttgggggcaggagtcagacccactcaggacacagcatggacatgagggtccccgctcagctcctggggcttctgctgctctggctcccaggtgccaaatgtgccatccagttcgacccagtcctccatcctccctgtctcgcctctgttcgagacatagtcaccatctattgtcgggctaggtcggtcagttggctaggtgtactttagccgtggtatcgagacgaacgaaaccggaggggaactccgtacctaacgccttcctgtacttcttgactccgtccttaccgtaggtttacggaaagtcggtacgtccaacgtacgtaacgtcgacggtcggagtaggtcgggatcggtacgggactagttacttacactccctacaaccctactacgacncgtacgccgtagaccgacgtacgtaagtaacgttctacgtacgtaacctaatttattaacgtacgtaaacttaaacgttaacgttaaccgttacctttaccgtacgttaccggttaccgggtacggggtaacgggaaccggtaaacggtaacgggtacgaaacgtaaccgtaaacgtaaacgtcggtacggtcgtacgaccgtaccgtacgtcg

SEQ ID NO: 309496 - DNA, 571 bp, Homo sapiens
  misc_feature: GZ8MTXP02FIVL0.25.86.H09.1.454.CMB.2.raw
  modified_base (275)..(275): a, c, t, g, unknown or other
  misc_feature (275)..(275): n is a, c, g, or t
  modified_base (289)..(289): a, c, t, g, unknown or other
  misc_feature (289)..(289): n is a, c, g, or t
  modified_base (374)..(374): a, c, t, g, unknown or other
  misc_feature (374)..(374): n is a, c, g, or t
  modified_base (426)..(426): a, c, t, g, unknown or other
  misc_feature (426)..(426): n is a, c, g, or t
tcagactgtacagtcacgaccggtgctcgatttagtgctatagacttgggtttgggggagtcagacccactcaggacacagcatggacatgagggtccccgctcagctcctggggcttctgctgctctggctcccaggtgccaaatgtgccatccagttgacccagtctccatcctccctgtctgcctctgttcgagacatagtcaccatcacttgtcgggctagtcgggtcattggcagtgctttagcctggtatcagcagaaaccaggggaanctacctaagctccngattctttgatgcctcagtttggaagtgactccatcgaggttcagcggcagtggatcgtgggacagtactttcatcccacacccntcagacacggcctagccaagcctagaaacgtactttcgacgactaaaccttntttattacggtaataaaacttaaagtttaaacggtacctttaacccctcttaccgttccgtcggggacggtaacggggacctaaaggggtgacgtaacttacgaaaacgtacgtggtacgcgtacgacctaacctgtctttccgg

SEQ ID NO: 309497 - DNA, 717 bp, Homo sapiens
  misc_feature: GZ8MTXP02HOJWL.25.86.H09.1.454.CMB.2.raw
  modified_base (298)..(298): a, c, t, g, unknown or other
  misc_feature (298)..(298): n is a, c, g, or t
tcagactgtacagtcacgaccggtgctcgatttagtgctatagacttggggtttgggggagtcagacccactcaggacacagcatggacatgagggtccccgctcagctcctggggcttctgctgctctggctcccaggtgccaaatgtgccatccagttgacccagtctccatcctccctgtctgcctctgttcgagacatagtcaccatcacttggtcgggctaggtcgggtctagttgggctagtgtctttaggcctggtatccgagacgaaggtaaaacccggagggggtaacncctaccgtaaacgccgtcctgtactttctttagacttcgcctaccgtaggtttacggaaaggtcggtacgtaccctagtacgtaacggtacgacggcggcgaacggtggacgtcggtagggggaactagttactttcgaaccgttcctaccaaccctatacccaaacggcctaacggtcccttacggaccgaaaggccccttaagggaaaacttcgttaacgtaccggtaaccttaaacttttattaacgttacgttaaactaaacgttaaaaggttttaacgaacctttccccttcgttaccgttacccgggttacgggacggggaaacgtaaccggtaaaggggtacggaaactaacgtaaacgtaaaccgtaagttcgggttacgacgtcggtacctaaccggttatttccttacg

SEQ ID NO: 309498 - DNA, 668 bp, Homo sapiens
  misc_feature: GZ8MTXP02F815O.25.86.H09.1.454.CMB.2.raw
tcagactgtacagtcacgaccggtgctcgatttagtgctatagacttggggtttgggggagtcagacccactcaggacacagcatggacatgagggtccccgctcagctcctggggcttctgctgctctggctcccaggtgccaaatgtgccatccagttgacccagtctccatccctccctgtctgcctctgttcgagacatagtcaccatcacttggtcgggctaggtcgggtctattggctagtgtctttagcctggtatcagcaaggaaaccgaggggaagtcctaccgtaagcctcctgtattcgtttgatcgtcctcgtagttggaagtggacgtccatcgaacggtcacgcggctaggtggatcgtgggaacagtatttcactcctacaccatcgagctacgcctgccagtccgtagaacgtacttacgtacgaccttaaacctttaatttagttacggttaacctaaaacgtttaaaacgttttaaacggtacccttttaaccccttcttaccccggtttacccgggttacgggggtaaccggggaaacgggggtaacccgtaaagggggtaccgggtaaagtaaccgtaaaccgtaaaacggtaacgttcgggttacggtaccgttacggaccctaacccgttactttaccgtttccgg

SEQ ID NO: 309499 - DNA, 723 bp, Homo sapiens
  misc_feature: GZ8MTXP02H68DF.25.86.H09.1.454.CMB.2.raw
  modified_base (302)..(302): a, c, t, g, unknown or other
  misc_feature (302)..(302): n is a, c, g, or t
  modified_base (315)..(315): a, c, t, g, unknown or other
  misc_feature (315)..(315): n is a, c, g, or t
  modified_base (320)..(320): a, c, t, g, unknown or other
  misc_feature (320)..(320): n is a, c, g, or t
tcagactgtacagtcacgaccggtgctcgatttagtgctatagacttggggtttgggggcaggagtcagacccactcaggacacagcatggacatgagggtccccgctcagctcctggggcttctgctgctctggctcccgaggtgccaaatgtgccatccagttcgacccagtcctccatccctcctgtctgcctctgttcgagacatacgtccaccatctacgttggtcgggcttaggtcgggttcagttggctaggtgtcgtttagccgtggtactcagcaacgaaaccggagggaacnctactaagctctnacttntgatcgctacgtaggttaggaagtcggactaccagtacgtaacggttcacggtcggacgtaggtcgggtacttacgggtacggggtactaggttactttacctacgtaccctacaaccctaacgtacgacgaccgtacgtaccgtacgaccgtaacgtaccgtaaggtaacgttacgttaccgtaacgtaaacctttaaactttagtttaacgttaaccgtaaaaccgttaaacgtttaaacggtttaaaccgttaccctttaacccttcccgtttaacccggttaccgggttacgggggtaaaccgggtaaacgggtaaacggtaacgggttacgaaacgttaacgtaaaaccggtaacggtaacggttacggtacgtacgaccgttaccgtaaccgttacg

SEQ ID NO: 309500 - DNA, 740 bp, Homo sapiens
  misc_feature: GZ8MTXP02JJK9L.25.86.H09.1.454.CMB.2.raw
  modified_base (272)..(272): a, c, t, g, unknown or other
  misc_feature (272)..(272): n is a, c, g, or t
  modified_base (276)..(276): a, c, t, g, unknown or other
  misc_feature (276)..(276): n is a, c, g, or t
tcagactgtacagtcacgaccggtgctcgatttagtgctatagacttgggtttggggagctctgggaaaggagccccagccctgagattcccaggtgattccattcggtgatcagcactgaacacagaactcaccatggagtttggactgagctgggttttccttgttgcctattttaaaaggtgtccagtgtgaagtgcaacgtggtggagtcggtgggggagccggtggtacgagggcccggggggtccctggacgactctcctgtgtancctntggattcattgtttgatgtattagtgccatcgctacggtcgggtccgtcggtaacggggtccggggaagggttcgtgggtagggttcggtcttcgttcgtttagtcgtacgtggggtagtaggggagaaacgtaaccctatagtcgacacgtactacgtaggtagggtacgggtacgtacttaccgaaccccaccgtaccgagaacaacaaacgtataccaaacgtaccctccgtagtactacgtagaacgtaaagtcggaacctacgggtacctacggaaaccctcgtaacgtacgttaccgaaccccgttacccgtacttttaaggttaaacttttaggtcggttaaggggtaaacgggtaaaccggggtttcggggtttaaggttagggaagggttaaacggaacggtttcccggggaccccggttaccccgggtaaaccccccggggtttggtaaacccg

SEQ ID NO: 309501 - DNA, 632 bp, Homo sapiens
  misc_feature: GZ8MTXP02HQDF8.25.86.H09.1.454.CMB.2.raw
  modified_base (226)..(226): a, c, t, g, unknown or other
  misc_feature (226)..(226): n is a, c, g, or t
  modified_base (419)..(419): a, c, t, g, unknown or other
  misc_feature (419)..(419): n is a, c, g, or t
  modified_base (443)..(443): a, c, t, g, unknown or other
  misc_feature (443)..(443): n is a, c, g, or t
  modified_base (447)..(447): a, c, t, g, unknown or other
  misc_feature (447)..(447): n is a, c, g, or t
  modified_base (449)..(449): a, c, t, g, unknown or other
  misc_feature (449)..(449): n is a, c, g, or t
  modified_base (456)..(456): a, c, t, g, unknown or other
  misc_feature (456)..(456): n is a, c, g, or t
tcagactgtacagtcacgaccggtgctcgatttagtgctatagacttgggtttgggggagtcagacccactcaggacacagcatggacatgagggtcccccgctcagctcctggggcttctgctgctctggctcccaggtgccaaatgtgccatccagttcgacccagtctccactcctccctgtctcgcctctgttcagacatatcaccatctacgttggtcggntaggtcggtctagttggctaggttcgtcgttagccgttggtactcgaacgacgaacggaaaccggaaggggtaactcccgttaccgtaacgtccttccgtgtaacttcgtttaacggcttcgtacccgtttacggtagggtttaacggtaaaggtcggtacctacctagtacgtacggtcagtcgagtgtcgngtcgtggactgttacttcacttcncacncncgacacncgtcagcctgtacgtagtacttctacgtactaacttacgttattagtactaactaacgttaaaccgttactaccttacctccgttacgtccggtacgggacgggtaacgtacgtacggtacgaaacgtaccgtaaacgtaacgtacgtggtacgaccgtacactctcgttacgtcg

SEQ ID NO: 309502 - DNA, 676 bp, Homo sapiens
  misc_feature: GZ8MTXP02FZBPS.25.86.H09.1.454.CMB.2.raw
  modified_base (274)..(274): a, c, t, g, unknown or other
  misc_feature (274)..(274): n is a, c, g, or t
  modified_base (356)..(356): a, c, t, g, unknown or other
  misc_feature (356)..(356): n is a, c, g, or t
tcagactgtacagtcacgaccggtgctcgatttagtgctatagacttggggtttggggagctctggggaaaggagccccagccctgagattcccaggtgattccattcggtgatcagcactgaacacagaactcaccatggagtttggactgagctgggttttccttgttgcctattttaaaaaggtgtccagtgtgaagtgcaactggtggagtcgtggggggagccgtgggtacaggccgggggggtccctgagactctcctgtgtagcctntggattcatgttgatgattatgccatgcacgtgggtcgtacgaagggtccggggaaggggtctggaggtgggtctctcttangaacgttgggagtgggaacgaagaacctactagtgcgtagactctggtaggaaggggttacgtattcaaccctacctacccgaagagtaaacccaaaatactaacgaaaacgtaaccttccctagtactcgtaagaaacgtaaaaggtcggaacctaggttccgtaacgaacctaccgtagtaacgacgtaaccgacccgttaccgtttacgttagtttagtttaggttaggttaacgggtaaacgggtacgggttagggttaggtaaggtaaggtaacgtacggtacccggtacccgggtaaccccggacccggtaccg

SEQ ID NO: 309503 - DNA, 581 bp, Homo sapiens
  misc_feature: GZ8MTXP02F1XLB.25.86.H09.1.454.CMB.2.raw
  modified_base (305)..(305): a, c, t, g, unknown or other
  misc_feature (305)..(305): n is a, c, g, or t
tcagactgtacagtcacgaccggtgctcgatttagtgctatagacttgggtttgggggcaggagtcagacccactcaggacacagcatggacatgagggtcccccgctcagctcctggggcttctgctgctctggctcccaggtgccaaatgtgccatccagttgacccagtctccatcctccctgtctgcctctgttcgagacatagtcaccatcacttgtcgggctaggtcgggtcagttggcagtgtcttagcctggtatcagcagaaaccgaggggaagctctaagctcctgatcttgatncctcagtttaggaagtgagtccatacagtcagcgcagtggatcgtgggacagtattcatcctcacatcagctacgcctgctacgcctagaatacttactacgacctaacttatttacttacgtaactaaacgtaaatttaacggtacttaacccttcttccgttccgttacgggacgggtaacgggtaacccggtaaaggggttacggaaagtaacgttaaacccgaaaaacggtaacgttacgggtacggggtactacggacccactttaaccgg

SEQ ID NO: 309504 - DNA, 696 bp, Homo sapiens
  misc_feature: GZ8MTXP02HMAP4.25.86.H09.1.454.CMB.2.raw
  modified_base (226)..(226): a, c, t, g, unknown or other
  misc_feature (226)..(226): n is a, c, g, or t
  modified_base (288)..(288): a, c, t, g, unknown or other
  misc_feature (288)..(288): n is a, c, g, or t
  modified_base (377)..(377): a, c, t, g, unknown or other
  misc_feature (377)..(377): n is a, c, g, or t
  modified_base (558)..(558): a, c, t, g, unknown or other
  misc_feature (558)..(558): n is a, c, g, or t
tcagactgtacagtcacgaccggtgctcgatttagtgctatagacttgggtttgggggagtcagacccactcaggacacagcatggacatgagggtcccccgctcagctcctggggcttctgctgctctggctcccaggtgccaaatgtgccatccagttcgacccagtctccatcctccctgtctgcctctgttcgagacatagtcacctatctacttggtcggntaggtcgggtctattggcagtgctttagccttggtatcagacaacggaaaccgaggggaacncctaccgtaagtcctcctagtacttcttgactcgccttccgtaaggtttaggaagtcggtacgtccagtacgaacggttcgacggccgngaggtggatcggtagggactagtatttcacttacctaccactataccgagacacggccccttagacctagtacccgtaagaacggtactttccgtaacggtaaccttaaacggttttaacttagtttaccggtaaaaccttaaaacgtttaaagttttaaaccgacccttttaaccccgtntttacccggttcccggttaacgggacgggtaaaccggggtaaccgtaaaggtacggtaaaacgtacgtaaaccgaaaaccggttagtaacgggtcgttacccgacggtacccgacttaaccgtttcggtttaaccccg

SEQ ID NO: 309505 - DNA, 690 bp, Homo sapiens
  misc_feature: GZ8MTXP02JTK39.25.86.H09.1.454.CMB.2.raw
tcagactgtacagtcacgaccggtgctcgatttagtgctatagacttgggtttggggagctctgggaaaggagccccagccctgagattcccaggtgattccattcggtgatcagcactgaacacagaactcaccatggagtttggactgagctgggttttccttgttgcctattttaaaaggtgtccagtgtgaagtgcaactggtggagtcgtgggggagccgtggtacgaggccggggggtccctgagactctcctgtgtagcctctggattcattgttgatgattatgccatgcacgtgggtccgtacggaacggggtccggggaagggtcgtgggtaggtgggtcttcgttcttagtgtacgtgggagtagggaagaacgtaactactagtcgcgtacgtactcgtggtaggtaacgggttcgactttacccgaacccctaccgtacccgaagaaccgaaccaaactactaccgaaacgtaaccctcccgttagtactcgtagacaaaagtcggactacgtctaggacctaccgtagacgtaccgaacccgtaccccgtacgtttacgttaagtttagttacggtaggttaagggtaaacgggtcgggtttaggttaaggggaaccggttagtaaaccggttccggaaccccggtttacccggggaacccccgtcgggtaacccg

SEQ ID NO: 309506 - DNA, 552 bp, Homo sapiens
  misc_feature: GZ8MTXP02F64EH.25.86.H09.1.454.CMB.2.raw
  modified_base (279)..(279): a, c, t, g, unknown or other
  misc_feature (279)..(279): n is a, c, g, or t
  modified_base (429)..(429): a, c, t, g, unknown or other
  misc_feature (429)..(429): n is a, c, g, or t
tcagactgtacagtcacgaccggtgctcgatttagtgctatagacttgggtttgggggcaggagtcagacccactcaggacaaagcatggacatgagggtccccgctcagctcctggggcttctgctgctctggctcccaggtgccaaatgtgccatccagttgacccagtctccatcctcctgtctgcctctgttcgagacatagtcaccatcacttgtcggctagtcgggtcattggcagtgctttagcctggtatcagcaagaaaccgaggggaanctacctaagctcctgatctttgatcgcctctagtttaggaaagtggacgtccccataccgtaaggttcaggcggcaggtgatcgtaggggacagtatttcactccctacaccatcagcagcctgcagcctagaatattcagactaaactntttagttctaactaacgtaatttaacgacttacctcttccgttcgttacggacgggaagggtaccgtaaaggtagggacaacgtacgaaaacgtaacgtcggtagctagacaacctatttccg

SEQ ID NO: 309507 - DNA, 587 bp, Homo sapiens
  misc_feature: GZ8MTXP02I9888.25.86.H09.1.454.CMB.2.raw
  modified_base (280)..(280): a, c, t, g, unknown or other
  misc_feature (280)..(280): n is a, c, g, or t
  modified_base (349)..(349): a, c, t, g, unknown or other
  misc_feature (349)..(349): n is a, c, g, or t
  modified_base (353)..(353): a, c, t, g, unknown or other
  misc_feature (353)..(353): n is a, c, g, or t
  modified_base (366)..(366): a, c, t, g, unknown or other
  misc_feature (366)..(366): n is a, c, g, or t
  modified_base (386)..(386): a, c, t, g, unknown or other
  misc_feature (386)..(386): n is a, c, g, or t
tcagactgtacagtcacgaccggtgctcgatttagtgctatagacttggggtttgggggagtcagacccactcaggacacagcatggacatgagggtccccgctcagctcctggggcttctgctgctctggctcccaggtgccaaatgtgccatccagttgacccagtctccatcctccctgtctgcctctgttcgagacatagtcaccatcacttggtcgggctaggtcgggtcattggcagtgctttagcctggtatcagcaagaaaccgaggggacnctaccgtaagctcctgtatcttgatcgtcctcgtaggtttggaaagtcggacgtccatcagtcagcgangtgntcggtggacagtnttcatcctacacatcagcancctgcagtcctaggactatcgcacctaaacgtttattacttacgtaacctaaattaaacgtttaacgtaacctttacccctcttaaccgtcccggttacgggacgggtaacggggaaccgtaaaggggtcggaaacggtactaaaccgtaaaccggtagtgggtaccggtaacttcggacctaacccgtagttcgtttacg

SEQ ID NO: 309508 - DNA, 625 bp, Homo sapiens
  misc_feature: GZ8MTXP02I1DTA.25.86.H09.1.454.CMB.2.raw
  modified_base (197)..(197): a, c, t, g, unknown or other
  misc_feature (197)..(197): n is a, c, g, or t
tcagactgtacagtcacgaccggtgctcgatttagtgctatagacttgggtttgggggagtcagacccactcaggacacagcatggacatgagggtccccgctcagctcctggggcttctgctgctctggctcccaggtgccaaatgtgccatccagttgacccagtctccatcctccctgtctgcctctgttcganacatagtcaccatcacttgtcgggctaggtcgggtcagttggcagtgctttagcctggtatcagcagaaaccgaggggaagctaccgtaagctcctgatcttgatcgcctcagtttaggaaagtggacgtcccatacaaggttcagcgcaggtgatcgtgggacagtattcatcctacactatcacgacacgctagccagaccgtagaatcttacgacgtacctaaacctttatttacttagttaacctaaaacttaacgtttaaacggtacctttaacccccgttcgttaccctttaccccggttacgggtaccggggtacgggtaaaccccggtaagggtttaacgggaaacggtaacgtaaaccgtaaaacggtaacgtaaccggtaggtccgttaccggacgaccccgttattaccggtttccg

SEQ ID NO: 309509 - DNA, 645 bp, Homo sapiens
  misc_feature: GZ8MTXP02G5NB8.25.86.H09.1.454.CMB.2.raw
  modified_base (333)..(333): a, c, t, g, unknown or other
  misc_feature (333)..(333): n is a, c, g, or t
tcagactgtacagtcacgaccggtgctcgatttagtgctatagacttgggtttggggagctctgggaaaggagccccagccctgagattcccaggtgattccattcggtgatcagcactgaacacagaactcaccatggagtttggactgagcttgggttttccttgttgcctaattttaaaaggtgtccagtgtgaagtgcaactggtggagtcgtgggggagccgtggtacgacggccggggggtcctgagactctcctgtgtagcctcgtggattcattgttgatgattatgccatgcacgtggtccgtcgaagggtccggggaaggtcngggagtgggtctctgttacgtgtacttgggatccggggaagaagtaaccgtatacgtaggctggactcgtggtgaaggggtccgtagttaccaaccaccgttacccgagtacgaacaaccaattaccgaaagtaacctcccgtagtaactcgtacgaactaaggtacggacacggttacacgaacctaccgttagacttacgaccgtaaccgtccctttacggtatttagtgttacggtaaggtaacgggcgttagtttacgggaaggttacgaaacgttcggaccgttaccggacccccggacgggtaccg

SEQ ID NO: 309510 - DNA, 584 bp, Homo sapiens
  misc_feature: GZ8MTXP02ITX3L.25.86.H09.1.454.CMB.2.raw
  modified_base (280)..(280): a, c, t, g, unknown or other
  misc_feature (280)..(280): n is a, c, g, or t
tcagactgtacagtcacgaccggtgctcgatttagtgctatagacttgggtttgggggagtcagacccactcaggacacagcatggacatgagggtccccgctcagctcctggggcttctgctgctctggctcccaggtgccaaatgtgccatccagttgacccagtctccatcctccctgtctgcctctgttcgagacatagtcaccatcacttgtcgggctagtcgggtcattggcagtgtctttagccttggtatcagcaagaaaccgaggggaacnctactaagctcctgtatctttgatgcctctagtttggaaagtggagtcccatcaagtcagcgcagtgatcgtgggacagtatttcatcctcaccatcacgtcacgctagcacgcctagaagtacttctagtacctaaacctttatttacgtagtaacctaaaacttaacgttttaaacgtactttaaccccgttcttccgttaccgttaccggggtacgggaacgggaaaccgtaaggggttacgaaagtacgtaaccgtaaaacgtaacgtggtacggtacctacgaccgaactactacttcg

SEQ ID NO: 309511 - DNA, 702 bp, Homo sapiens
  misc_feature: GZ8MTXP02F30TK.25.86.H09.1.454.CMB.2.raw
  modified_base (301)..(301): a, c, t, g, unknown or other
  misc_feature (301)..(301): n is a, c, g, or t
tcagactgtacagtcacgaccggtgctcgatttagtgctatagacttggggtttgggggcaggagtcagacccactcaggacacagcatggacatgagggtccccgctcagctcctggggcttctgctgctctggctcccaggtgccaaatgtgccatccagttgacccagtctccatcctccctgtctgcctctgttcgagacatacgtcaccatcattggtcggctaggtcgggtcagttggcagtgtcgtttacgccgttggtactacgacgacgaaagaaaacccggaggggaaacncctacccgtaaagcttccgtgtaactttccttgacttcgtaccctacgtagggtttaacggaaaagggtcggtaaaccgtaccctaagttaacgtaaacgggtttacgaaacggggtccggacgtaaggggttggggtaacttcggtaacgggggtaaacctaggttaaacttttaccactttaccccgacctaacccgtaatacgaacgtaccgtaaactccccgttagacgtacgccgtaagtaaaccgtgttcaacgtacctaaaccttagtttatacgtactaaacgtaatttacgtaaccttacctcgttaccttaccggttacggacggtaaacgggacgtaacggtagaacgtactaaccgaaaggtcttaggacggtctaccggatacccgta

SEQ ID NO: 309512 - DNA, 772 bp, Homo sapiens
  misc_feature: GZ8MTXP02FKGWT.25.86.H09.1.454.CMB.2.raw
  modified_base (300)..(300): a, c, t, g, unknown or other
  misc_feature (300)..(300): n is a, c, g, or t
  modified_base (470)..(470): a, c, t, g, unknown or other
  misc_feature (470)..(470): n is a, c, g, or t
tcagactgtacagtcacgaccggtgctcgatttagtgctatagacttgggtttgggggcaggagtcagacccactcaggacacagcatggacatgagggtccccgctcagctcctggggcttctgctgctctggctcccaggtgccaaatgtgccatccagttcgacccagtctccatcctccctgtctcgcctctgttcgagactatacgtccaccatctacgttggtcggctaggtcgggtcagttggcagtgtctttagccgttggtatcgagacgaacgaaaaccggaggggaacncctaccgtaagcctccgtgtacttcgtttagcgtcgtcccgtacgtaggtttagggtaaaggtggtaaccgttacctaacgtaccgtaaacggttcgaacggtccggtacgagggtgtaacgtcggtacgggacgtagttactttaccacctttacccactaaacccgtntaacgacggaccgtacgtccccgtaggacctaccgtacgttaagtaaaacgttccttacgtaccgtaaaccttaaaccttttagtttaaactttaccgtaaaacttaaaacgtttaaaagggttttaaccgtaaccctttaccccgttccgttaccgtttacccggggtttaccgggggaaacggaaaccggggtttaacccggaaaagggtttacggaaaacggtaacctttaaaaccccgggaaaaagttacccgggtttggaaaccgggttccacgggtaaacccgtactttaacccgg

SEQ ID NO: 309513 - DNA, 717 bp, Homo sapiens
  misc_feature: GZ8MTXP02HXVZI.25.86.H09.1.454.CMB.2.raw
  modified_base (292)..(292): a, c, t, g, unknown or other
  misc_feature (292)..(292): n is a, c, g, or t
tcagactgtacagtcacgaccggtgctcgatttagtgctatagacttggggtttggggggcaggagtcagacccactcaggacacagcatggacatgagggtcccccgctcagctcctggggcttctgctgctctggctcccaggtgccaaatgtgccatccagttgacccagtcctccatccctccctgtctgcctctgttcgagacatagtcaccatcacttgcgggctaggtcgggtcagttggctagtgtcttagcctggtatacgagacaagaaaccggaggggaancctaccgtaagccttacctgtattcgtttgactcgtccctacgttaggtttaggaaagtggtacgtaccatacgaacggttcaacggtcggacgtagtcggtagtcgtgggaactagttacttactacgtccctacaaccgtatccgagacctacgtccctaggacccgtacgtaccgtaagtaaaacgttcgtttaaccgtacgttaaccttaaacccttttaagtttaacttacgtaaaccttaaaaacgtttaaacggtttaaaccggttaaccctttacccccttacgttaccccgtttacccggggtaccgggggtaaccggggtaaaccgggtaaaccggtaaaggggttaacggacgtaaacgtaaaccggtaaaaacgttaccgtagggtccggtactacggtacccttaccgtacg

SEQ ID NO: 309514 - DNA, 497 bp, Homo sapiens
  misc_feature: GZ8MTXP02HN4PS.25.86.H09.1.454.CMB.2.raw
  modified_base (190)..(190): a, c, t, g, unknown or other
  misc_feature (190)..(190): n is a, c, g, or t
  modified_base (199)..(199): a, c, t, g, unknown or other
  misc_feature (199)..(199): n is a, c, g, or t
  modified_base (213)..(213): a, c, t, g, unknown or other
  misc_feature (213)..(213): n is a, c, g, or t
  modified_base (216)..(216): a, c, t, g, unknown or other
  misc_feature (216)..(216): n is a, c, g, or t
  modified_base (226)..(226): a, c, t, g, unknown or other
  misc_feature (226)..(226): n is a, c, g, or t
  modified_base (281)..(281): a, c, t, g, unknown or other
  misc_feature (281)..(281): n is a, c, g, or t
  modified_base (324)..(324): a, c, t, g, unknown or other
  misc_feature (324)..(324): n is a, c, g, or t
  modified_base (341)..(341): a, c, t, g, unknown or other
  misc_feature (341)..(341): n is a, c, g, or t
  modified_base (477)..(497): a, c, t, g, unknown or other
  misc_feature (477)..(497): n is a, c, g, or t
tcagactgtacagtcacgaccggtgctcgatttagtgctatagacttgggtttgggagaagaacctactatgcagactctgtgaagggtcgattcaccacctccagagacaacatcaagaacctccctgtatctgacaaatggacagtctgacacctgatgacaccgtcttgtattattgtgtagaaggngtgtgagtnatgctcggacccgngtnagcacttctntacgagtcgggcgtcggtggggaacgaaaggggtactacgtcatccgtcttccgnacgccctacgaaccgaacggtcccagttcccgtccttccccgngccgccctgccgtacgnggacgcctaccgccgagcgcacgccggtccgcccgtggcgttcgaccgtagggtcaaacgtaccttaccttaccggtaccttaggaccttagggcgtacgacggacgggtcggacggacgacggaccgacgagagnnnnnnnnnnnnnnnnnnnnn

SEQ ID NO: 309515 - DNA, 783 bp, Homo sapiens
  misc_feature: GZ8MTXP02HE45E.25.86.H09.1.454.CMB.2.raw
  modified_base (289)..(289): a, c, t, g, unknown or other
  misc_feature (289)..(289): n is a, c, g, or t
tcagactgtacagtcacgaccggtgctcgatttagtgctatagacttgggtttgggggcaggagtcagacccactcaggacacagcatggacatgagggtccccgctcagctcctggggcttctgctgctctggctcccaggtgccaaatgtgccatccagttgacccagtcctccatcctcctgtctgcctctgttcgagacatagtcaccatcacttgtcggctaggtcgggtcagttggcagtgtcttagcctggtatcgagacgaacggaaaccgagggggaacnccttaccgtaaacgccgttacccgtaggtaacttcgtttagtaacgttccggtacccgtttaccgttaaggttttacgggaaaaaggttcggggtaaccttaccccgtaagttaccggtaaacgggtttccgaacgggtcggtaaccgtaagggtcgggtaacgttcggtacgggggttaaccagggtttaaacgtttcctaaaccgttccccgttaacgaaacccgtttaactaccgtaaaacggcccgtaaacggttccccgtagggacccttaaacggcccgttaaagggtaaacgttacctttacgacggttaaccgtaaacccgttttatttaaacggttacgtaaaccttaaaacgttaaaggttttaaacggtacccttttacctaaccgttcggttaccggttacgggacgggtaacggtaaccgaacggtagtaacgtacgtaaacaaccgtaaagtcggtacggtactccgaaacctcgttacg

SEQ ID NO: 309516 - DNA, 776 bp, Homo sapiens
  misc_feature: GZ8MTXP02JSFA1.25.86.H09.1.454.CMB.2.raw
  modified_base (747)..(747): a, c, t, g, unknown or other
  misc_feature (747)..(747): n is a, c, g, or t
  modified_base (754)..(754): a, c, t, g, unknown or other
  misc_feature (754)..(754): n is a, c, g, or t
  modified_base (765)..(765): a, c, t, g, unknown or other
  misc_feature (765)..(765): n is a, c, g, or t
tcagactgtacagtcacgaccggtgctcgatttagtgctatagacttggggtttgggggagtcagacccactcaggacacagcatggacatgagggtccccgctcagctcctggggcttctgctgctctggctcccaggtgccaaatgtgccatccagttcgacccagtctccactcctcctgtcctcgcctctgttcgagacatacgtcaccatctacgttggtcgggctacggtcgggtcagttggctagtgtcttagccgttggtatcagacgaacgaaaccggaggggacacctaccgtaacgtcctcctgtctttccgttagtacgtccgtacccgttaccgtttaagggtttaacggtaacggttacggtaaccgttacccctaaggttaccggtaacggttaccgacggtaccggtaccgttagggtacggtacgttccgggtacggggaacgttaaggttaaccctttcgtacccttcccgttaacccaaccgttaccgtaccgaaacgtcccgtaacggggtcccttaacggggtccaaacgggttcccgtaaagttacggttaccttaccgtaaccgtacctttaacccgttaagtttcttaacggttaaccaaaacgttttaaaggtttacctaccctttacccgttccgttaccggttcccggacggggttaccggggaaaacggtaccggacggtttaacggactaaaccgttaccgaaagtccgaagggtacncggtacncgtacccgttntacggtttccc

SEQ ID NO: 309517 - DNA, 490 bp, Homo sapiens
  misc_feature: GZ8MTXP02F2QXD.25.86.H09.1.454.CMB.2.raw
  modified_base (268)..(268): a, c, t, g, unknown or other
  misc_feature (268)..(268): n is a, c, g, or t
  modified_base (275)..(275): a, c, t, g, unknown or other
  misc_feature (275)..(275): n is a, c, g, or t
  modified_base (286)..(286): a, c, t, g, unknown or other
  misc_feature (286)..(286): n is a, c, g, or t
  modified_base (341)..(341): a, c, t, g, unknown or other
  misc_feature (341)..(341): n is a, c, g, or t
  modified_base (351)..(351): a, c, t, g, unknown or other
  misc_feature (351)..(351): n is a, c, g, or t
  modified_base (373)..(373): a, c, t, g, unknown or other
  misc_feature (373)..(373): n is a, c, g, or t
  modified_base (375)..(375): a, c, t, g, unknown or other
  misc_feature (375)..(375): n is a, c, g, or t
tcagactgtacagtcacgaccggtgctcgatttagtgctatagacttgggtttgggggagtcagacccactcaggacacagcatggacatgagggtcccgctcagctcctggggcttctgctgctctggctcccaggtgccaaatgtgccatccagttgacccagtctccatcctccctgtctgcctctgttcgagacatagtcaccatcacttgtcgggctagtcgggtcattggcagtgctttagcctggtatcagcagaaaaccnggggaanctcaagctctnatcttgatgcctcagtttggaaagtggatccatcgaagttcagcgcagtggatgnggacagattntatctcacactacagcagctcncngactagagatactgacaactattattagtactaactaaattaagtaactacctactctctcgtacggacggacgaacgagacgacacaacgaactgtgactcgacacactactcg

SEQ ID NO: 309518 - DNA, 676 bp, Homo sapiens
  misc_feature: GZ8MTXP02GDHQR.25.86.H09.1.454.CMB.2.raw
  modified_base (277)..(277): a, c, t, g, unknown or other
  misc_feature (277)..(277): n is a, c, g, or t
  modified_base (388)..(388): a, c, t, g, unknown or other
  misc_feature (388)..(388): n is a, c, g, or t
tcagactgtacagtcacgaccggtgctcgatttagtgctatagacttggggtttgggggcaggagtcagacccactcaggacacagcatggacatgagggtccccgctcagctcctggggcttctgctgctctggctcccaggtgccaaatgtgccatccagttgacccagtctccatcctccctgtctgcctctgttcgagacatagtcaccatcacttgcgggctagtcggtcattggcagtgctttagcctggtatcagcagaaaccagggganctacctaagctacctgatctttagatgccctaccgagtttacggaaaagtggagtcccgatcaaaggttcaaggtcggacagtggaatcgtagggacagatttcatccctnaccagtcagcagcccgcaagtccctagaaaggtactttaccagtacctaaaacccttaatttacggtttacgtaaccgtaaaaccgtaaatttttaaaacgggacttttaaaacccccttacggttccctttaccccggtttacgggggaacccggggttaaaacgggggaaacccccgttaaaaagggggttacgggaaaagggttaaactaaacctaaaaaaccgggaaaacccgtaacggtttaacgggtaccggtacgtaccgtaaacccgaaaacgtttaccg

SEQ ID NO: 309519 - DNA, 817 bp, Homo sapiens
  misc_feature: GZ8MTXP02G5VR9.25.86.H09.1.454.CMB.2.raw
  modified_base (224)..(224): a, c, t, g, unknown or other
  misc_feature (224)..(224): n is a, c, g, or t
  modified_base (278)..(278): a, c, t, g, unknown or other
  misc_feature (278)..(278): n is a, c, g, or t
  modified_base (287)..(287): a, c, t, g, unknown or other
  misc_feature (287)..(287): n is a, c, g, or t
tcagactgtacagtcacgaccggtgctcgatttagtgctatagacttgggtttgggggagtcagacccactcaggacacagcatggacatgagggtccccgctcagctcctggggcttctgctgctctggctcccaggtgccaaatgtgccatccagttgacccagtctccatcctccctgtctgcctctgttcgagacatacgtcaccatcacttggtcgggnttaggtcgggtcagttggctagtgtctttagcctggtatcacgcaagaaaccgnggggaaacncctacctaacggtctccctaggtactttcgtttagacttcgcccgtttaccgtaaagggttttaggtaaaaacgggttcgggtaaacggttacccctaagttaccggtaaaggtttccgaagggtcgggtaccaaggggttggacgttaccgggtagggggaactaacggttacgtttccctaaacgttcccccttacccaacccttaacgtaaccgacgaccgtaccgtcccgtaccgaccgtacgtaccgtaacgtaacgttaacttaccgtaaccgttaaccttaaacgtttaacgtttaacgtttaacgttaaaccgttaaaaccgtttaaaacgtttaaaccgtttaacccgtttaaccccgtttacccgtttacccgttacccggttacccggggtaaccgggtaaaccggggtaaacccggtaaacgggtaacgggtaaacggtaaaccgtaaaccggtaaaaccggtaacggttaacggtacggtaccgtaccgtaccgtaccgttaccgttaccgttaccg

SEQ ID NO: 309520 - DNA, 517 bp, Homo sapiens
  misc_feature: GZ8MTXP01D7FST.13.72.G06.1.454.CMB.2.raw
  modified_base (260)..(260): a, c, t, g, unknown or other
  misc_feature (260)..(260): n is a, c, g, or t
  modified_base (386)..(386): a, c, t, g, unknown or other
  misc_feature (386)..(386): n is a, c, g, or t
  modified_base (454)..(454): a, c, t, g, unknown or other
  misc_feature (454)..(454): n is a, c, g, or t
tcagtcacgtactacacgaccggtgctcgatttagctacgactgcaagggaaaggggttgtgtccaccatggcctggactcctctcctcctcctgctcctctctcactgcacaggttccctctcgcaggctgtgctgactcagccgtcttccctctctgcttctcctggagcgtcagccagtctcacctgcaccttgcgcagtggcaccaatgttggtccctatgacatatattggtaccgacagaagccagggagtccnccccagttctcctgaggttcaggtcaactcagataaacgacagggctctggagtccccagccgcttctctggactccaaggatgattcccgcaacgcagggatatactcatctctgggctcagtcngacgatgagctgactattactggtttgactttggcacaacaacgctaggatcgttcggctgggaaccncgggttcaccgttctaaggtcacgcccaacggcccaacccaactcgtccactcttcgttcccc

SEQ ID NO: 309521 - DNA, 525 bp, Homo sapiens
  misc_feature: GZ8MTXP01DWVEY.13.72.G06.1.454.CMB.2.raw
  modified_base (465)..(465): a, c, t, g, unknown or other
  misc_feature (465)..(465): n is a, c, g, or t
  modified_base (504)..(504): a, c, t, g, unknown or other
  misc_feature (504)..(504): n is a, c, g, or t
tcagtcacgtactacacgaccggtgctcgatttagctacgactgcaagggaaagggttgtgtccaccatggcctggactcctctcctcctcctgctcctctctcactgcacaggttccctctcgcaggctgtgctgactcagccgtcttccctctctgcttctcctggagcgtcagccagtctcacctgcaccttgcgcagtggcaccaatgttggtccctatgacatatattggtaccgacagaagccagggagtcctccccagtttctcctgaggttcaggtcaaactcagataaacgacagggctctggacgtccccagccgcttctctggactccaaggatgattcccgccaacgcagggatattactcatctctgggctcagtctgacgatgaggctgactattactgggtttgacttggactacaaacacgcctaggactcgttcggacctgggaaccncggttcaccgttctaggtcacgcccaaggcccaaacccntcgtcactcttcgttaacccc

SEQ ID NO: 309522 - DNA, 501 bp, Homo sapiens
  misc_feature: GZ8MTXP01AI147.13.72.G06.1.454.CMB.2.raw
  modified_base (259)..(259): a, c, t, g, unknown or other
  misc_feature (259)..(259): n is a, c, g, or t
  modified_base (329)..(329): a, c, t, g, unknown or other
  misc_feature (329)..(329): n is a, c, g, or t
  modified_base (343)..(343): a, c, t, g, unknown or other
  misc_feature (343)..(343): n is a, c, g, or t
  modified_base (369)..(369): a, c, t, g, unknown or other
  misc_feature (369)..(369): n is a, c, g, or t
  modified_base (422)..(422): a, c, t, g, unknown or other
  misc_feature (422)..(422): n is a, c, g, or t
  modified_base (484)..(484): a, c, t, g, unknown or other
  misc_feature (484)..(484): n is a, c, g, or t
tcagtcacgtactacacgaccggtgctcgatttagctacgactgcaagggaaaggggttgtgtccaccatggcctggactcctctcctcctcctgctcctctctcactgcacaggttccctctcgcaggctgtgctgactcagccgtcttccctctctgcttctcctggagcgtcagccagtctcacctgcaccttgcgcagtggcaccaatgttggtccctatgacatatattggtaccacagaagccagggagtccnccccagtttctcctgagttcaggtcaaactcagataaacgacagggctctggacgtccccagccgcttcnctggactccaaggntgattccgcaacgcagggatatactnatctctggctcagtctgacgatgaggctgactattactggtttgacttgacanaacacgcctggatcgtcggctgggaaccaggttcaccgttctaggcagcccaggcccaaccnctgcactcttcgtcccc

SEQ ID NO: 309523 - DNA, 722 bp, Homo sapiens
  misc_feature: GZ8MTXP01B6W2U.13.72.G06.1.454.CMB.2.raw
  modified_base (690)..(690): a, c, t, g, unknown or other
  misc_feature (690)..(690): n is a, c, g, or t
tcagtcacgtactacacgaccggtgctcgatttagctacgactgcaagggaaaggggttgtgtccaccatggcctggactcctctcctcctcctgctcctctctcactgcacaggttccctctcgcaggctgtgctgactcagccgtcttccctctctgcttctcctggagcgtcagccagtctcacctgcaccttgcgcagtgcacatgttcgtcctatgacatatagtcggtaccacagaagccgagggacgtccctcccctagtttcctccgtggtacggttcaggtacaaactcaagaactaaacgacgagggctcgtggaccgtccccgagccgtcttcctcgtacgggtacctaccgaaaggtactacgtacgttaaccccgaacccgaacggacgtaaacggggtaattaacgtttacctactaacgttcccgtcggttcggggtaccctttaccgacgggttacgtacgggtaaccgtacgttagggaacgggtccttaggtaactttacgtttacgtttaggggttttacggtacggtttacggacctaaacgtaaaccgaaccgtaccgttacgggtacttcccggttaccgggtacccgtacggggaacccgtacgggttacccgacccggttcgttacggtaccgaccggaccccgaacgggaacccccaaccccgtnttccgccttaccttcccgttccgttaaccccc

SEQ ID NO: 309524 - DNA, 602 bp, Homo sapiens
  misc_feature: GZ8MTXP01DZRI2.13.72.G06.1.454.CMB.2.raw
tcagtcacgtactacacgaccggtgctcgatttagctacgactgcaagggaaaggggttgtgtccaccatggcctggactcctctcctcctcctgctcctctctcactgcacaggttccctctcgcaggctgtgctgactcagccgtcttccctctctgcttctcctggagcgtcagccagtctcacctgcaccttgcgcagtggcaccaatgttggtccctatgacatatattggtaccacagaagccagggagtcctccccagtttctcctgaggttcaggtcaaactcagataaacgacaggctctggacgtccccagccgcttctctggactccaaggatcgacttcccgacaacgcagggtatatactcatctcgtggctcgagtctgacgtatgagctgtactattacgtggtttacgactttggactaacaaccgtaacgccgttacgggaacttccgttaccgggtaacccgttcggggaacccctacggggttacccgacccggttccgtaaacgggtccaaccggccccaacgggtcccctaaaccccgaacgttccggtaccttacccgttccgttccggtttaacccccc

SEQ ID NO: 309525 - DNA, 716 bp, Homo sapiens
  misc_feature: GZ8MTXP01ERGEB.13.72.G06.1.454.CMB.2.raw
  modified_base (258)..(258): a, c, t, g, unknown or other
  misc_feature (258)..(258): n is a, c, g, or t
tcagtcacgtactacacgaccggtgctcgatttagctacgactgcaagggaaaggggttgtgtccaccatggcctggactcctctcctcctcctgctcctctctcactgcacaggttccctctcgcaggctgtgctgactcagccgtcttccctctctgcttctcctggagcgtcagccagtctcacctgcaccttgcgcagtggcaccaatgttgtcctatgacatatattggtaccacagaagccgagggactccnccccagttctctgagtcaggtcaactcagataaacgacaggctcgtggacgtcccagccgtcttctctggactccaaggatgacttcccgaccaacgcgaagggatagttactcattctcgtcgggctccgagttccgtaggaaccgtagttaggaacgggtcttacggtaactttaagtttaccgtttggggttttacggtaaccgtttacgggaccctaaaccgaaaccgtaaacccggtcccgttaggggtaacttccggttacccgggtaacccgttcgggggaaccccttaaaccgggggttcccaaaccccgggtttacccgtttaacggggtaaccccgttaacccgggttaccccccggaaaaccggggtcccccccaaaaaacccccctaaccgtttccggtacccttaaccccgttttccccgtttccccgggttttcccccccccgg

SEQ ID NO: 309526 - DNA, 625 bp, Homo sapiens
  misc_feature: GZ8MTXP01DECSG.13.72.G06.1.454.CMB.2.raw
  modified_base (242)..(242): a, c, t, g, unknown or other
  misc_feature (242)..(242): n is a, c, g, or t
  modified_base (256)..(256): a, c, t, g, unknown or other
  misc_feature (256)..(256): n is a, c, g, or t
  modified_base (343)..(343): a, c, t, g, unknown or other
  misc_feature (343)..(343): n is a, c, g, or t
  modified_base (379)..(379): a, c, t, g, unknown or other
  misc_feature (379)..(379): n is a, c, g, or t
tcagtcacgtactacacgaccggtgctcgatttagctacgactgcaagggaaaggggttgtgtccaccatggcctggactcctctcctcctcctgctcctctctcactgcacaggttccctctcgcaggctgtgctgactcagccgtcttccctctctgcttctcctggagcgtcagccagtctcacctgcaccttgcgcagtggcacatgttcggtcctatgactatatattggtaccganagagcgaggatccncccagttctcctagagttcaggtacaactcagaataaacgacgaggctcgtggacgtcccagccgtcttctcgtgactaccgaaggntcgacttcccgacctaacgcgaagggtatacttacnctatctcgtaggcctaccgagttcgacgtacggtatggagtcctagtaacgtttattaaccgtttggggtttcgtacgtttcggaccaaaccgtaaccgaacgtcccgtagggtacttcggtaccgggtacccgtacgggtaaccgtaccgggttctaaccccggttcgtaacgggtccacggttcccgaaacgggtcctcccggtccccgttcggtccttacccttccgttcccgttaacccccg

SEQ ID NO: 309527 - DNA, 731 bp, Homo sapiens
  misc_feature: GZ8MTXP01EDRMB.13.72.G06.1.454.CMB.2.raw
  modified_base (366)..(366): a, c, t, g, unknown or other
  misc_feature (366)..(366): n is a, c, g, or t
tcagtcacgtactacacgaccggtgctcgatttagctacgactgcaagggaaaggggttgtgtccaccatggcctggactcctctcctcctcctgctcctctctcactgcacaggttccctctcgcaggctgtgctgactcagccgtcttccctctctgcttctcctggagcgtcagccagtcctcacctgcaccttgcgcagtgcaccaattgttcggtcctatgacatatattggtaccacagaacgcgagggactccctcccctagttctcctgtaggttcaggtacaactcaagaactaaacgacgagggtctcgtaggaccgttccccagtccgtcttctcgtaggactacccgaaaggtntcgacttcccgaccaacggtacgaaggggtattaacttactactactctcgtgggtcctaccgtagttccaggaacgtagttaggaacggcttacggtaacttaattttaccgttggggttttcgtaccgtttacgggacctaaaccgtaaacgaacccgttcgttacggtacgtttacccggttaccgggtacccggttccggggtaaaccctacccggggttcccgttaaccccgggttacgtttaaccgggtaacccgaacccgggttacccccgttaaaacccgggtcccccaaaaacccccggtctttacccgggtaaaccaccccgttttcccgttaaaccccggtttttccccccccc

SEQ ID NO: 309528 - DNA, 504 bp, Homo sapiens
  misc_feature: GZ8MTXP02HDW9O.13.72.G06.1.454.CMB.2.raw
  modified_base (346)..(346): a, c, t, g, unknown or other
  misc_feature (346)..(346): n is a, c, g, or t
  modified_base (490)..(490): a, c, t, g, unknown or other
  misc_feature (490)..(490): n is a, c, g, or t
  modified_base (494)..(494): a, c, t, g, unknown or other
  misc_feature (494)..(494): n is a, c, g, or t
tcagtcacgtactacacgaccggtgctcgatttagctacgactgcaagggaaaggggttgtgtccaccatggcctggactcctctcctcctcctgctcctctctcactgcacaggttccctctcgcaggctgtgctgactcagccgtcttccctctctgcttctcctggagcgtcagccagtctcacctgcaccttgcgcagtggcaccaatgttggtccctatgacatatattggtaccgacagaagccagggagtcctccccagtttctcctgaggttcaggtcaaactcagataaacgacagggctcgtggacgtccccagccgcttctctggactccaaggntgactccgcacgcagggatatactcatctcgtggcctcagtctgacgatgaggctgactattactgttgacttggcaacaacacgcctggactcgttcggactcgggaccacggtcaccgtcacggtcacgccaagccaacccnctcncactctctcc

SEQ ID NO: 309529 - DNA, 647 bp, Homo sapiens
  misc_feature: GZ8MTXP02JXPLO.13.72.G06.1.454.CMB.2.raw
  modified_base (366)..(366): a, c, t, g, unknown or other
  misc_feature (366)..(366): n is a, c, g, or t
tcagtcacgtactacacgaccggtgctcgatttagctacgactgcaagggaaaggggttgtgtccaccatggcctggactcctctcctcctcctgctcctctctcactgcacaggttccctctcgcaggctgtgctgactcagccgtcttccctctctgcttctcctggagcgtcagccagtctcacctgcacctgcgcagtggcacaatgttcggtcctatgactatatattcggtaccacagaacgccagggacgtccctcccctagttcctccgtgaggttcaggtacaaactcaagaataaacgacagggcctcgtcggacgtccccaggcccgtacttctcgtaggacctaccgaaaggtntacgacttcccgaccacggcgaaggggtacttactaacctctattccgtcgtcggggtccttccggagttccgaggacgtagtcggacggtctacgtaactttaagtttacgtttggtttacgacgttcgggaccaaacaaaccgacgtccgtaggtacttccggttaccgggacgtacggggtaaccctaccgggtccgacccggttacgtacgggtaccaccggaccccgaacggaaccccaacccgtactcggtaccaccgttcgtcccggttccccg

SEQ ID NO: 309530 - DNA, 414 bp, Homo sapiens
  misc_feature: GZ8MTXP02GYA3H.13.72.G06.1.454.CMB.2.raw
  modified_base (212)..(212): a, c, t, g, unknown or other
  misc_feature (212)..(212): n is a, c, g, or t
  modified_base (285)..(285): a, c, t, g, unknown or other
  misc_feature (285)..(285): n is a, c, g, or t
  modified_base (288)..(288): a, c, t, g, unknown or other
  misc_feature (288)..(288): n is a, c, g, or t
  modified_base (314)..(314): a, c, t, g, unknown or other
  misc_feature (314)..(314): n is a, c, g, or t
  modified_base (318)..(318): a, c, t, g, unknown or other
  misc_feature (318)..(318): n is a, c, g, or t
  modified_base (321)..(321): a, c, t, g, unknown or other
  misc_feature (321)..(321): n is a, c, g, or t
  modified_base (328)..(328): a, c, t, g, unknown or other
  misc_feature (328)..(328): n is a, c, g, or t
  modified_base (395)..(395): a, c, t, g, unknown or other
  misc_feature (395)..(395): n is a, c, g, or t
  modified_base (410)..(414): a, c, t, g, unknown or other
  misc_feature (410)..(414): n is a, c, g, or t
tcagtcacgtactacacgaccggtgctcgatttagctacgactgcaagggaaaggggctgcagtgggtcgccactattggtgataatggcagaaacatttactacgcagactccgtgaggggccgcttcaccatctccagagacaattcacggaacacattgtttttacaaattgtcggcctgcgggcgaggacacggccaaatatttttgngtaaaggatcaatataccagtttggtcgaagtccgtgccttttgactctgggccagggacctggtcaccgtcnccncagctccacaggcccatcgctccccnggcnccngctcagncacctcgtggggcacagcggcctgggcctgcctgtcaaggctacttccagtacgtgactgagcgggntgcaaggcgcatagnnnnn

SEQ ID NO: 309531 - DNA, 486 bp, Homo sapiens
  misc_feature: GZ8MTXP01EA6RG.51.38.D05.1.454.CMB.2.raw
  modified_base (349)..(349): a, c, t, g, unknown or other
  misc_feature (349)..(349): n is a, c, g, or t
  modified_base (422)..(422): a, c, t, g, unknown or other
  misc_feature (422)..(422): n is a, c, g, or t
  modified_base (426)..(426): a, c, t, g, unknown or other
  misc_feature (426)..(426): n is a, c, g, or t
  modified_base (436)..(436): a, c, t, g, unknown or other
  misc_feature (436)..(436): n is a, c, g, or t
  modified_base (442)..(442): a, c, t, g, unknown or other
  misc_feature (442)..(442): n is a, c, g, or t
  modified_base (447)..(447): a, c, t, g, unknown or other
  misc_feature (447)..(447): n is a, c, g, or t
  modified_base (449)..(449): a, c, t, g, unknown or other
  misc_feature (449)..(449): n is a, c, g, or t
  modified_base (456)..(456): a, c, t, g, unknown or other
  misc_feature (456)..(456): n is a, c, g, or t
  modified_base (479)..(479): a, c, t, g, unknown or other
  misc_feature (479)..(479): n is a, c, g, or t
tcagcgatcgtatacacgaccggtgctcgatttagtatctgatagttgggtttggggaggcgtggtccagcctgggaggtccctgagactcgcctgtaaaccgtccggattcaccttcagtaactatgcaatgcactgggtccgccaggctccaggcaaggggctggactgggtggcaggcatatcatttgatggaagcaagaagtactatgcagactccgtgaagggccgattcaccatctccagagacagttccgatgacacagtcatctacacatgagcagtgtgagacctgacgacacggcttcttttttactgtgcgccaggaagcagtggctggccacaatcntgtcttttgattatctggagccaagggacaagtggtcatcgtctcttcgcctcacaggccagtcgtctccccngccncctctcagcncactcngggcncngcgccgngggcttgcttggtcaggctctcncgtgctc

SEQ ID NO: 309532 - DNA, 504 bp, Homo sapiens
  misc_feature: GZ8MTXP01CWVDE.51.38.D05.1.454.CMB.2.raw
  modified_base (360)..(360): a, c, t, g, unknown or other
  misc_feature (360)..(360): n is a, c, g, or t
  modified_base (413)..(413): a, c, t, g, unknown or other
  misc_feature (413)..(413): n is a, c, g, or t
  modified_base (431)..(431): a, c, t, g, unknown or other
  misc_feature (431)..(431): n is a, c, g, or t
  modified_base (494)..(494): a, c, t, g, unknown or other
  misc_feature (494)..(494): n is a, c, g, or t
tcagcgatcgtatacacgaccggtgctcgatttagtatctgatagttgggtttgggggaggcgtggtccagcctgggaggtccctgagactcgcctgtaaaccgtccggattcaccttcagtaactatgcaatgcactgggtccgccaggctccaggcaaggggctggactgggtggcaggcatatcatttgatggaagcaagaagtactatgcagactccgtgaaggccattcaccatctcagagacagttccgatgacacagtcatctacacatgagcagtgtgagacctgacgacacggctctttttactgtgcgcagagcagtggctggccacaatcaatgcttttgatatctganccaaggacaatggtcatcgtctctcggcctcacaggcccagtcgtcttccccngccaccctcctcaaacgngccacctcgtcggggcacgagccgcccgtgggcttcgccttgggtcaaaggtcctacgttccncggtcgctcg

SEQ ID NO: 309533 - DNA, 540 bp, Homo sapiens
  misc_feature: GZ8MTXP01BJB26.51.38.D05.1.454.CMB.2.raw
  modified_base (239)..(239): a, c, t, g, unknown or other
  misc_feature (239)..(239): n is a, c, g, or t
  modified_base (456)..(456): a, c, t, g, unknown or other
  misc_feature (456)..(456): n is a, c, g, or t
tcagcgatcgtatacacgaccggtgctcgatttagtatctgatagttgggtttgggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctctgcactgggaccagcggtgacattggtntttataactatgtctctggtaccagcaccacccaggacaaacgcccccaaactcatgatttatgatgtcagtgatcggcctgtaggggtttcaatcgccttctctggctccaaagtcccggcaacaccggccctccctgaccatctctggccctccgaggccgaggacgaggctgattatactgcaggctcatatacaatcaagtaaacagttgggngttcgggcggaaggaaccaagtcgacccgtacgtaggttcacgacccaaggccgtcgcccccgtcggcctaaccttcgttcccg

SEQ ID NO: 309534 - DNA, 586 bp, Homo sapiens
  misc_feature: GZ8MTXP01ED7XI.51.38.D05.1.454.CMB.2.raw
  modified_base (249)..(249): a, c, t, g, unknown or other
  misc_feature (249)..(249): n is a, c, g, or t
  modified_base (306)..(306): a, c, t, g, unknown or other
  misc_feature (306)..(306): n is a, c, g, or t
tcagcgatcgtatacacgaccggtgctcgatttagtatctgatagttgggtttgggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcacgtgggaccagcggtgactagttggtntttaataactatgtctctgaccagcaccaccagacaaacgccccaatcatgatttangatgtcagtgagtcggcctcgtaggggttcaactcgtcttctctggcctaccgaacgtcccggacaaaccgaccggccctccctacgaccctattcctcgtcggccctccgaggaccggaggaccgaggctagtattatacgtggcagctacaatactacaatacaaataactaagttgggtcgtttaacgggacggacgggtaaaccaaacgtcggtaaccgttaccgttaggccaacggacccaacgggctcccgcccccgtcggttcccgtaacccg

SEQ ID NO: 309535 - DNA, 554 bp, Homo sapiens
  misc_feature: GZ8MTXP01EXQWC.51.38.D05.1.454.CMB.2.raw
  modified_base (243)..(243): a, c, t, g, unknown or other
  misc_feature (243)..(243): n is a, c, g, or t
tcagcgatcgtatacacgaccggtgctcgatttagtatctgatagttgggtttgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactgggaccagcggtgactattggtntttataactatgtctcctggtaccagcaccacccaggcaaacgcccccaaatcatgatttatgatgtcagtgatcggcctgaggggtttcgaatcgccttctctggcctccaaacgtccggcaaacgaccggccctccctacgaccatctcgtcggcctaccgaggccgaggacgaggtctgtattatactgcagctcatatacaatacaaataactaagtggtgtcggagggaacggtaacaaacgtcgttaccgtcgtaacgttcgcgacccaagggctccgccccgtcggttacctccgttcttcccg

SEQ ID NO: 309536 - DNA, 575 bp, Homo sapiens
  misc_feature: GZ8MTXP01EO48F.51.38.D05.1.454.CMB.2.raw
tcagcgatcgtatacacgaccggtgctcgatttagtatctgatagttgggtttgggggaggcgtggtccagcctgggaggtccctgagactcgcctgtaaaccgtccggattcaccttcagtaactatgcaatgcactgggtccgccaggctccaggcaaggggctggactgggtggcaggcatatcatttgatggaagcaagaagtactatgcagactccgtgaagggccgattcaccatctccagagacagttccgatgacacagtctatctacacatgagcagtgtgagacctgacgacacggtcttctttttactgtgcgccaggaagcagtggctggccacaatcaatgtcttttgattatcgtgggagaccgaaagggacaagtggtcattcgtctcttcggcctccaccgaacgggcccaggtccggttccttcccctggccacccctcctccaacgcgccaccgtcgtcgggggccacgacggccggcccgtcggggccttcggcccgttcgggttaaccaaacggggtccttaacccggtttccttaccggttaacgcctaacccg

SEQ ID NO: 309537 - DNA, 530 bp, Homo sapiens
  misc_feature: GZ8MTXP01EQAM9.51.38.D05.1.454.CMB.2.raw
  modified_base (246)..(246): a, c, t, g, unknown or other
  misc_feature (246)..(246): n is a, c, g, or t
tcagcgatcgtatacacgaccggtgctcgatttagtatctgatagttgggtttgggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactgggaccagcggtgacattggtntttataactatgtctctggaccagcaccaccaggcaaacgcccccaaatcatgatttatgatgtcagtgatcggccctcgaggggtttcaactcgcttctctggctccaagtccggcaacacggcctccctgacccatctctcggcctccaggcccgaggacgaggctgattattactggcagctcatatacaatacaaataacaagttgggtgttcggcggagggaccaaacgtcgaccgttcgttaggttcaagcccaaggctcgcccctcggttctaaccg

SEQ ID NO: 309538 - DNA, 515 bp, Homo sapiens
  misc_feature: GZ8MTXP01CNTHK.51.38.D05.1.454.CMB.2.raw
  modified_base (315)..(315): a, c, t, g, unknown or other
  misc_feature (315)..(315): n is a, c, g, or t
  modified_base (426)..(426): a, c, t, g, unknown or other
  misc_feature (426)..(426): n is a, c, g, or t
  modified_base (430)..(430): a, c, t, g, unknown or other
  misc_feature (430)..(430): n is a, c, g, or t
tcagcgatcgtatacacgaccggtgctcgatttagtatctgatagttgggtttgggggaggcgtggtccagcctgggaggtccctgagactcgcctgtaaaccgtccggattcaccttcagtaactatgcaatgcactgggtccgccaggctccaggcaaggggctggactgggtggcaggcatatcatttgatggaagcaagaagtactatgcagactcgtgaaggccattcaccatctccagagacagttccgatgacacagtcatctacacatgagcagtgtgagacctgacgacacggcttcttttttacngtgcgccaggagcagtggctggccacaatcaatgtctttgatatctggagaccaagggacaaagtggtcatcgtctctcggcctccaccaaggccagtcgtctccctgccncccncctcaagcgccacctcgtgggggcacgcggccgccggcgtcgcgttcgttacgtaacgaacgtcttcctcttacgcgttaactcg

SEQ ID NO: 309539 - DNA, 512 bp, Homo sapiens
  misc_feature: GZ8MTXP01CJ03X.51.38.D05.1.454.CMB.2.raw
  modified_base (313)..(313): a, c, t, g, unknown or other
  misc_feature (313)..(313): n is a, c, g, or t
  modified_base (326)..(326): a, c, t, g, unknown or other
  misc_feature (326)..(326): n is a, c, g, or t
  modified_base (451)..(451): a, c, t, g, unknown or other
  misc_feature (451)..(451): n is a, c, g, or t
  modified_base (457)..(457): a, c, t, g, unknown or other
  misc_feature (457)..(457): n is a, c, g, or t
  modified_base (465)..(465): a, c, t, g, unknown or other
  misc_feature (465)..(465): n is a, c, g, or t
tcagcgatcgtatacacgaccggtgctcgatttagtatctgatagttgggtttggggaggcgtggtccagcctgggaggtccctgagactcgcctgtaaaccgtccggattcaccttcagtaactatgcaatgcactgggtccgccaggctccaggcaaggggctggactgggtggcaggcatatcatttgatggaagcaagaagtactatgcagactcgtgaaggccattcaccatctcagagacagttccgatgacacagtcatctacacatgagcagtgtgagacctgacgacacggcttcttttttacngtgcgccaggaancacgtggctggccacaatcaatgtcttttgatatctggacgtccaaagggacaaagtggtacatcgttctcttccggcctcaccaaggccccagtccggtcttcccctgccacctcctcaacgcncactcngggccacngccgccgtgggcttgccttggtcacggctacttccttcgtcgctaac

SEQ ID NO: 309540 - DNA, 546 bp, Homo sapiens
  misc_feature: GZ8MTXP01DLSYV.51.38.D05.1.454.CMB.2.raw
  modified_base (242)..(242): a, c, t, g, unknown or other
  misc_feature (242)..(242): n is a, c, g, or t
tcagcgatcgtatacacgaccggtgctcgatttagtatctgatagttgggtttgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactgggaccagcggtgacattggtntttataactatgtctctggtaccagcaccacccaggcaaaacgcccccaaatcatgatttatgatgtcagtgatcggcctgagggtttcaatcgccttctctgctccaaaagtcccggcaaacacggcctccctgacctatctctggccctccgaggccgaggacgaggctgattatactgcaggctcatataacaatcaaataaacaagttgggtgttcgggcggtaagggacccaaaagtcggaaccgtcgtaagggttccaggaccccaaggcctcgccccctggttcaacgttcttcccg

SEQ ID NO: 309541 - DNA, 523 bp, Homo sapiens
  misc_feature: GZ8MTXP01CP6G9.51.38.D05.1.454.CMB.2.raw
  modified_base (245)..(245): a, c, t, g, unknown or other
  misc_feature (245)..(245): n is a, c, g, or t
  modified_base (298)..(298): a, c, t, g, unknown or other
  misc_feature (298)..(298): n is a, c, g, or t
  modified_base (307)..(307): a, c, t, g, unknown or other
  misc_feature (307)..(307): n is a, c, g, or t
  modified_base (446)..(446): a, c, t, g, unknown or other
  misc_feature (446)..(446): n is a, c, g, or t
tcagcgatcgtatacacgaccggtgctcgatttagtatctgatagttgggtttgggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactgggaccagcggtgacattggtgtttanaactatgtctctggtaccagcaccaccagcaaagcccccaaatcatgatttangatgcagtnatcggcctgagggtttcaatcgcttctctggctccaaagtccggcaaacacggccctccctgaccatctctggcctccgaggccgaggacgaggctgattatactgcaggctcatatacaatcaaataacaattgggtnttcgggcggaagggaaccaaagtcgaccgtctaggttcagccccaaggcctcgccccctggttccaacgttctcccg

SEQ ID NO: 309542 - DNA, 509 bp, Homo sapiens
  misc_feature: GZ8MTXP01AEPUH.51.38.D05.1.454.CMB.2.raw
  modified_base (245)..(245): a, c, t, g, unknown or other
  misc_feature (245)..(245): n is a, c, g, or t
  modified_base (360)..(360): a, c, t, g, unknown or other
  misc_feature (360)..(360): n is a, c, g, or t
  modified_base (413)..(413): a, c, t, g, unknown or other
  misc_feature (413)..(413): n is a, c, g, or t
  modified_base (416)..(416): a, c, t, g, unknown or other
  misc_feature (416)..(416): n is a, c, g, or t
  modified_base (424)..(424): a, c, t, g, unknown or other
  misc_feature (424)..(424): n is a, c, g, or t
tcagcgatcgtatacacgaccggtgctcgatttagtatctgatagttgggtttggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactgggaccagcggtgacattggtntttataactatgtctctggtaccagcaccaccaggcaaacgccccaatcatgatttatgatgtcagtgatcgcctgaggggttcactcgcttctctggctccaagtccggcaacncggcctcctgaccatctctggcctcgaggccgaggacgaggctgattattacngcngcacatanacatacaatatagtggtgtcggacggacggaccaacgtcgaccgttcgttcgcgaacgccgaacgcctccgcccgtcgttcctcg

SEQ ID NO: 309543 - DNA, 539 bp, Homo sapiens
  misc_feature: GZ8MTXP01B22FK.51.38.D05.1.454.CMB.2.raw
  modified_base (435)..(435): a, c, t, g, unknown or other
  misc_feature (435)..(435): n is a, c, g, or t
tcagcgatcgtatacacgaccggtgctcgatttagtatctgatagttgggtttgggggaggcgtggtccagcctgggaggtccctgagactcgcctgtaaaccgtccggattcaccttcagtaactatgcaatgcactgggtccgccaggctccaggcaaggggctggactgggtggcaggcatatcatttgatggaagcaagaagtactatgcggactccgtgaagggccgattcaccatctccagagacagttccgatgacacagtctatctacacatgagcagtgtgagacctgacgacacggtcttctttttactgtgcgccaggaagcagtcggctggccacatcatgtcttttgattatcgtggagccgaagggacaagtggtcatcgtctcgttcggcctccacacggccagtccgggtcttccccgngccaccctcctccaagacgcctaccgtcgtcgggggcaacgacgccggcccgttgggcctgccgttggttcgaaggtctaacttccgtcgttacgtcaacgtcg

SEQ ID NO: 309544 - DNA, 509 bp, Homo sapiens
  misc_feature: GZ8MTXP01B0KMG.51.38.D05.1.454.CMB.2.raw
  modified_base (317)..(317): a, c, t, g, unknown or other
  misc_feature (317)..(317): n is a, c, g, or t
  modified_base (349)..(349): a, c, t, g, unknown or other
  misc_feature (349)..(349): n is a, c, g, or t
  modified_base (422)..(422): a, c, t, g, unknown or other
  misc_feature (422)..(422): n is a, c, g, or t
  modified_base (426)..(426): a, c, t, g, unknown or other
  misc_feature (426)..(426): n is a, c, g, or t
  modified_base (429)..(429): a, c, t, g, unknown or other
  misc_feature (429)..(429): n is a, c, g, or t
  modified_base (431)..(431): a, c, t, g, unknown or other
  misc_feature (431)..(431): n is a, c, g, or t
  modified_base (444)..(444): a, c, t, g, unknown or other
  misc_feature (444)..(444): n is a, c, g, or t
  modified_base (450)..(450): a, c, t, g, unknown or other
  misc_feature (450)..(450): n is a, c, g, or t
  modified_base (453)..(453): a, c, t, g, unknown or other
  misc_feature (453)..(453): n is a, c, g, or t
tcagcgatcgtatacacgaccggtgctcgatttagtatctgatagttgggtttggggaggcgtggtccagcctgggaggtccctgagactcgcctgtaaaccgtccggattcaccttcagtaactatgcaatgcactgggtccgccaggctccaggcaaggggctggactgggtggcaggcatatcatttgatggaagcaagaagtactatgcagactccgtgaaggccgattcaccatctccagagacagttccgatgacacagtctatctacacatgagcagtgtgagacctgacgacacggtcttctttttacngtgcgccaggagcagtggctggcccacaatcntgtcttttgatatctggacgcaagggacaagtggtcatcgtctcttcgcctccacaggccagtcgtctccccngccnccncncagcgcacctcgnggggcncgngccgccgtcgggcttcggccttggtcaaggtcctacgttccttcgtaacgctaacg

SEQ ID NO: 309545 - DNA, 546 bp, Homo sapiens
  misc_feature: GZ8MTXP01DWA0C.51.38.D05.1.454.CMB.2.raw
  modified_base (243)..(243): a, c, t, g, unknown or other
  misc_feature (243)..(243): n is a, c, g, or t
tcagcgatcgtatacacgaccggtgctcgatttagtatctgatagttgggtttgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactgggaccagcggtgacatttggtntttaataactatgtctctggtaccagcaccacccaggacaaacgcccccaaatcatgatttatgatgtcagtgatcggcctgagggggtttcaatcgcttctctggctccaaaagtccggcaaacacggcctccctgaccatcctctggccctcgaggccgaggacgaggctgattatactgcaggctcatatacaatacaaagtaactaagttgggtagttggcggaagggaaccttaaacgtcgaccggtctaagggttcacgccccaaggcctcgcccctaggttcctaacttcgtcccg

SEQ ID NO: 309546 - DNA, 541 bp, Homo sapiens
  misc_feature: GZ8MTXP01DZWCJ.51.38.D05.1.454.CMB.2.raw
  modified_base (242)..(242): a, c, t, g, unknown or other
  misc_feature (242)..(242): n is a, c, g, or t
  modified_base (247)..(247): a, c, t, g, unknown or other
  misc_feature (247)..(247): n is a, c, g, or t
  modified_base (304)..(304): a, c, t, g, unknown or other
  misc_feature (304)..(304): n is a, c, g, or t
tcagcgatcgtatacacgaccggtgctcgatttagtatctgatagttgggtttgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactgggaccagcggtgacattggtntttanaactatgtctctggtaccagcaccacccaggacaaacgcccccaaatcatgatttangatgtcagtgatcggcctcgtaggggtttcaatcgcttctctggctccgaaagtcccggcaacgaccggccctccctgaccatcctctcggccctcgagggcccgaggaccgaggctgattatactgcaggcttacatactacatctaaataacagttgggtgttcgggcggaagggaccaaagtcgaccgtctaggccacgccccaaggcctcgccccctggcctcttcgttcccg

SEQ ID NO: 309547 - DNA, 572 bp, Homo sapiens
  misc_feature: GZ8MTXP01EAOBU.51.38.D05.1.454.CMB.2.raw
  modified_base (247)..(247): a, c, t, g, unknown or other
  misc_feature (247)..(247): n is a, c, g, or t
tcagcgatcgtatacacgaccggtgctcgatttagtatctgatagttgggtttgggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactgggaccagcggtgacatttggtntttataactatgtctcctggaccagcaccacccaggcaaacgcccccaaactcatgatttatgatgtcagtgatcggccctgaggggtttcaactcgcttctctggcctccaagtccggacaaaccgacggccctcctgaccatctctggcctccgaggaccgaggacgaggctgattatactggacagctacatacacaatacgaaataactaagtttcggggtgttaacgggacgggttacggggaaccttaaaacgtcggacccgttacgttacggttcgaacgacccgaaggccctccggccccctcgggttcctaacccg

SEQ ID NO: 309548 - DNA, 556 bp, Homo sapiens
  misc_feature: GZ8MTXP01AM628.51.38.D05.1.454.CMB.2.raw
  modified_base (267)..(267): a, c, t, g, unknown or other
  misc_feature (267)..(267): n is a, c, g, or t
tcagcgatcgtatacacgaccggtgctcgatttagtatctgatagttgggtttggggctttgcctgggctctgctattcctcaccctcctcactcagggcacagggtcctgggcccagtctgccctgactcagcctgcctccgtgtctgggtctcctggacagtcgatcaccatctcctgcactgggaccagcggtgacattggtgtttataactatgtctcctggtaccagcaccacccaggcaaagcccccaaatcatgatttangatgtcagtgatcggccctgaggggtttcaatcgcttctctggctccaagtccggcaacacggcctccctgaccccatctctcggccctccagggccgaggacgagggctagattattactgcagctacatatacaatacaaataacaagttgggtagttcgggacggggaagggacctaaacgtcgaccgtcctaggtacacgaccacgacgtcgccccgtccgtcgacctccttcgttccctacccttcccgttccttcgtcgcaacctctcggacgcgggcgtcgg

SEQ ID NO: 309549 - DNA, 560 bp, Homo sapiens
  misc_feature: GZ8MTXP01C0OCT.51.38.D05.1.454.CMB.2.raw
  modified_base (268)..(268): a, c, t, g, unknown or other
  misc_feature (268)..(268): n is a, c, g, or t
  modified_base (386)..(386): a, c, t, g, unknown or other
  misc_feature (386)..(386): n is a, c, g, or t
tcagcgatcgtatacacgaccggtgctcgatttagtatctgatagttgggtttgggggctttgcctgggctctgctattcctcaccctcctcactcagggcacagggtcctgggcccagtctgccctgactcagcctgcctccgtgtctgggtctcctggacagtcgatcaccatctcctgcactgggaccagcggtgacattggtgtttataactatgtctcctggtaccagcaccacccaggcaaagcccccaaatcatgatttangatgtcagtgatcggccctgaggggtttcaatcgcttctctggctccaagtccggacaacacggcctccctgaccccatctctggccctccgaggccgaggacgaggctgattatacngcagctcatatacaatacaaagtaacaagttgggtagttcgggacggggaaggggacccaaacgtgacccgtcctagggtccacggcccaagggcctcgccccctggtcacgttcttcgttccccgcccttcccttcgttccgtaagccaactcgtggacgtccgggcgtcggg

SEQ ID NO: 309550 - DNA, 548 bp, Homo sapiens
  misc_feature: GZ8MTXP01CIG9K.51.38.D05.1.454.CMB.2.raw
  modified_base (246)..(246): a, c, t, g, unknown or other
  misc_feature (246)..(246): n is a, c, g, or t
tcagcgatcgtatacacgaccggtgctcgatttagtatctgatagttgggtttgggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactgggaccagcggtgacattggtntttaataactatgtctcctggaccagcaccacccaggcaaacgcccccaaatcatgatttatgatgtcagtgatcggccctcgaggggtttcgaactcgcttctctcggctccaacgtccggcaacacggccctccctgacccatctctcggccctccaagggcccgaagggacgagggctgattattactgggcagtctcatataacaatacaaataacaattgggtgttcgggcggagggaaccaaacgtcgaccgttcgttaggttcaacgcccaaggctaccgcccctcggctaaccc

SEQ ID NO: 309551 - DNA, 618 bp, Homo sapiens
  misc_feature: GZ8MTXP01CQCB6.51.38.D05.1.454.CMB.2.raw
  modified_base (252)..(252): a, c, t, g, unknown or other
  misc_feature (252)..(252): n is a, c, g, or t
  modified_base (453)..(453): a, c, t, g, unknown or other
  misc_feature (453)..(453): n is a, c, g, or t
tcagcgatcgtatacacgaccggtgctcgatttagtatctgatagttgggtttgggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctctgcacgtgggaccaggcggtagactagtttgggtntttaataactatgtctctggacagcaccaccaggacaaacgccccaaatcatgattatgatgtcagtgatcgcctgtaggggttcaactcgcttcgtctacggcttaccgaacgtccgggacaaccgaccggcctcccgtagaccctactctcgtcgccctccgacgggccgaacggacgaggctagtaattatttaacgngacgtacgtctactaataataaactaaacgtaactaaataacgttaaggttcgggtcggtaacgggaacgggaaacggtaaaccgaaacgtaccgtaaccgttaccgttacggaccgaaccgacccgtaacggtcccgtcccgttaccccgttcgttcctaaccg

SEQ ID NO: 309552 - DNA, 548 bp, Homo sapiens
  misc_feature: GZ8MTXP01AZLV7.51.38.D05.1.454.CMB.2.raw
  modified_base (246)..(246): a, c, t, g, unknown or other
  misc_feature (246)..(246): n is a, c, g, or t
  modified_base (375)..(375): a, c, t, g, unknown or other
  misc_feature (375)..(375): n is a, c, g, or t
tcagcgatcgtatacacgaccggtgctcgatttagtatctgatagttgggtttgggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactgggaccagcggtgacattggtntttataactatgtctctggtaccagcaccaccaggcaaacgcccccaaactcatgatttatgatgtcagtgatcggcctcgaggggtttcaactcgcttctctggctcaagtccgcaacacggcctccngaccatctctcggcctccgaggcccgagggacgaggctagtattattacgtggcagctcatactacaaatacaaattaaacgaagttgggtgttcgggcggaaggggtaccaaacgtcgacgttccgttaggttcaacgtcccgaaggccgtcgccccgtcggttctaacccg

SEQ ID NO: 309553 - DNA, 560 bp, Homo sapiens
  misc_feature: GZ8MTXP01CQ4X4.51.38.D05.1.454.CMB.2.raw
  modified_base (372)..(372): a, c, t, g, unknown or other
  misc_feature (372)..(372): n is a, c, g, or t
  modified_base (480)..(480): a, c, t, g, unknown or other
  misc_feature (480)..(480): n is a, c, g, or t
  modified_base (490)..(490): a, c, t, g, unknown or other
  misc_feature (490)..(490): n is a, c, g, or t
  modified_base (496)..(496): a, c, t, g, unknown or other
  misc_feature (496)..(496): n is a, c, g, or t
tcagcgatcgtatacacgaccggtgctcgatttagtatctgatagttgggtttgggggaggcgtggtccagcctgggaggtccctgagactcgcctgtaaaccgtccggattcaccttcagtaactatgcaatgcactgggtccgccaggctccaggcaaggggctggactgggtggcaggcatatcattttgatggaagcaagaagtactatgcagactccgtgaaggccattcaccatctcagagacagttccgatgacacagtcatctacacatgagcagtgtgagaccctgacgacacggtcttcttttttacgtgtcgccgaccaggaagcaggtggctggaccacaatcaattgtcttttgattancgtaggacgacaagggacaagtggtcacgtcgtctccttacggcccttaccaaccgaacgggccctaggtcccggttccttccccgcgcctacccctccaccaacgcnccaccgtcgnggggcncgacgccgcccgtgggcttcgcgttcggtcaaacggtcctaccgttccgcgtaacgcgtaaccg

SEQ ID NO: 309554 - DNA, 566 bp, Homo sapiens
  misc_feature: GZ8MTXP01CMBTA.51.38.D05.1.454.CMB.2.raw
  modified_base (398)..(398): a, c, t, g, unknown or other
  misc_feature (398)..(398): n is a, c, g, or t
tcagcgatcgtatacacgaccggtgctcgatttagtatctgatagttgggtttgggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactgggaccagcggtgacattggtgtttataactatgtctctggtaccagcaccacccaggcaaacgcccccaaatcatgatttatgatgtcagtgactcggcctcgaggggtttcaactcgacttctctggcctccgaagtcccggacaaaccgaccggcctccctgacccattcnctggccctccgaggccgaggacgaggctgattagtactggcagctacatatacaataccaaataacaagttggggtgttcgggacggagggaaccaaacgtcgacccgttccgttaggttaccgaagccccgaaggtccctccggttccccctcgggttcctaacccg

SEQ ID NO: 309555 - DNA, 633 bp, Homo sapiens
  misc_feature: GZ8MTXP01DYH58.51.38.D05.1.454.CMB.2.raw
  modified_base (208)..(208): a, c, t, g, unknown or other
  misc_feature (208)..(208): n is a, c, g, or t
  modified_base (395)..(395): a, c, t, g, unknown or other
  misc_feature (395)..(395): n is a, c, g, or t
tcagcgatcgtatacacgaccggtgctcgatttagtatctgatagttgggtttgggggctttgcctgggctctgctattcctcaccctcctcactcagggcacagggtcctgggcccagtctgccctgactcagcctgcctccgtgtctgggtctcctggacagtcgatcaccatctcctgcactggggaccagcggtgacattggtntttataactatgtctcctggtaccagcaccaccaggcaaacgccccaaatcatgatttatgatgtcagtgactcggccctgtagggtttcaatcgcttctctggctccgaagtccggacaacacggcctcctgaccccatctcgtcggccctaccgaggccgaggacgagggctgattatactgcanctacaatataacaattacaaataacgaagtttggggtacgttcgggacgggggaacggggtaacctaaaacgtcggtaaccccgtacgtaggtaccaaccggacccgaaacgggtccctcccggccccccgttcgggttacccttacccttccgttcccggttccccccggtccccttcccttcgttaccgttaacggccttaaccgttcgtcggacggtccggggttcgtaaccggg

SEQ ID NO: 309556 - DNA, 528 bp, Homo sapiens
  misc_feature: GZ8MTXP01CU8I3.51.38.D05.1.454.CMB.2.raw
  modified_base (507)..(507): a, c, t, g, unknown or other
  misc_feature (507)..(507): n is a, c, g, or t
  modified_base (514)..(514): a, c, t, g, unknown or other
  misc_feature (514)..(514): n is a, c, g, or t
  modified_base (516)..(516): a, c, t, g, unknown or other
  misc_feature (516)..(516): n is a, c, g, or t
  modified_base (519)..(519): a, c, t, g, unknown or other
  misc_feature (519)..(519): n is a, c, g, or t
  modified_base (521)..(521): a, c, t, g, unknown or other
  misc_feature (521)..(521): n is a, c, g, or t
  modified_base (525)..(525): a, c, t, g, unknown or other
  misc_feature (525)..(525): n is a, c, g, or t
  modified_base (527)..(527): a, c, t, g, unknown or other
  misc_feature (527)..(527): n is a, c, g, or t
tcagcgatcgtatacacgaccggtgctcgatttagtatctgatagttgggtttgggggctttgcctgggctctgctattcctcaccctcctcactcagggcacagggtcctgggcccagtctgccctgactcagcctgcctccgtgtctgggtctcctggacagtcgatcaccatctcctgcactgggaccagcggtgacattggtgtttataactatgtctcctggtaccagcaccacccaggcaaagcccccaaactcatgatttatgatgtcagtgatcggccctcgaggggtttcgaatcgcttctctggctcaagtccgcaacacgcctcctgaccccatctctcggccctaccgagggcccgaggacgagggctgattatactgcagctcatatacaatcaaataacaattgggtgttcgggcggggagggaccaaactcgaccgtcctaggtcacgccaaggctcgcccctggtcacgtcttgttccccaccttccttcncgtaacncnctngngcgngng

SEQ ID NO: 309557 - DNA, 557 bp, Homo sapiens
  misc_feature: GZ8MTXP01B1VOO.51.38.D05.1.454.CMB.2.raw
  modified_base (344)..(344): a, c, t, g, unknown or other
  misc_feature (344)..(344): n is a, c, g, or t
  modified_base (439)..(439): a, c, t, g, unknown or other
  misc_feature (439)..(439): n is a, c, g, or t
tcagcgatcgtatacacgaccggtgctcgatttagtatctgatagttgggtttgggggaggcgtggtccagcctgggaggtccctgagactcgcctgtaaaccgtccggattcaccttcagtaactatgcaatgcactgggtccgccaggctccaggcaaggggctggactgggtggcaggcatatcatttgatggaagcaagaagtactatgcagactccgtgaagggccattcaccatctccagagacagttccgatgacacagtctatctacacatgagcagtgtgagacctgacgacacggtcttctttttactgtgcgccaggagcagtggctggccanaatcaatgtcttttgattatcgtagggacgaccgaagggactaagtggtcagttcgtctcttcggcctccacacggcccagtccgtccttccccncggcccaccctcctccaacgcgcctaccgtcgtcgggggcacgcggcccggcccgtcgggccttcggcccttcgggtaaccaacgggtccttacttcccgttcgttaacgcgtaaccg

SEQ ID NO: 309558 - DNA, 547 bp, Homo sapiens
  misc_feature: GZ8MTXP01A348L.51.38.D05.1.454.CMB.2.raw
  modified_base (327)..(327): a, c, t, g, unknown or other
  misc_feature (327)..(327): n is a, c, g, or t
tcagcgatcgtatacacgaccggtgctcgatttagtatctgatagttgggtttgggggctttgcctgggctctgctattcctcaccctcctcactcagggcacagggtcctgggcccagtctgccctgactcagcctgcctccgtgtctgggtctcctggacagtcgatcaccatctcctgcactgggaccagcggtgacattggtgtttataactatgtctcctggtaccagcaccaccaggcaaacgcccccaaatcatgattatgatgtcagtgatcggccctcgaggggtttcaatcgcttctctggctccagtccgacaacncggcctccctgaccccatctcgtcgccctccgaggccgaggacgagctgattatactgcagctcaatataacaatacaaataacgtaagttggggtgttcgggacgggggaacgggtaaccaaacgtcgaccgtcctaggtcacgcccaaggcctcgcccctgtcacgtcttcgtccccgccttccgttcttcgtaagccaactcgtgacgcggctcggg

SEQ ID NO: 309559 - DNA, 553 bp, Homo sapiens
  misc_feature: GZ8MTXP01DS0U9.51.38.D05.1.454.CMB.2.raw
  modified_base (528)..(528): a, c, t, g, unknown or other
  misc_feature (528)..(528): n is a, c, g, or t
  modified_base (532)..(532): a, c, t, g, unknown or other
  misc_feature (532)..(532): n is a, c, g, or t
  modified_base (538)..(538): a, c, t, g, unknown or other
  misc_feature (538)..(538): n is a, c, g, or t
tcagcgatcgtatacacgaccggtgctcgatttagtatctgatagttgggtttgggggctttgcctgggctctgctattcctcaccctcctcactcagggcacagggtcctgggcccagtctgccctgactcagcctgcctccgtgtctgggtctcctggacagtcgatcaccatctcctgcactgggaccagcggtgacattggtgtttataactatgtctctggtaccagcaccacccaggcaaacgcccccaaatcatgatttatgatgtcagtgatcggccctgaggggtttcaatcgcttctctggctccaagtccggcaacgacgccctcctgacccccatctctcggccctccgaggcccgaggacgaggctgatttatactgcagctcatataacaatcaaataactaattcgggtagttcgggacggggaacgggaccaaacgtcggacctcgtacggtcaacgcccaaggctacgccccctggtcaccttcgttcgttccccacccttccttcttcgngccncgttcngacgtcggcgtcggg

SEQ ID NO: 309560 - DNA, 604 bp, Homo sapiens
  misc_feature: GZ8MTXP01C0ZEK.51.38.D05.1.454.CMB.2.raw
  modified_base (317)..(317): a, c, t, g, unknown or other
  misc_feature (317)..(317): n is a, c, g, or t
  modified_base (355)..(355): a, c, t, g, unknown or other
  misc_feature (355)..(355): n is a, c, g, or t
tcagcgatcgtatacacgaccggtgctcgatttagtatctgatagttggggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcacgtggggaccaggcggtgactagtttgggtattttaataacttatgtctcctggtaccagcaccacccaggcaaacgcccccaaaatcatgatttangatgtcagtgatcggcctgagggtttcaatcgcttctntgctcaaagtcccggcaacgacggccctccctgaccctatcctcgtcggccctcgagggccgaggacgaggctgattatactgcaggtctacataactaacaaatacaaattaacgtaaagtttggggtacgttcggggcggaaacggggtaacccttaaacgtcggaacccgttaccgtaagggttaccacggaccccgtaaagggcccttccggcccccgtcggttacctaaccttccgtttccccg

SEQ ID NO: 309561 - DNA, 504 bp, Homo sapiens
  misc_feature: GZ8MTXP01C0MIR.51.38.D05.1.454.CMB.2.raw
  modified_base (166)..(166): a, c, t, g, unknown or other
  misc_feature (166)..(166): n is a, c, g, or t
  modified_base (193)..(193): a, c, t, g, unknown or other
  misc_feature (193)..(193): n is a, c, g, or t
  modified_base (293)..(293): a, c, t, g, unknown or other
  misc_feature (293)..(293): n is a, c, g, or t
  modified_base (481)..(481): a, c, t, g, unknown or other
  misc_feature (481)..(481): n is a, c, g, or t
  modified_base (483)..(504): a, c, t, g, unknown or other
  misc_feature (483)..(504): n is a, c, g, or t
tcagcgatcgtatacacgaccggtgctcgatttagtatctgatagttgggtttgggtgcccaagctccgtgaagggccgattcaccatctccagagacagttccgatgacacagtctatctacacatgagcagtgtgagacctgacgacacggcttcttttttacngtgcgccaggaagcagtggctggccanatcatgtctttttgattatcgtaggacgaccgaaagggacaagtggtcattcgtctcgttcggccctccacgaacggcccagtccggtcccttcccccgnggccctacccctcctaccaagacgcctacctcggtcgggggaccaacgcggcccggcccgttggggcctcgacccgtgggtaccaaacgggtacccccttaccgttccgtacggtaacgccctaaccttccgtgggaacgggtccggggaccttcggggaccgaaacgggggcccgaaacgtagtagngnnnnnnnnnnnnnnnnnnnnnn

SEQ ID NO: 309562 - DNA, 592 bp, Homo sapiens
  misc_feature: GZ8MTXP01A3S9T.51.38.D05.1.454.CMB.2.raw
  modified_base (247)..(247): a, c, t, g, unknown or other
  misc_feature (247)..(247): n is a, c, g, or t
tcagcgatcgtatacacgaccggtgctcgatttagtatctgatagttgggtttgggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactgggaccagcggtgacattgggtntttataactatgtctcctggtaccagcaccacccaggcaaacgcccccaaatcatgatttatgatgtcagtgactcggcctgaggggtttcactcgtctctctgctccaagtccgcacacgcctcctgacctatctctcggcctccgaggcccggaggacgaggccttagacttagttacctgggacctaggtcctactaataactaacaataaccaaattaaacctaaaggtttcggggtggttaacgggacgggaacgggtaacccgaaacgtccggaaccgttaccgttacggttaccaacggaccccgaacgggctccggcccccgtcggttcctaacccg

SEQ ID NO: 309563 - DNA, 533 bp, Homo sapiens
  misc_feature: GZ8MTXP01AFKQS.51.38.D05.1.454.CMB.2.raw
  modified_base (244)..(244): a, c, t, g, unknown or other
  misc_feature (244)..(244): n is a, c, g, or t
  modified_base (255)..(255): a, c, t, g, unknown or other
  misc_feature (255)..(255): n is a, c, g, or t
  modified_base (344)..(344): a, c, t, g, unknown or other
  misc_feature (344)..(344): n is a, c, g, or t
  modified_base (423)..(423): a, c, t, g, unknown or other
  misc_feature (423)..(423): n is a, c, g, or t
tcagcgatcgtatacacgaccggtgctcgatttagtatctgatagttgggtttgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactgggaccagcggtgactagttggtntttaataactntgtctcctggtaccagcaccaccaggcaaacgcccccaaatcatgatttatgatgtcagtgatcggcctcgagggttcaatcgcttctntgctcaaagtccgcacgacgcctccgacatctctcgcctccgaggccgaggacgagctgtattatactgcagctcatanaacaaatcaaataactaaagtttggggtgttacgggcggtaacgggaacaaacgttgaccgttcgtaggtcacgcccaggcctcggcccctggcactcgttccgttcccc

SEQ ID NO: 309564 - DNA, 566 bp, Homo sapiens
  misc_feature: GZ8MTXP01CMGSX.51.38.D05.1.454.CMB.2.raw
  modified_base (244)..(244): a, c, t, g, unknown or other
  misc_feature (244)..(244): n is a, c, g, or t
  modified_base (249)..(249): a, c, t, g, unknown or other
  misc_feature (249)..(249): n is a, c, g, or t
  modified_base (306)..(306): a, c, t, g, unknown or other
  misc_feature (306)..(306): n is a, c, g, or t
tcagcgatcgtatacacgaccggtgctcgatttagtatctgatagttgggtttggggtggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactgggaccagcggtgacattggtntttanaactatgtctcctggtaccagcaccacccaggcaaacgccccaaactcatgatttangatgtcagtgatcggcctcgaggggtttcaatccgcttctctggctccaagtccggcaaacgaccggcctccctgaccatcctctcggccctcgacggccgaggacgaggctagattatactgcagctcatatacaatacaaataactaagttgggtacgtttcggcgggaagggacctaaacttggtaaacccgtcgttaacgggttccacggtcccaaagggtcctccggtcccccgttcgggtcccaacgtttcccg

SEQ ID NO: 309565 - DNA, 559 bp, Homo sapiens
  misc_feature: GZ8MTXP01DSLJL.51.38.D05.1.454.CMB.2.raw
  modified_base (368)..(368): a, c, t, g, unknown or other
  misc_feature (368)..(368): n is a, c, g, or t
tcagcgatcgtatacacgaccggtgctcgatttagtatctgatagttgggtttggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactgggaccagcggtgacattggtgtttataactatgtctcctggtaccagcaccacccaggcaaacgccccaaatcatgatttatgatgtcagtgatcggccctgaggggtttcaactcgcttctctggctccaagtccggcaaacncggcctcctgaccatctctggcctccaggccgaggacgaggctgattatactggcagctcatatacaatacaaataactaagttggggtgttcgggcgggttaaggggaacccaaaacgtcggaacccgttaccgttagggttaccaaggaccccaagggccctcggttcccccctcgggttcctaacccg

SEQ ID NO: 309566 - DNA, 612 bp, Homo sapiens
  misc_feature: GZ8MTXP01EU0ML.51.38.D05.1.454.CMB.2.raw
  modified_base (272)..(272): a, c, t, g, unknown or other
  misc_feature (272)..(272): n is a, c, g, or t
  modified_base (320)..(320): a, c, t, g, unknown or other
  misc_feature (320)..(320): n is a, c, g, or t
tcagcgatcgtatacacgaccggtgctcgatttagtatctgatagttgggtttgggggaggcgtggtccagcctgggaggtccctgagactcgcctgtaaaccgtccggattcaccttcagtaactatgcaatgcactgggtccgccaggctccaggcaaggggctggactgggtggcaggcatatcatttgatggaagcaagaagtactatgtagactccgtgaagggccgattcaccatctccagagacagttccgatgacacagtctanctacacatgagcagtgtgagacctgacgacacggtcttcttttttacngtgcgcaggaagcagtcggctggccacatcatgtcttttgattatcgtgggacgaccgaaagggacaagtcggtactacgttcgttccttccgtttccgggcccttacccgaacccgaaacgggtcccctaacgttcccgggggttaccctttccccccgtgggcccctaccccgttccctaccgaacgacgtcctaccgttcggtcgggggccaacgcgccggcccgttgggcctcggccgttcggttacgaacgggtccttaacgttcccgcgttacgccgttaacgtcg

SEQ ID NO: 309567 - DNA, 567 bp, Homo sapiens
  misc_feature: GZ8MTXP01DE2L9.51.38.D05.1.454.CMB.2.raw
  modified_base (201)..(201): a, c, t, g, unknown or other
  misc_feature (201)..(201): n is a, c, g, or t
  modified_base (244)..(244): a, c, t, g, unknown or other
  misc_feature (244)..(244): n is a, c, g, or t
  modified_base (279)..(279): a, c, t, g, unknown or other
  misc_feature (279)..(279): n is a, c, g, or t
  modified_base (319)..(319): a, c, t, g, unknown or other
  misc_feature (319)..(319): n is a, c, g, or t
  modified_base (325)..(325): a, c, t, g, unknown or other
  misc_feature (325)..(325): n is a, c, g, or t
  modified_base (355)..(355): a, c, t, g, unknown or other
  misc_feature (355)..(355): n is a, c, g, or t
  modified_base (520)..(520): a, c, t, g, unknown or other
  misc_feature (520)..(520): n is a, c, g, or t
  modified_base (566)..(566): a, c, t, g, unknown or other
  misc_feature (566)..(566): n is a, c, g, or t
tcagcgatcgtatacacgaccggtgctcgattttagtatctgataggttgggtttgggggaggcgtggtccagcctgggaggtccctgagactcgcctgtaaaccgtccggattcaccttcagtaactatgcaatgcactgggtccgccaggctccaggcaaggggctggactgggtggcaggcatatcatttgatggaancaagagtactatgcagactcgtgaaggcgatcacatctcaganacagttcgatgaacacagtacatctacgacatgancaagtgtagagacctgacgactacggcttcttttttacgngtcgcnccgagagctagtcggactggccacaatacntgtcttttagactatcgtggactacgaagggacaagtggtacctaatccgtcttcttccggaccttacaacaaacggggtcccctaaggttccggggtcccttttcccccgagggcctaaaccccgtcttaccgaaaagtccgacctaccgtcgtaggggaaacncgaacgcgccggtcgcggcttcgcgtgacaacgtactcttcctgcnc

SEQ ID NO: 309568 - DNA, 527 bp, Homo sapiens
  misc_feature: GZ8MTXP01BPXXY.51.38.D05.1.454.CMB.2.raw
  modified_base (304)..(304): a, c, t, g, unknown or other
  misc_feature (304)..(304): n is a, c, g, or t
  modified_base (343)..(343): a, c, t, g, unknown or other
  misc_feature (343)..(343): n is a, c, g, or t
  modified_base (458)..(458): a, c, t, g, unknown or other
  misc_feature (458)..(458): n is a, c, g, or t
  modified_base (496)..(496): a, c, t, g, unknown or other
  misc_feature (496)..(496): n is a, c, g, or t
  modified_base (505)..(505): a, c, t, g, unknown or other
  misc_feature (505)..(505): n is a, c, g, or t
tcagcgatcgtatacacgaccggtgctcgatttagtatctgatagttgggtttgggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggggaccagcggtgacattggtgtttataactatgtctcctggtaccagcaccacccaggcaaacgcccccaaactcatgatttangatgtcagtgatcggcctcgaggggtttcaatcgcttcnctggctccaaagtcccggcaacacgggccctccctgaccatctctggcctccaggccgaggaccgaggctgattattactgcaggctcatataacaatcaaataacaattgggtnttcgggcggaagggaaccaaatgaccgtcctaggttcngcccaagcncgcccctgttccaacttctccg

SEQ ID NO: 309569 - DNA, 571 bp, Homo sapiens
  misc_feature: GZ8MTXP01DQ7WY.51.38.D05.1.454.CMB.2.raw
  modified_base (245)..(245): a, c, t, g, unknown or other
  misc_feature (245)..(245): n is a, c, g, or t
tcagcgatcgtatacacgaccggtgctcgatttagtatctgatagttgggtttgggggctggggtctcaggaggcagcgctctcgggacgtctccaccatggcctgggctctgctattcctcaccctcctcactcagggcacagggtcctgggcccagtctgccctgactcagcctgcctcgtgtctgggtctcctggacagtcgatcacatctcctgcactgggaccagcggtgactattggtntttaataactatgtctcctggaccagcaccaccaggcaaacgcccccaaatcatgatttatgatgtcagtgatcgcctgaggggtttcaactcgcttctctggctccaagtccggacaaacacggccctccctgacccatctctcggcctcgaggccgaggacgaggctgattatactggcagctacaatataacaatacaaataaacgtaaagttggggtgttcgggacggaacggggaaaccaaaacgtcggaacccgttaccgttaggaccgaacgaccccgaaaggtccctccggttcccccgttcgggttccttaaccccg

SEQ ID NO: 309570 - DNA, 645 bp, Homo sapiens
  misc_feature: GZ8MTXP01DI8RD.51.38.D05.1.454.CMB.2.raw
  modified_base (208)..(208): a, c, t, g, unknown or other
  misc_feature (208)..(208): n is a, c, g, or t
  modified_base (270)..(270): a, c, t, g, unknown or other
  misc_feature (270)..(270): n is a, c, g, or t
tcagcgatcgtatacacgaccggtgctcgatttagtatctgatagttgggtttgggggctttgcctgggctctgctattcctcaccctcctcactcagggcacagggtcctgggcccagtctgccctgactcagcctgcctccgtgtctgggtctcctggacagtcgatcaccatctcctgcactgggaccaggcggtgacattggtntttataactatgtctcctggtaccagcaccacccaggcaaacgcccccaaatcatgatttangatgtcagtgatcggccctgaggggtttcaatcgcttctctggctccaagtcccggcaacacgcctccctgaccccatctctggccctaccgaggcccgaggaccgaggctagattagtactgcagctacatacaacaatacaaataaactagttggggtgtttacgggacgggggtaacggggaaccaaacgtcggaacccgtccgtaagggtccaacggccccgaaagggtccctaccggtccccccgttaacgggtcccttaacccgttcccttaccgggttcccccctaacccctttcccgttcccgttaccgggttaacgtacccgtaaccttcccgtaggaccggggtccggggttccgtaaccggggg

SEQ ID NO: 309571 - DNA, 520 bp, Homo sapiens
  misc_feature: GZ8MTXP01C2U1C.51.38.D05.1.454.CMB.2.raw
  modified_base (246)..(246): a, c, t, g, unknown or other
  misc_feature (246)..(246): n is a, c, g, or t
  modified_base (305)..(305): a, c, t, g, unknown or other
  misc_feature (305)..(305): n is a, c, g, or t
  modified_base (343)..(343): a, c, t, g, unknown or other
  misc_feature (343)..(343): n is a, c, g, or t
  modified_base (416)..(416): a, c, t, g, unknown or other
  misc_feature (416)..(416): n is a, c, g, or t
  modified_base (484)..(484): a, c, t, g, unknown or other
  misc_feature (484)..(484): n is a, c, g, or t
tcagcgatcgtatacacgaccggtgctcgatttagtatctgatagttgggtttgggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactgggaccagcggtgacattggtntttaataactatgtctctggaccagcaccaccaggcaaacgccccaaatcatgatttangatgtcagtgatcggccctgagggtttcactcgcttcnctggctcaagtccgacaacacggcctcctgaccatctctggcctcaggccgagggacgaggctgattattacnggcagctacatatacaataccaaataactagttgggtgtcgggcggagggacaaacgtcgcgttacgnggttcaagcccgtaacggctcgcccctcggctaacc

SEQ ID NO: 309572 - DNA, 646 bp, Homo sapiens
  misc_feature: GZ8MTXP01DDBVP.51.38.D05.1.454.CMB.2.raw
  modified_base (249)..(249): a, c, t, g, unknown or other
  misc_feature (249)..(249): n is a, c, g, or t
tcagcgatcgtatacacgaccggtgctcgatttagtatctgatagttggggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcacgtgggaccaggcggtgactagtttggtntttaataactatgtctctggtaccagcaccaccaggacaaaacgcccccaaactcatagtatttatgatgtcagtgacgtcggcctcgtagggtttcgaatcgtccttctcgtggctccaaacgtccggcaacgaccggccctccctcgacctactcctctcggtccctccgacggccggaacggaacggacgggtccttaggtaacttaagttaacctgaccgtacgggtccttactaaacttagtaaacctaaataacaaaacttaaaacgtaaaggtttggggtacggttacgggacgggtaaacggggaacccaaacgtcggaccgttaccgtcggttaccgcgacccgtaaggcctcccgccccgtcgggttcctaacgttccgttccccgg

SEQ ID NO: 309573 - DNA, 583 bp, Homo sapiens
  misc_feature: GZ8MTXP01EMSGI.51.38.D05.1.454.CMB.2.raw
  modified_base (351)..(351): a, c, t, g, unknown or other
  misc_feature (351)..(351): n is a, c, g, or t
  modified_base (489)..(489): a, c, t, g, unknown or other
  misc_feature (489)..(489): n is a, c, g, or t
  modified_base (507)..(507): a, c, t, g, unknown or other
  misc_feature (507)..(507): n is a, c, g, or t
tcagcgatcgtatacacgaccggtgctcgatttagtatctgatagttgggtttgggggaggcgtggtccagcctgggaggtccctgagactcgcctgtaaaccgtccggattcaccttcagtaactatgcaatgcactgggtccgccaggctccaggcaaggggctggactgggtggcaggcatatcatttgatggaagcaagaagtactatgcagactccgtgaaggccattcaccatctcagagacagttccgatgacacagtcatctacacatgagcagtgtgagacctgacgacacggtctttctttttactgtcgcgccgaaggagcagtggctggccacaatctntgtcttttgattagtcgtgggacgaccgaaagggactaagtcggtctagttccgtcttccgttccggcctacccgaaccgaacgggcccctaggtcccggttcccttccccgtcggcccacccctcctaccaacggcnccaccgtcggtcggggcncgcggcccggcccgtggggcttcggcccgttgggtaaccaacgggtccttaccgttcccgttacggtaacgcctcg

SEQ ID NO: 309574 - DNA, 684 bp, Homo sapiens
  misc_feature: GZ8MTXP01C63ZU.51.38.D05.1.454.CMB.2.raw
  modified_base (235)..(235): a, c, t, g, unknown or other
  misc_feature (235)..(235): n is a, c, g, or t
  modified_base (252)..(252): a, c, t, g, unknown or other
  misc_feature (252)..(252): n is a, c, g, or t
  modified_base (305)..(305): a, c, t, g, unknown or other
  misc_feature (305)..(305): n is a, c, g, or t
tcagcgatcgtatacacgaccggtgctcgatttagtatctgatagttgggtttggggtggggtctcaggaggcagcgctctcgggacgtctccaccatggcctgggctctgctattcctcaccctcctcactcagggcacagggtcctgggcccagtctgccctgactcagcctgcctcgtgtctgggtctcctggacagtcatcaccatctcctgcacgtgggaccaggcggtnactagttggtatttaanaactatgtctctggtacagcaccaccagacaaacgccccaaatcatgatttangatgtcagtgactccggccctgtaggggtttacaatcccgtcttctcgttacggccttaacccgaaacggtcccggaccaaaccgacccgggtcccctaccctacgaaacctacttccctcgttcgggcccctaccgacgggacccgaagggaccgtaagggcctaggtaactttaattaaccgtcgacgtacgtactaactaaataaactaaactaaataaactaaaacgttaaacgttaagggttcggggttacggtacggggaacgggtaaacggaaaccgtaaacgttccggtaacccgtacgttacggttaccgaaccggaacccgtaacggtcccgtccccggtaccccgttaccggtcccttcccgttcccg

SEQ ID NO: 309575 - DNA, 555 bp, Homo sapiens
  misc_feature: GZ8MTXP01DDC3C.51.38.D05.1.454.CMB.2.raw
  modified_base (245)..(245): a, c, t, g, unknown or other
  misc_feature (245)..(245): n is a, c, g, or t
  modified_base (305)..(305): a, c, t, g, unknown or other
  misc_feature (305)..(305): n is a, c, g, or t
  modified_base (341)..(341): a, c, t, g, unknown or other
  misc_feature (341)..(341): n is a, c, g, or t
tcagcgatcgtatacacgaccggtgctcgatttagtatctgatagttgggtttgggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcacatctctgcactgggaccagcggtgactattggtntttataactatgtctcctggaccagcaccacccaggcaaacgccccaaatcatgatttangatgtcagtgatcggcctcgaggggtttcaactcgnttctctggctccaagtccgacaaacgacggcctccctgacccatctctcggcctccgaggaccgaggacgaggctgattatactggcagctcatatacaatacaaataaacaagttggggtgttcggacgggacgggaaaccaaacgttcggaaccgttccgttaggttccaacgacccgaaggtctccggacccccttcgggttcctaacccg

SEQ ID NO: 309576 - DNA, 545 bp, Homo sapiens
  misc_feature: GZ8MTXP01BFCH3.51.38.D05.1.454.CMB.2.raw
  modified_base (247)..(247): a, c, t, g, unknown or other
  misc_feature (247)..(247): n is a, c, g, or t
  modified_base (374)..(374): a, c, t, g, unknown or other
  misc_feature (374)..(374): n is a, c, g, or t
  modified_base (505)..(505): a, c, t, g, unknown or other
  misc_feature (505)..(505): n is a, c, g, or t
tcagcgatcgtatacacgaccggtgctcgatttagtatctgatagttgggtttgggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactgggaccagcggtgactattggtntttataactatgtctcctggtaccagcaccacccaggcaaacgcccccaaatcatgatttatgatgtcagtgatcggccctcgaggggtttcaactcgctttctctggccttccaagtccggcaacncggcctccctgacccatctctggcctccagggcccgagggacgaggctgatttagtactggcagctacatatacaatcaaataacaatttggggtgttcgggcggaagggaccaaacgtcgaaccgttcgngggttcaagcccaaggcctcgaccccctggttcctaaccg

SEQ ID NO: 309577 - DNA, 552 bp, Homo sapiens
  misc_feature: GZ8MTXP01AFLIT.51.38.D05.1.454.CMB.2.raw
  modified_base (243)..(243): a, c, t, g, unknown or other
  misc_feature (243)..(243): n is a, c, g, or t
  modified_base (248)..(248): a, c, t, g, unknown or other
  misc_feature (248)..(248): n is a, c, g, or t
  modified_base (253)..(253): a, c, t, g, unknown or other
  misc_feature (253)..(253): n is a, c, g, or t
tcagcgatcgtatacacgaccggtgctcgatttagtatctgatagttgggtttgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactgggaccagcggtgactattggtntttanaactntgtctctggtaccagcaccacccaggcaaacgcccccaaatcatgatttatgatgtcagtgatcggcctgtaggggtttcaatcgccttctctggcctccgaaacgtcccggcaaccgaccggcctccctgaccatcctctcggcctcgaggccgaggacgaggctagattatactgcaggctcatataacaatacaaataactaagttgggtagttcgggcggtaacggaaccaaacgtcgaccgtccgtaggttcgcgacccgaaggctcgccccgtcggttcctcgttcgttcccg

SEQ ID NO: 309578 - DNA, 586 bp, Homo sapiens
  misc_feature: GZ8MTXP01BQWF8.51.38.D05.1.454.CMB.2.raw
  modified_base (309)..(309): a, c, t, g, unknown or other
  misc_feature (309)..(309): n is a, c, g, or t
  modified_base (382)..(382): a, c, t, g, unknown or other
  misc_feature (382)..(382): n is a, c, g, or t
  modified_base (416)..(416): a, c, t, g, unknown or other
  misc_feature (416)..(416): n is a, c, g, or t
tcagcgatcgtatacacgaccggtgctcgatttagtatctgatagttgggtttgggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcacgtgggaccagcggtgactattggtatttataactatgtctcctggaccagcaccacccagacaaacgcccccaaatcatgatttangatgtcagtgatcgcctcgaggggtttcaactcgcttctctggctccaagtccggacaacgaccggccctccngacccatctctcggcctccgaggcccgaggacgnggctgattactactggcagtctacatactacaatacgaaataactagttcggggtgttaacgggacggttaacgggtaacccttaaacgtcggtaacccgttaccgttacgggttccaacggaccccgaagggtccctccggttcccccgtcggttaacccttaaccccg

SEQ ID NO: 309579 - DNA, 660 bp, Homo sapiens
  misc_feature: GZ8MTXP01DYTDT.51.38.D05.1.454.CMB.2.raw
  modified_base (308)..(308): a, c, t, g, unknown or other
  misc_feature (308)..(308): n is a, c, g, or t
  modified_base (457)..(457): a, c, t, g, unknown or other
  misc_feature (457)..(457): n is a, c, g, or t
tcagcgatcgtatacacgaccggtgctcgatttagtatctgatagttgggtttggggggggtctcaggaggcagcgctctcgggacgtctccaccatggcctgggctctgctattcctcaccctcctcactcagggcacagggtcctgggcccagtctgccctgactcagcctgcctcgtgtctgggtctcctggacagtcgatcaccatctcctgcacgtgggaccagcggtgacagtttggtatttaataactatgtctctggtaccagcaccaccaggacaaacgcccccaaatcatgtatttangatgtcagtgactccggcctagtacgggtttcgaattccgtccttcctcgtcggcctacccgaaacggtcccggcaaaccgaccgggtccccttacccctcgaccctattcccttcgtcgcccctaccgacgggccgaagggtaacggngggtactagtaatttacttactgactaggtacttactaaattaactaaactaaactacgtaaaattaaacgtaaggtttcggggttagttaccgggacgggaaacgggtaacccttaaacgtcgttacccgtacgtacggttaccgaccgttacccgaacggtcctccgtacccccgtggttaccctaaccttccgttccccg

SEQ ID NO: 309580 - DNA, 565 bp, Homo sapiens
  misc_feature: GZ8MTXP01C55WB.51.38.D05.1.454.CMB.2.raw
  modified_base (245)..(245): a, c, t, g, unknown or other
  misc_feature (245)..(245): n is a, c, g, or t
tcagcgatcgtatacacgaccggtgctcgatttagtatctgatagttgggtttgggggctggggtctcaggaggcagcgctctcgggacgtctccaccatggcctgggctctgctattcctcaccctcctcactcagggcacagggtcctgggcccagtctgccctgactcagcctgcctccgtgtctggtctcctggacagtcgatcacatctcctgcactgggaccagcggtgactattggtntttaataactatgtctcctggtaccagcaccacccaggccaaacgcccccaaactcatagatttatgatgtcagtgatcggccctgaggggtttcaactcgcttctctggcctccaagtccggacaaccacggccctccctgacccattctcgtcggcctccgacggccgaggacgaggctagattattactggctagctacataatacaataccaaataactagtgggtgttcgggcggaagggaaccaaacgtcgtaacccgttaccgttacggttcaacgacccgaacgtccgtccgccccgtcggttcctaacccg

SEQ ID NO: 309581 - DNA, 528 bp, Homo sapiens
  misc_feature: GZ8MTXP01E3R68.51.38.D05.1.454.CMB.2.raw
tcagcgatcgtatacacgaccggtgctcgatttagtatctgatagttgggtttgggggctttgcctgggctctgctattcctcaccctcctcactcagggcacagggtcctgggcccagtctgccctgactcagcctgcctccgtgtctgggtctcctggacagtcgatcaccatctcctgcactggggaccagcggtgacattggtgtttataactatgtctctggtaccagcaccaccaggcaaagcccccaaatcatgatttatgatgtcagtgatcggccctcaggggtttcaatcgcttctctggctccaagtcccggcaacacggcctccctgaccccatctctcggccctaccgagggcccgagggacgaggctgattatactgcagctacatatacaatcaataacattgggtgtcggcgggaggacaactgaccgtcagtcagccaggcctcgcccctggtcacgtcttcgttccccacccttccttcttcgtaagcaactctgacgtcgggcgtcggg

SEQ ID NO: 309582 - DNA, 561 bp, Homo sapiens
  misc_feature: GZ8MTXP01A6F2W.51.38.D05.1.454.CMB.2.raw
  modified_base (207)..(207): a, c, t, g, unknown or other
  misc_feature (207)..(207): n is a, c, g, or t
  modified_base (212)..(212): a, c, t, g, unknown or other
  misc_feature (212)..(212): n is a, c, g, or t
  modified_base (268)..(268): a, c, t, g, unknown or other
  misc_feature (268)..(268): n is a, c, g, or t
  modified_base (386)..(386): a, c, t, g, unknown or other
  misc_feature (386)..(386): n is a, c, g, or t
  modified_base (389)..(389): a, c, t, g, unknown or other
  misc_feature (389)..(389): n is a, c, g, or t
  modified_base (540)..(540): a, c, t, g, unknown or other
  misc_feature (540)..(540): n is a, c, g, or t
  modified_base (559)..(559): a, c, t, g, unknown or other
  misc_feature (559)..(559): n is a, c, g, or t
tcagcgatcgtatacacgaccggtgctcgatttagtatctgatagttgggtttgggggctttgcctgggctctgctattcctcaccctcctcactcagggcacagggtcctgggcccagtctgccctgactcagcctgcctccgtgtctgggtctcctggacagtcgatcaccatctcctgcactgggaccagcggtgacattggtntttanaactatgtctcctggtaccagcaccaccaggcaaacgcccccaaatcatgatttangatgtcagtgatcggccctgaggggtttcaatcgcttctctggctccaagtccggcaacacggcctcctgaccccatctcgtggccctccgaggccgagggacgaggctgattatacngcngctcatatacaatcaaataactaagttgggtagttcgggacggggtaacgggaaccaaacgtcgaaccgtccgtaggtacgacgccctaagggcctaccggcccctcggtaccttcgtccttcgttccccgccttccgttcttccgtaacnctcgtcgcggcgtcggcgngg

SEQ ID NO: 309583 - DNA, 534 bp, Homo sapiens
  misc_feature: GZ8MTXP01AVPTG.51.38.D05.1.454.CMB.2.raw
  modified_base (244)..(244): a, c, t, g, unknown or other
  misc_feature (244)..(244): n is a, c, g, or t
  modified_base (303)..(303): a, c, t, g, unknown or other
  misc_feature (303)..(303): n is a, c, g, or t
  modified_base (529)..(529): a, c, t, g, unknown or other
  misc_feature (529)..(529): n is a, c, g, or t
tcagcgatcgtatacacgaccggtgctcgatttagtatctgatagttgggtttggggtggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactgggaccagcggtgacattggtntttataactatgtctctggtaccagcaccaccagcaaacgcccccaaatcatgatttangatgtcagtgatcggcctcgtaggggtttcaatccgcttctcgtggctaccaacgtccggacaacgaccggccctccctgacctactctctcggccctccgaaggcccgagggacgaggctgattattactgcagctcatatacgaatacaaatactaagttggtgtcggaacggaggaccaaacgttgaccgtcaggttcacgccaggcctcgccccttaggtcncgtcc

SEQ ID NO: 309584 - DNA, 585 bp, Homo sapiens
  misc_feature: GZ8MTXP01ACVMI.51.38.D05.1.454.CMB.2.raw
  modified_base (248)..(248): a, c, t, g, unknown or other
  misc_feature (248)..(248): n is a, c, g, or t
  modified_base (308)..(308): a, c, t, g, unknown or other
  misc_feature (308)..(308): n is a, c, g, or t
  modified_base (392)..(392): a, c, t, g, unknown or other
  misc_feature (392)..(392): n is a, c, g, or t
  modified_base (452)..(452): a, c, t, g, unknown or other
  misc_feature (452)..(452): n is a, c, g, or t
  modified_base (561)..(561): a, c, t, g, unknown or other
  misc_feature (561)..(561): n is a, c, g, or t
tcagcgatcgtatacacgaccggtgctcgatttagtatctgatagttgggtttgggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcacgtgggaccagcggtgactattggtntttataactatgtctctggaccagcaccaccaggacaaacgcccccaaatcatgatttangatgtcagtgatcggcctgtacgggttcactcgcttctctggactccaacgtccggacaacgaccggtccctccctagaccctntcctcgtcggccctccggaggacccggagggaccgaagggtcctgtaactttagtttacnggctaagctactaataactaacaatactaaactaacgtaagttcggggtgttcgggacggaacgggtaaccaaacgtcgaccgttcgacggttcaacgccaacggtccnccggcccctaacggttcctaaccg

SEQ ID NO: 309585 - DNA, 718 bp, Homo sapiens
  misc_feature: GZ8MTXP01EL8OO.51.38.D05.1.454.CMB.2.raw
  modified_base (236)..(236): a, c, t, g, unknown or other
  misc_feature (236)..(236): n is a, c, g, or t
  modified_base (246)..(246): a, c, t, g, unknown or other
  misc_feature (246)..(246): n is a, c, g, or t
  modified_base (251)..(251): a, c, t, g, unknown or other
  misc_feature (251)..(251): n is a, c, g, or t
  modified_base (307)..(307): a, c, t, g, unknown or other
  misc_feature (307)..(307): n is a, c, g, or t
tcagcgatcgtatacacgaccggtgctcgatttagtatctgatagttgggtttgggggctggggtctcaggaggcagcgctctcgggacgtctccaccatggcctgggctctgctattcctcaccctcctcactcagggcacagggtcctgggcccagtctgccctgactcagcctgcctcgtgtctgggtctcctggacagtcgatcacatctcctgcacgtgggaccagcggtnactattggtntttanactatgtctcgtggtaccagcaccaccaggcaaacgcccccaatcatgtatttagngatgtacagtcgacgtcggcctgtacgggttcaacgtccgtacttctcgtcggtacctaccgaagtccgactaaccgccgggtcctcccgtagaccctacttcgtacgtcggcccttacgacgggtacccgtaaggtaccgtacgggtcttacgtaatttacgttaccgtacgggtaccgtaaggtccttaacggtaattaaccgtaaaccgtaaacgttaccgtaaaagttaacccgttaaggtttacgggggtaccgtttaaccggggaaccgggttaaacgggtaaacccttaaacggttacgggtaaccccgttaccggttaacgggttaccgtaaccgggtaccccgtaaagggttccccgtacccggttaccccccggtttaaggttaacccgtttaaccccggg

SEQ ID NO: 309586 - DNA, 603 bp, Homo sapiens
  misc_feature: GZ8MTXP01D7ZUT.51.38.D05.1.454.CMB.2.raw
  modified_base (247)..(247): a, c, t, g, unknown or other
  misc_feature (247)..(247): n is a, c, g, or t
  modified_base (298)..(298): a, c, t, g, unknown or other
  misc_feature (298)..(298): n is a, c, g, or t
tcagcgatcgtatacacgaccggtgctcgatttagtatctgatagttgggtttgggggctggggtctcaggaggcagcgctctcgggacgtctccaccatggcctgggctctgctattcctcaccctcctcactcagggcacagggtcctgggcccagtctgccctgactcagcctgcctcgtgtctgggtctcctggacagtcatcaccatctcctgcacgtgggaccagcggtgactattgggtntttaataactatgtctctggaccagcaccaccaggacaaacgaccccaaancatagtatttatgattgtcagtgactccggcctcgtaggggttcgaactcgtcttctctggacctaccaacggtcccgacaaccgaccggccctccctgaccctactctcgtcggccctcgacgggaccgacggacgagtctagtatttattactagggcagtcctactaataataaccaaatacgaaattaaacgaagtttgggtagttcgggacggaacgggtaaccaaacgtcgaacccgttacgttacggttaccaacgccccgaacggtccctaccgttcccccgtcggttcctaacccg

SEQ ID NO: 309587 - DNA, 678 bp, Homo sapiens
  misc_feature: GZ8MTXP01EBL97.51.38.D05.1.454.CMB.2.raw
  modified_base (320)..(320): a, c, t, g, unknown or other
  misc_feature (320)..(320): n is a, c, g, or t
  modified_base (347)..(347): a, c, t, g, unknown or other
  misc_feature (347)..(347): n is a, c, g, or t
tcagcgatcgtatacacgaccggtgctcgatttagtatctgatagttgggtttgggggaggcgtggtccagcctgggaggtccctgagactcgcctgtaaaccgtccggattcaccttcagtaactatgcaatgcactgggtccgccaggctccaggcaaggggctggactgggtggcaggcatatcatttgatggaagcaagaagtactatgcagactccgtgaagggccgattcaccatctccagagacagttccgatgacacagtctatctacacatgagcagtgtgagacctgacgacacggtcttcttttttacngtgcgccaggaagcagtggctggccanaatcaatgtcttttgattatcgtgggacgaccgaagggacaagtggtcagttcgttcttcgttccgggccctacccgaaccgaaacggggcccctaacggttcccgggttccctttccccccgtcgggtacccctaacccccgttccccgtacccgaaacggaccgtacccgtaacccgttcccgggtcggggggaaccctaaaccggcgggtccccggggttccccggtcgggggtcccttccggggttccccggttacggggttaacccggaaaacgggttaaccctttaacccgtttcccggttaccggttaaccgcccgttaacccg

SEQ ID NO: 309588 - DNA, 594 bp, Homo sapiens
  misc_feature: GZ8MTXP01EIJPD.51.38.D05.1.454.CMB.2.raw
  modified_base (242)..(242): a, c, t, g, unknown or other
  misc_feature (242)..(242): n is a, c, g, or t
  modified_base (247)..(247): a, c, t, g, unknown or other
  misc_feature (247)..(247): n is a, c, g, or t
  modified_base (252)..(252): a, c, t, g, unknown or other
  misc_feature (252)..(252): n is a, c, g, or t
  modified_base (301)..(301): a, c, t, g, unknown or other
  misc_feature (301)..(301): n is a, c, g, or t
  modified_base (344)..(344): a, c, t, g, unknown or other
  misc_feature (344)..(344): n is a, c, g, or t
  modified_base (488)..(488): a, c, t, g, unknown or other
  misc_feature (488)..(488): n is a, c, g, or t
tcagcgatcgtatacacgaccggtgctcgatttagtatctgatagttgggtttgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactgggaccagcggtgacattggtntttanaactntgtctcctggtacagcaccacccagcaaagcccccaaatcatgatttangatgtcagtgactcggcctagtaggggtttcaatcgtccttcnctggcctaccaaagtcccggcaacgaccggccctcccctgacccattcctcgtcggacctccgaggcccgaggaccgaggctgaattatactgcaggctacataataacaatacaaagtaaactaagttggggtgttaccgggngggaaacgggtaaccaaaacgtcgacccggttaccgtaagggttaccacggaccccgaaagggtcctccgggtccccctcgggttaccctaacttcccgtttcccg

SEQ ID NO: 309589 - DNA, 683 bp, Homo sapiens
  misc_feature: GZ8MTXP01DO9GA.51.38.D05.1.454.CMB.2.raw
  modified_base (310)..(310): a, c, t, g, unknown or other
  misc_feature (310)..(310): n is a, c, g, or t
tcagcgatcgtatacacgaccggtgctcgatttagtatctgatagttgggtttggggtggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcacgtgggaccagcggtgactagttggtatttataaactatgtctctggtaccagcaccaccaggacaaacgcccccaaatcatgtatttangatgtcagtgactccggtcctcggtaggggtttcaacttccgtcttctcgtcggcctaacccgaacgtcccggacaaaccgacccgggcccctccctacggacctactcccttcgtccgggccctaccggacgggaccccggaagggaccggacggtaccgttagttaactttaacttacgtcggacaacgtctaactaataactaaccaaagttactaaaacgttaacgtaaagggtttcggggtacggtttacggggaacgggaacgggttaaccctaaaacggttcggtaaacccgttccgttaacgggttccaaccggccccgaaaggtcccgtcccgtccccgttacggttccgttaacctttccccg

SEQ ID NO: 309590 - DNA, 565 bp, Homo sapiens
  misc_feature: GZ8MTXP01BNIMN.51.38.D05.1.454.CMB.2.raw
  modified_base (234)..(234): a, c, t, g, unknown or other
  misc_feature (234)..(234): n is a, c, g, or t
  modified_base (243)..(243): a, c, t, g, unknown or other
  misc_feature (243)..(243): n is a, c, g, or t
  modified_base (248)..(248): a, c, t, g, unknown or other
  misc_feature (248)..(248): n is a, c, g, or t
  modified_base (419)..(419): a, c, t, g, unknown or other
  misc_feature (419)..(419): n is a, c, g, or t
  modified_base (424)..(424): a, c, t, g, unknown or other
  misc_feature (424)..(424): n is a, c, g, or t
tcagcgatcgtatacacgaccggtgctcgatttagtatctgatagttgggtttgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggggaccagcggtnacattggtntttanaactatgtctctggtaccagcacaccaggcaaacgcccccaaatcatgatttatgatgtcagtgatcggcctcgagggtttcaatcgccttctctggctccaaagtccggcaacacggccctcctgaccatctctggcctcgaggccgaggacgaggctgattatactgcnggctnatatacaatacaataaacaagtttggggtacgttcgggcggtaacgggaacccttaaacgtcggacccgttccgtaggttaccgacggaccccgaagggcctccggcccccgttgggttccctaaccgttccgtttccccg

SEQ ID NO: 309591 - DNA, 548 bp, Homo sapiens
  misc_feature: GZ8MTXP01A2O3Y.51.38.D05.1.454.CMB.2.raw
  modified_base (243)..(243): a, c, t, g, unknown or other
  misc_feature (243)..(243): n is a, c, g, or t
  modified_base (304)..(304): a, c, t, g, unknown or other
  misc_feature (304)..(304): n is a, c, g, or t
  modified_base (355)..(355): a, c, t, g, unknown or other
  misc_feature (355)..(355): n is a, c, g, or t
  modified_base (359)..(359): a, c, t, g, unknown or other
  misc_feature (359)..(359): n is a, c, g, or t
tcagcgatcgtatacacgaccggtgctcgatttagtatctgatagttgggtttgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactgggaccagcggtgactattggtntttataactatgtctcctggtaccagcaccaccaggcaaacgcccccaaatcatgatttangatgtcagtgatcggcctgagggtttcatcgcttctctgctcaaagtccgnaacncgcctcctgaccatctctggcctcgaggccgaggacgaggctagattagtactgcaggtctacatatacaatcaaataactaagttgggtgttcgggcgggaacgggaaccaaacgtcggaacccgttcgtaaggttccacgaccccgaagggccttccgcccccgtggttacctaaccttcgttcccg

SEQ ID NO: 309592 - DNA, 664 bp, Homo sapiens
  misc_feature: GZ8MTXP01CWW4C.51.38.D05.1.454.CMB.2.raw
  modified_base (244)..(244): a, c, t, g, unknown or other
  misc_feature (244)..(244): n is a, c, g, or t
tcagcgatcgtatacacgaccggtgctcgatttagtatctgatagttgggtttgggggctggggtctcaggaggcagcgctctcgggacgtctccaccatggcctgggctctgctattcctcaccctcctcactcagggcacagggtcctgggcccagtctgccctgactcagcctgcctccgtgtctggtctcctggacagtcgatcacatctctgcacgtgggaccagcggtgacattggtntttataactatgtctctggtaccagcaccaccaggcaaacgccccaaactcatgatttatgatgtcagtgacgtcggccctcgtagggggtttcaactcggtctttcgtcgtcgggtacctcccgaacggttcccggaccaaaccgtaccgggcccttcccctggaaccctattcctccgttcgggccctaccgacgggccgaagggacgtaagggcctagtatttaacgttacgtcggggacacgtaccttaccaattactaaacgaaacttaccaaaattaaacgtaaagtttggggttcggtttaacggggcggttaaacggggaacccttaaaacgttccggtacccggttaccgttacgggttaccgaaccggcccgaaacggggccctcggacccccttcgggttcctaacccg

SEQ ID NO: 309593 - DNA, 596 bp, Homo sapiens
  misc_feature: GZ8MTXP01B0BOB.51.38.D05.1.454.CMB.2.raw
  modified_base (238)..(238): a, c, t, g, unknown or other
  misc_feature (238)..(238): n is a, c, g, or t
  modified_base (255)..(255): a, c, t, g, unknown or other
  misc_feature (255)..(255): n is a, c, g, or t
  modified_base (313)..(313): a, c, t, g, unknown or other
  misc_feature (313)..(313): n is a, c, g, or t
  modified_base (398)..(398): a, c, t, g, unknown or other
  misc_feature (398)..(398): n is a, c, g, or t
  modified_base (569)..(569): a, c, t, g, unknown or other
  misc_feature (569)..(569): n is a, c, g, or t
tcagcgatcgtatacacgaccggtgctcgatttagtatctgatagttgggtttgggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcacgtgggaccagcggtnactagttggtgtttaanaactatgtctcctggaccagcaccaccaggaccaaacgcccccaaatcatgtatttangatgtcagtgagtccgcctgtaggggtttcaactcgtcttctctcggacctccgaacgtcccgacaaaccgccggtccctcccgngacccattctaccgtcgcctccgacggcccggaaggcggagctagtattactactggctagtctctaatataaccaaattacaaattaaacaagtttgggtcggttcgggacggggacggaccaaacgtcggtaccgttaccgttcggttcaacggccccgtaaggtcccnccgggttccccctcggttaacctcccg

SEQ ID NO: 309594 - DNA, 543 bp, Homo sapiens
  misc_feature: GZ8MTXP01CG15L.51.38.D05.1.454.CMB.2.raw
  modified_base (302)..(302): a, c, t, g, unknown or other
  misc_feature (302)..(302): n is a, c, g, or t
  modified_base (535)..(535): a, c, t, g, unknown or other
  misc_feature (535)..(535): n is a, c, g, or t
tcagcgatcgtatacacgaccggtgctcgatttagtatctgatagttgggtttggggtggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactgggaccagcggtgactattggtgtttataactatgtctctggtacagcaccaccagcaaacgccccaaatcatgatttangtatgtcagtgatcggcctgagggttcaatccgcttctcgtgctacacgtccggacaacacggccctccgtcgaccatctctcggccctcgacggccgaggacgaggctagattactactgacagctacaatatacaaatacaaataactaagtttgggtgttcgggaacgggaacggaactaaacgttcgaccggtcttaggttcacgccaacggctccgccccttcgtccncgttcccg

SEQ ID NO: 309595 - DNA, 568 bp, Homo sapiens
  misc_feature: GZ8MTXP01E0DOG.51.38.D05.1.454.CMB.2.raw
  modified_base (247)..(247): a, c, t, g, unknown or other
  misc_feature (247)..(247): n is a, c, g, or t
  modified_base (307)..(307): a, c, t, g, unknown or other
  misc_feature (307)..(307): n is a, c, g, or t
  modified_base (382)..(382): a, c, t, g, unknown or other
  misc_feature (382)..(382): n is a, c, g, or t
  modified_base (416)..(416): a, c, t, g, unknown or other
  misc_feature (416)..(416): n is a, c, g, or t
  modified_base (542)..(542): a, c, t, g, unknown or other
  misc_feature (542)..(542): n is a, c, g, or t
tcagcgatcgtatacacgaccggtgctcgatttagtatctgatagttgggtttgggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactgggaccagcggtgactattggtntttataactatgtctctggaccagcaccaccaggacaaacgccccaaactcatgatttangatgtcagtgatcggcctcgtaggggttcaactcgtcttctctggcctccaagtcccggacaacaccggcctccngaccatctcgtcggcctcgacggaccgaggacgnggctgtattatactgggctacgctacatactaactatacaaataactaagttcgggtgttcgggcggaacgggtaaccaaacgtcggaaccgttccgttggttacgaaccgacccgtaacggcccncggttcccccgtcggttcctaacccg

SEQ ID NO: 309596 - DNA, 539 bp, Homo sapiens
  misc_feature: GZ8MTXP01EBWWS.51.38.D05.1.454.CMB.2.raw
  modified_base (167)..(167): a, c, t, g, unknown or other
  misc_feature (167)..(167): n is a, c, g, or t
  modified_base (247)..(247): a, c, t, g, unknown or other
  misc_feature (247)..(247): n is a, c, g, or t
  modified_base (253)..(253): a, c, t, g, unknown or other
  misc_feature (253)..(253): n is a, c, g, or t
  modified_base (309)..(309): a, c, t, g, unknown or other
  misc_feature (309)..(309): n is a, c, g, or t
  modified_base (386)..(386): a, c, t, g, unknown or other
  misc_feature (386)..(386): n is a, c, g, or t
tcagcgatcgtatacacgaccggtgctcgatttagtatctgatagttgggtttggggggggtctcaggaggcagcgctctcgggacgtctccaccatggcctgggctctgctattcctcaccctcctcactcagggcacagggtcctgggcccagtcctgcccggtnactcagcctgcctcgtgtctgggtctcctggacagtcgatcaccatctcctgcacgtgggaccagcggtgactattggtntttaanaactatgtctctggtaccagcaccaccaggacaaacgcccccaaatcatgatttangatgcagtgactcggcctgtaggggtttcatcgtcttctctgcctcaaacgtccgcaacacgcctcctgacatctcngcctcgagccgaggacgaggctagattatactgctaggctacaattaataacaatactaaataaactagttgggtagtcgggaggaacgggaccaaagtcgacgtcgtagccagccccaaggcctccgccccgttgccctaacgttcttcccg

SEQ ID NO: 309597 - DNA, 655 bp, Homo sapiens
  misc_feature: GZ8MTXP01CGUL0.51.38.D05.1.454.CMB.2.raw
  modified_base (268)..(268): a, c, t, g, unknown or other
  misc_feature (268)..(268): n is a, c, g, or t
  modified_base (383)..(383): a, c, t, g, unknown or other
  misc_feature (383)..(383): n is a, c, g, or t
tcagcgatcgtatacacgaccggtgctcgatttagtatctgatagttgggtttgggggctttgcctgggctctgctattcctcaccctcctcactcagggcacagggtcctgggcccagtctgccctgactcagcctgcctccgtgtctgggtctcctggacagtcgatcaccatctcctgcactgggaccagcggtgacattggtgtttataactatgtctcctggtaccagcaccaccaggacaaacgccccaaatcatgatttangatgtcagtgatcggccctgtaggggtttcaatcgtcttctctggctccagtccggcaacgaccggcctccctgacccccatctcgtcggccctacccgagggccgagggtacgnggctagatttactactgcagctacaatataacaatacaaattaacgaagttggggtgttacgggacgggggaacggaacctaaacgtcggaacccgtccgtaacggttaccaaccggacccgtaaacgggtccctacccggtccccccgttaacgggttcccttaacccgttcccgttcccggtttacccccctaccccttccccgttccgttaccgggtttaacccgcccgttaaccgtccggtacgggaccgggtccggggcgtaacggg

SEQ ID NO: 309598 - DNA, 559 bp, Homo sapiens
  misc_feature: GZ8MTXP01BCYLH.51.38.D05.1.454.CMB.2.raw
  modified_base (245)..(245): a, c, t, g, unknown or other
  misc_feature (245)..(245): n is a, c, g, or t
  modified_base (250)..(250): a, c, t, g, unknown or other
  misc_feature (250)..(250): n is a, c, g, or t
  modified_base (255)..(255): a, c, t, g, unknown or other
  misc_feature (255)..(255): n is a, c, g, or t
tcagcgatcgtatacacgaccggtgctcgatttagtatctgatagttgggtttgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcacgtgggaccagcggtgactagttggtntttanaactntgtctctggtaccagcaccaccaggcaaacgcccccaaatcatgatttatgatgtcagtgatcggcctgagggtttcatcgcttctctggcctccgaaaagtcccggcaacaccgggccctccctgacccatcctctggccctcgacggccgaggacgaggtctgtattactactgacaggctcatactacaatcaaataactaagttggggtacgttcgggcgggtaacggaaccaaacgtcgaacccgtcgtagggttcacgccaaggcctaaccgcccctcggttaccaacgttcgtcccg

SEQ ID NO: 309599 - DNA, 551 bp, Homo sapiens
  misc_feature: GZ8MTXP01CHPKF.51.38.D05.1.454.CMB.2.raw
  modified_base (246)..(246): a, c, t, g, unknown or other
  misc_feature (246)..(246): n is a, c, g, or t
  modified_base (483)..(483): a, c, t, g, unknown or other
  misc_feature (483)..(483): n is a, c, g, or t
  modified_base (535)..(535): a, c, t, g, unknown or other
  misc_feature (535)..(535): n is a, c, g, or t
tcagcgatcgtatacacgaccggtgctcgatttagtatctgatagttgggtttgggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctctgcactgggaccagcggtgactattggtntttataactatgtctcctggaccagcaccaccaggcaaacgccccaaactcatgatttatgatgtcagtgatcggccctcgagggttcaactcgcttctctggctccaagtcccggacaaccacggccctccctcgaccactcgtctcggcctccgaggcccgagggacgaggctgtaattagttaactgggcagcttacaatataacaatacaaataactagttgggtgttcgggnggacgggaccaaacgtcgtaccgttcgttagttcgaagcccgaagccgtccnccccgtcgttccgtcc

SEQ ID NO: 309600 - DNA, 594 bp, Homo sapiens
  misc_feature: GZ8MTXP01EVHVE.51.38.D05.1.454.CMB.2.raw
  modified_base (311)..(311): a, c, t, g, unknown or other
  misc_feature (311)..(311): n is a, c, g, or t
tcagcgatcgtatacacgaccggtgctcgatttagtatctgatagttgggtttggggtggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactgggaccaggcggtgactagtttggtgtttaataactatgtctcctggtaccagcaccacccaggcaaacgcccccaaatcatgatttangatgtcagtgatcggcctgaggggtttcaatcccgctttctcgtggcctacccgaagtcccggacaaaccgccgggtccctcccgtgaccctatcctcgtcggccctcgagggccgaaggacgaggctagattatactgcagtctacatataacaatacaaattaactaagttgggtcgttcgggcgggtaacgggaaccaaacgttgaacccgttcgttagggttccaacggccccgaaaggtcccttcccggccccccttcgggtcccttaacgtttcccg

SEQ ID NO: 309601 - DNA, 792 bp, Homo sapiens
  misc_feature: GZ8MTXP01B7ZTB.51.38.D05.1.454.CMB.2.raw
  modified_base (249)..(249): a, c, t, g, unknown or other
  misc_feature (249)..(249): n is a, c, g, or t
  modified_base (283)..(283): a, c, t, g, unknown or other
  misc_feature (283)..(283): n is a, c, g, or t
  modified_base (288)..(288): a, c, t, g, unknown or other
  misc_feature (288)..(288): n is a, c, g, or t
  modified_base (789)..(792): a, c, t, g, unknown or other
  misc_feature (789)..(792): n is a, c, g, or t
tcagcgatcgtatacacgaccggtgctcgatttagtatctgatagttgggtttgggggaggcgtggtccagcctgggaggtccctgagactcgcctgtaaaccgtccggattcaccttcagtaactatgcaatgcactgggtccgccaggctccgaggcaaggggctggactggggtggcaggcatatcatttgatggaagacaagaagtactatgcagactcgtagaaggccattcaccatctcaganactagttccatcgacacgatccatactacagtanagagngagtgtagacgaccgtacgacgtacgtaacggtacgttttacgttttttacgtttcgttcggtacgaccgaacggaaaggaccgaacggttaggtcgtacgggtacccgaactaaacctactaacttcgttacgttttaggttaattaagttaccggttaggtaaacggtaacccggtaaacgggtaaacgaaacgtagggttacgttaacgttaccggtttacccgtttaccgtttcccggaccccgttaccccgtaaaccccggaaacccggggtaccccgtaacccggggttaccccggtttaccccgttttaccccccggtttccccgggaccccgtaacccccgtttaccccgtaaccctaaacccggtaaccggtaccccgaaccccggtttacccgggtcccgggggtaacccgggtaaacccggttacccggggtaccccgggcccccgggttaccgggggttcccgggtttacccgggccccgggttacccnnnn

SEQ ID NO: 309602 - DNA, 549 bp, Homo sapiens
  misc_feature: GZ8MTXP01DWH9G.51.38.D05.1.454.CMB.2.raw
  modified_base (320)..(320): a, c, t, g, unknown or other
  misc_feature (320)..(320): n is a, c, g, or t
tcagcgatcgtatacacgaccggtgctcgatttagtatctgatagttgggtttgggggagacgtggtccagcctgggaggtccctgagactcgcctgtaaaccgtccggattcaccttcagtaactatgcaatgcactgggtccgccaggctccaggcaaggggctggactgggtggcaggcatatcatttgatggaagcaagaagtactatgcagactccgtgaagggccattcaccatctccagagacagttccgatgacacagtctatctacacatgagcagtgtgagacctgacgacacggtctttcttttttacngtgcgccaggaagcagtggctggccacaatctaatgtcttttgatatcgtggagcgaagggacaagtggtacatcgtctcgtccgccctaccaccgaacggccctagttccggtccttccccgtcggccacccctcctaccaagcgcctacctcgtcggggccacgacggccgggccgtcggggcttcggccttggtcaacggccttacgtcccgttagtcgctaaccg

SEQ ID NO: 309603 - DNA, 520 bp, Homo sapiens
  misc_feature: GZ8MTXP01B3Z18.51.38.D05.1.454.CMB.2.raw
  modified_base (244)..(244): a, c, t, g, unknown or other
  misc_feature (244)..(244): n is a, c, g, or t
tcagcgatcgtatacacgaccggtgctcgatttagtatctgatagttgggtttggggctggggtctcaggaggcagcgctctcgggacgtctccaccatggcctgggctctgctattcctcaccctcctcactcagggcacagggtcctgggcccagtctgccctgactcagcctgcctcgtgtctgggtctcctggacagtcgatcaccatctcctgcactgggaccagcggtgacattggtntttataactatgtctcctggtaccagcaccacccaggcaaagcccccaaatcatgatttatgatgtcagtgatcggccctcaggggtttcaatcgcttctctggctccaagtccgcaacacggcctcctgaccatctctcgcctccgaggccgaggacgaggctgattattactggcagctacatatacaatacaaataacaaagttgggtgttcggcggaggaccaaacgtgaccgttcgttagttcaagcccaaggctcgcccctggttcctcc

SEQ ID NO: 309604 - DNA, 523 bp, Homo sapiens
  misc_feature: GZ8MTXP01EXAMW.51.38.D05.1.454.CMB.2.raw
  modified_base (246)..(246): a, c, t, g, unknown or other
  misc_feature (246)..(246): n is a, c, g, or t
  modified_base (434)..(434): a, c, t, g, unknown or other
  misc_feature (434)..(434): n is a, c, g, or t
tcagcgatcgtatacacgaccggtgctcgatttagtatctgatagttgggtttgggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactgggaccagcggtgacattggtntttataactatgtctctggaccagcaccacccaggcaaagcccccaaaactcatgatttatgatgtcagtgatcggcctcgaggggtttcaatcgcttctctggctccaagtccggcaaacacggcctccctgaccatctctggccctcgaggccgaggacgaggctgattatactggcagctcatanacaatacaaataacaattgggtgttcgggcggagggaccaaactgaccgttcgttaggttcaagcccaaggctacgcccctggttctcc

SEQ ID NO: 309605 - DNA, 657 bp, Homo sapiens
  misc_feature: GZ8MTXP01B8I8W.51.38.D05.1.454.CMB.2.raw
  modified_base (309)..(309): a, c, t, g, unknown or other
  misc_feature (309)..(309): n is a, c, g, or t
tcagcgatcgtatacacgaccggtgctcgatttagtatctgatagttgggtttggggtggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactgggaccagcggtgacatttggtgtttataactatgtctcctggtaccagcaccacccaggacaaacgcccccaaactcatgatttangatgtcagtgatcggcctcgtaggggtttcaactccgctttctcgtcggcctaaccgaacgtccggacaaacaccgggccctaccctcgaccacttcctccgtcgggccctccgaacgggcccggacggacgaggtctaggatttactactcggacacgtcctcaaattaactaactaaactacgtaaaattaaacgtaaagtttagggggttcgttccggggaacggggaaacgggaaccctaaaaccgttcggtaaacccggttacccgttaacggggttccaaccggtcccgtaaacgggcccgttacccggccccccttcggggtaacccttcccgtttccccg

SEQ ID NO: 309606 - DNA, 582 bp, Homo sapiens
  misc_feature: GZ8MTXP01B4P2E.51.38.D05.1.454.CMB.2.raw
  modified_base (247)..(247): a, c, t, g, unknown or other
  misc_feature (247)..(247): n is a, c, g, or t
  modified_base (258)..(258): a, c, t, g, unknown or other
  misc_feature (258)..(258): n is a, c, g, or t
  modified_base (310)..(310): a, c, t, g, unknown or other
  misc_feature (310)..(310): n is a, c, g, or t
  modified_base (389)..(389): a, c, t, g, unknown or other
  misc_feature (389)..(389): n is a, c, g, or t
tcagcgatcgtatacacgaccggtgctcgatttagtatctgatagttggggtttgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcacgtgggaccaggcggtgactattgggtntttaataactntgtctctggtaccagccaccaccagaccaaacgcccccaaatcatgatttangatgtcagtgactcggcctgtagggttcatcgtcttctctgcctccaaagtccgcacaccggcctccctgaccatctcncggcctacgacgccggaggacgtggactgaattactactgacaggtctataataactaacaaataccaaagtaaactaaggttggggtcgttcgggacgggaacgggaaccttaacgtcgaccgtaccgtacggttccgacgacccgaacgcccgtaacgtcccccgtacggttcctaaccgttccgttcccg

SEQ ID NO: 309607 - DNA, 594 bp, Homo sapiens
  misc_feature: GZ8MTXP01CE0PP.51.38.D05.1.454.CMB.2.raw
  modified_base (248)..(248): a, c, t, g, unknown or other
  misc_feature (248)..(248): n is a, c, g, or t
  modified_base (304)..(304): a, c, t, g, unknown or other
  misc_feature (304)..(304): n is a, c, g, or t
  modified_base (343)..(343): a, c, t, g, unknown or other
  misc_feature (343)..(343): n is a, c, g, or t
  modified_base (405)..(405): a, c, t, g, unknown or other
  misc_feature (405)..(405): n is a, c, g, or t
tcagcgatcgtatacacgaccggtgctcgatttagtatctgatagttgggtttgggggctggggtctcaggaggcagcgctctcgggacgtctccaccatggcctgggctctgctattcctcaccctcctcactcagggcacagggtcctgggcccagtctgccctgactcagcctgcctccgtgtctggtctcctggacagtcgatcaccatctctgcacgtgggaccagcggtgactatttgggtntttaatactatgtctctggaccagcaccaccaggcaaacgccccaatcatgattangatgtcagtgactcgcctcgtaggggtttacaacttcgnttctctggaccttcaacgtccgacaacgaccggcctccctgaccctatctccgcggtccccncgacggacgagacgagtctagtaattatacgcgtacgtagtactactaataataaactaaactaactaaactaaacgtaaaggttacgggtacgggttaacgggtacgggaacggtaaaccgaaacgtacgtaccgttaccgttcgttacgaaccgaccgaacgccgtcccgcccgtccgttccgtccg

SEQ ID NO: 309608 - DNA, 577 bp, Homo sapiens
  misc_feature: GZ8MTXP01BEDJQ.51.38.D05.1.454.CMB.2.raw
  modified_base (245)..(245): a, c, t, g, unknown or other
  misc_feature (245)..(245): n is a, c, g, or t
  modified_base (250)..(250): a, c, t, g, unknown or other
  misc_feature (250)..(250): n is a, c, g, or t
tcagcgatcgtatacacgaccggtgctcgatttagtatctgatagttgggtttgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcacgtgggaccaggcggtgactattggtntttanaactatgtctcctggtaccagcaccacccaggcaaacgcccccaaatcatgatttatgatgtcagtgactcggcctcgtaggggtttcaatcgccttctctggcctccaaacgtcccggcaacgaccggccctccctgaccatctctcggcctcgacggccgaggacgaggctgattatactgcaggctcaatatacaatacaaataactaagttgggtcgttcgggcggtaagggaaccaaacgtcggaccgtaccgtaggttaccgacggaccccgaaggtccctaacccggtcccccgtcggttacctaaccttccgttccccg

SEQ ID NO: 309609 - DNA, 583 bp, Homo sapiens
  misc_feature: GZ8MTXP01ALI28.51.38.D05.1.454.CMB.2.raw
  modified_base (212)..(212): a, c, t, g, unknown or other
  misc_feature (212)..(212): n is a, c, g, or t
  modified_base (267)..(267): a, c, t, g, unknown or other
  misc_feature (267)..(267): n is a, c, g, or t
  modified_base (435)..(435): a, c, t, g, unknown or other
  misc_feature (435)..(435): n is a, c, g, or t
tcagcgatcgtatacacgaccggtgctcgatttagtatctgatagttgggtttgggggctttgcctgggctctgctattcctcaccctcctcactcagggcacagggtcctgggcccagtctgccctgactcagcctgcctccgtgtctgggtctcctggacagtcgatcaccatctcctgcactgggaccagcggtgacattggtgtttanaactatgtctctggtaccagcaccaccaggcaaacgcccccaaatcatgatttangatgtcagtgatcggccctcgaggggtttcaatcgcttctctggcctccgaaagtcccggacaaccacggccctcccgtggccccatctcgtcggccctccgaggcccgagggaccgagggctgattattactgcagctacatatacaatcaaataacaagtttgggngttacgggcggggtaacgggaacctaaaccgtgacccgtccgtaggtcaacgcccaagggcctcgcccccgttggtccacttccttccgttccccacccttcccttcttccgtaacgctaactcgtcggacggcgggttcgtaacggg

SEQ ID NO: 309610 - DNA, 542 bp, Homo sapiens
  misc_feature: GZ8MTXP01BK76B.51.38.D05.1.454.CMB.2.raw
  modified_base (268)..(268): a, c, t, g, unknown or other
  misc_feature (268)..(268): n is a, c, g, or t
  modified_base (305)..(305): a, c, t, g, unknown or other
  misc_feature (305)..(305): n is a, c, g, or t
  modified_base (506)..(506): a, c, t, g, unknown or other
  misc_feature (506)..(506): n is a, c, g, or t
  modified_base (517)..(517): a, c, t, g, unknown or other
  misc_feature (517)..(517): n is a, c, g, or t
tcagcgatcgtatacacgaccggtgctcgatttagtatctgatagttgggtttgggggctttgcctgggctctgctattcctcaccctcctcactcagggcacagggtcctgggcccagtctgccctgactcagcctgcctccgtgtctgggtctcctggacagtcgatcaccatctcctgcactgggaccagcggtgacattggtgtttataactatgtctcctggtaccagcaccacccaggcaaagcccccaaatcatgatttangatgtcagtgatcggccctcgaggggtttcgaatcgnttctctggctccaagtccggcaacacggcctccctgacccccatctctcggcctcccaggccgagggacgaggctgattattactgcagctcatataacaatacaaataactaagttgggtgttcgggacggggtagggaccaaacgtcgaccgtccgtaggtcacgccaaggcctcgcccctcggtcactcttcgtcccncccttccttcnctaagcaactctgagcgggcgtcgg

SEQ ID NO: 309611 - DNA, 669 bp, Homo sapiens
  misc_feature: GZ8MTXP01AN21Z.51.38.D05.1.454.CMB.2.raw
  modified_base (207)..(207): a, c, t, g, unknown or other
  misc_feature (207)..(207): n is a, c, g, or t
  modified_base (431)..(431): a, c, t, g, unknown or other
  misc_feature (431)..(431): n is a, c, g, or t
tcagcgatcgtatacacgaccggtgctcgatttagtatctgatagttgggtttgggggctttgcctgggctctgctattcctcaccctcctcactcagggcacagggtcctgggcccagtctgccctgactcagcctgcctccgtgtctgggtctcctggacagtcgatcaccatctcctgcactgggaccagcggtgacattggtntttaataactatgtctctggtaccagcaccaccaggcaaacgcccccaaatcatgtattatgatgtcagtgacgtccggcccgtgtaggggtttcaagtccgtcttctcgtcggcctaccgaacgtcccggacaaaccgaccggtccctccctcgaccccctactctcgtccggccctaacccgacgggcccgagggaccgagggtctaggtaacttacttacngcatctatataactaacaatactaaataacgtaagttgggtagttacgggacgggggaacgggtaacctaaaccgtcggtaacccgtccgtaggaccaaccggccgtaaccgggtcctcccggtcccccgttaacggtcccttccgtcccgtttcccgttcccccgtcccctttcccgttccgttccgggtaactccctaaccgtttccgtcgggaccgggtcgggttcccgtaaggg

SEQ ID NO: 309612 - DNA, 585 bp, Homo sapiens
  misc_feature: GZ8MTXP01APU46.51.38.D05.1.454.CMB.2.raw
  modified_base (245)..(245): a, c, t, g, unknown or other
  misc_feature (245)..(245): n is a, c, g, or t
  modified_base (269)..(269): a, c, t, g, unknown or other
  misc_feature (269)..(269): n is a, c, g, or t
  modified_base (308)..(308): a, c, t, g, unknown or other
  misc_feature (308)..(308): n is a, c, g, or t
  modified_base (360)..(360): a, c, t, g, unknown or other
  misc_feature (360)..(360): n is a, c, g, or t
  modified_base (372)..(372): a, c, t, g, unknown or other
  misc_feature (372)..(372): n is a, c, g, or t
tcagcgatcgtatacacgaccggtgctcgatttagtatctgatagttgggtttgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggggaccaggcggtgacatttggtntttataactatgtctctggtaccngcaccacccaggacaaacgcccccaaactcatgatttangatgtcagtgatcggcctgagggttcaatcgcttctctgctcaaagtccggnacacggcctccngaccatctctcggcctcgacggccgagggacgacggctcgattagttactgacaggctcatactacaatacaaataactaaagttcggggtacgttcgggacgggaacgggtaacccgttaaacgttcggaccggttaccgtacgggttccgacgggaccccgtaagggcccttaaccggccccccttcgggttcctaaccttccgttccccg

SEQ ID NO: 309613 - DNA, 640 bp, Homo sapiens
  misc_feature: GZ8MTXP01B0TGR.51.38.D05.1.454.CMB.2.raw
  modified_base (199)..(199): a, c, t, g, unknown or other
  misc_feature (199)..(199): n is a, c, g, or t
  modified_base (245)..(245): a, c, t, g, unknown or other
  misc_feature (245)..(245): n is a, c, g, or t
  modified_base (256)..(256): a, c, t, g, unknown or other
  misc_feature (256)..(256): n is a, c, g, or t
  modified_base (307)..(307): a, c, t, g, unknown or other
  misc_feature (307)..(307): n is a, c, g, or t
  modified_base (602)..(602): a, c, t, g, unknown or other
  misc_feature (602)..(602): n is a, c, g, or t
tcagcgatcgtatacacgaccggtgctcgatttagtatctgatagttgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacngtcgatcaccatctcctgcactgggaccaggcggtgactattggtntttaataactntgtctctgtaccagcaccacccagacaaacgcccccaaactcatgatttangatgtcagtgatcggcctgtacggggtttcattccgtccttctcgtggcctccaaaacgtcccggccaaaccacccgggcccttccccgtcgaaccctactcccttcgtcggccctaccgacggggacccgaagggaccgagggtctaggaatttactacgtgcctaacgctactaataactaacaaatacgaaaattaaacgtaagtttgggggtacgttcgggcgggaacggggtaaccccttaaaggtccgacccggtaccgtaaggttaccgaccggacccgaagggtccncccggtcccccgtcggttacctaaccttccgttccccg

SEQ ID NO: 309614 - DNA, 528 bp, Homo sapiens
  misc_feature: GZ8MTXP01DPWGZ.51.38.D05.1.454.CMB.2.raw
  modified_base (246)..(246): a, c, t, g, unknown or other
  misc_feature (246)..(246): n is a, c, g, or t
  modified_base (414)..(414): a, c, t, g, unknown or other
  misc_feature (414)..(414): n is a, c, g, or t
  modified_base (432)..(432): a, c, t, g, unknown or other
  misc_feature (432)..(432): n is a, c, g, or t
  modified_base (447)..(447): a, c, t, g, unknown or other
  misc_feature (447)..(447): n is a, c, g, or t
tcagcgatcgtatacacgaccggtgctcgatttagtatctgatagttgggtttgggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactgggaccagcggtgacattggtntttaataactatgtctctggaccagcaccaccaggcaaacgccccaaatcatgatttatgatgtcagtgatcggccctcgaggggtttcaatcgtcttctctggctccaagtccggcaaaccacggcctccctgacccatctctggcctccaggccgaggacgaggcnattatactggcagctcanatacaatacaataanaataggtgttcggcggaggacgaaacgtacgacgttccgttcgttacgaacgccgaacgcgtcgcccctccggttcgtccc

SEQ ID NO: 309615 - DNA, 592 bp, Homo sapiens
  misc_feature: GZ8MTXP01CDYKI.51.38.D05.1.454.CMB.2.raw
  modified_base (246)..(246): a, c, t, g, unknown or other
  misc_feature (246)..(246): n is a, c, g, or t
  modified_base (309)..(309): a, c, t, g, unknown or other
  misc_feature (309)..(309): n is a, c, g, or t
tcagcgatcgtatacacgaccggtgctcgatttagtatctgatagttgggtttggggtggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactgggaccagcggtgactatttggtntttataactatgtctctggtaccagcaccaccaggaccaaacgcccccaaatcatgtatttangatgtcagtgactccggccctgtaggggtttcaagtcccgtctttctctcggcctacccgaacgtcccggacaaaccgaccggtcccctcccgtgaccctatcctcgtcggccctcgacgggccgagggacgaggctagattactactcgacagtctacataactacaaatactaaataacgtagttgggtcgttcgggaacgggtaacggaacctaaacgttcgaccgtcgttacggttcacgaacccgaggtcctcccgccccgttcgtccttccgttccg

SEQ ID NO: 309616 - DNA, 658 bp, Homo sapiens
  misc_feature: GZ8MTXP01EF4EZ.51.38.D05.1.454.CMB.2.raw
  modified_base (242)..(242): a, c, t, g, unknown or other
  misc_feature (242)..(242): n is a, c, g, or t
tcagcgatcgtatacacgaccggtgctcgatttagtatctgatagttgggtttgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactgggaccagcggtgacattggtntttaataactatgtctctggtaccagcaccaccagacaaacgcccccaaatcatgtatttatgatgtcagtgatcggcctgtagggtttcgaatcgtccttctcgtggcctcccgaaaacgtcccggcaaaccgacccgggccctcccctagaccctattcctcgtcgccctccggacggccggaggaccgaggtctagtactttaagttacgtcgacaggtcttactaaattaactaaactaaacgttaaactaaaacgttaaaacgttagggtttagggggttacggttaccggggaacggggtaaacgggaacccttaaacggtccgttaacccgtaccgtaacggttaccgaccggacccgtaacggcccgtcccgtcccccgtcggttaccctaaccgttccgtttccccg

SEQ ID NO: 309617 - DNA, 621 bp, Homo sapiens
  misc_feature: GZ8MTXP01EN6HE.51.38.D05.1.454.CMB.2.raw
  modified_base (247)..(247): a, c, t, g, unknown or other
  misc_feature (247)..(247): n is a, c, g, or t
  modified_base (253)..(253): a, c, t, g, unknown or other
  misc_feature (253)..(253): n is a, c, g, or t
tcagcgatcgtatacacgaccggtgctcgatttagtatctgatagttgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatcctcctgcactggggaccagcggtgactatttggtntttaanaacttatgtctctggtacagcaccaccaggacaaacgcccccaaatcatgatttatgatgtacagtgactccggcctcgtacggggttcaatcgtccttctcgtggctaccaaacgtccgcaaccgaccggcctcccgtagacctactctcgtcgccctacgacggaccggaggaccgaggtctagtattacgtactgcaggctacataactaacaatactaaataaacgtaagttggtacggttcggacgggaaacgggtaaccaaacgtcggttaaccgtaccgtaacgggttaccaacggaccccgtaagggtcccttcccggcccccgttcgggttaccctaaccgtttcccgtttaacccccg

SEQ ID NO: 309618 - DNA, 611 bp, Homo sapiens
  misc_feature: GZ8MTXP01ARSWE.51.38.D05.1.454.CMB.2.raw
  modified_base (473)..(473): a, c, t, g, unknown or other
  misc_feature (473)..(473): n is a, c, g, or t
tcagcgatcgtatacacgaccggtgctcgatttagtatctgatagttgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcacgtgggaccaggcggtgactagtttgggttatttaataacttatgtctcctggtaccagcaccacccgaggaccaaacgcccccaaatcatgtatttatgatgtcagtgatccggcctgtaggggtttacaatcgccttctcgtcggcctaccgaaaacggtcccgaactaaacgacccgggtccctccccgtgaccctatctcgtcgccctcgagggccgagggaccgaggctagattatactgcaggtctanaatactaacaactacgaaataacgtagttggggtcgtccgggagggaacggaaccttaaacgtcgttacccggtacgtaggttccgacggcccgtaaggccctaacccgcccctacggcctaaccttccgttccccgg

SEQ ID NO: 309619 - DNA, 558 bp, Homo sapiens
  misc_feature: GZ8MTXP01AINO4.51.38.D05.1.454.CMB.2.raw
  modified_base (246)..(246): a, c, t, g, unknown or other
  misc_feature (246)..(246): n is a, c, g, or t
  modified_base (252)..(252): a, c, t, g, unknown or other
  misc_feature (252)..(252): n is a, c, g, or t
  modified_base (453)..(453): a, c, t, g, unknown or other
  misc_feature (453)..(453): n is a, c, g, or t
  modified_base (486)..(486): a, c, t, g, unknown or other
  misc_feature (486)..(486): n is a, c, g, or t
tcagcgatcgtatacacgaccggtgctcgatttagtatctgatagttgggtttgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcacgtgggaccaggcggtgactagttggtntttaanaactatgtctcctggtacagcaccaccaggcaaacgcccccaaactcatgatttatgatgtcagtgactcggcctcgtagggggtttcaacttcgtccttctcgtggcctccgaaaagtcccggcaaaccgaccgggccctcccctgaccatctctggccctccgaggccgaggacgaggctgattagtactgcaggctanatatacaatacaataactaagttggtgttcggnggaacgggacaagtcgaccgtcgtaggcgcgcccgaacggctccgcccctacggcctaacgttcgttccccg

SEQ ID NO: 309620 - DNA, 554 bp, Homo sapiens
  misc_feature: GZ8MTXP01A49EX.51.38.D05.1.454.CMB.2.raw
  modified_base (243)..(243): a, c, t, g, unknown or other
  misc_feature (243)..(243): n is a, c, g, or t
  modified_base (248)..(248): a, c, t, g, unknown or other
  misc_feature (248)..(248): n is a, c, g, or t
  modified_base (430)..(430): a, c, t, g, unknown or other
  misc_feature (430)..(430): n is a, c, g, or t
  modified_base (438)..(438): a, c, t, g, unknown or other
  misc_feature (438)..(438): n is a, c, g, or t
tcagcgatcgtatacacgaccggtgctcgatttagtatctgatagttgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactgggaccagcggtgacattggtntttanaactatgtctctggtaccagcaccacccaggacaaacgcccccaaatcatgatttatgatgtcagtgatcggcctgtaggggtttcaatcgtcttctctggctccaaagtcccggcaacgaccggcctccctgaccatcctctggccctcgagggcccgaggaccgaggctagattattacngcagctanaataactaacaatacaaattaacgtaggttgggtagtacgggcggaacggaacaaacgtcgaccgtcgtagcgcgacccgaaggcctccgccccgtcgttacctccgttccgtccg

SEQ ID NO: 309621 - DNA, 548 bp, Homo sapiens
  misc_feature: GZ8MTXP01AIKLP.51.38.D05.1.454.CMB.2.raw
  modified_base (241)..(241): a, c, t, g, unknown or other
  misc_feature (241)..(241): n is a, c, g, or t
  modified_base (246)..(246): a, c, t, g, unknown or other
  misc_feature (246)..(246): n is a, c, g, or t
  modified_base (302)..(302): a, c, t, g, unknown or other
  misc_feature (302)..(302): n is a, c, g, or t
tcagcgatcgtatacacgaccggtgctcgatttagtatctgatagttgggtttggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactgggaccagcggtgacattggtntttanaactatgtctcctggtaccagcaccacccaggcaaagcccccaaatcatgatttangatgtcagtgatcggccctgaggggtttcaatcgcttctctggctcaaagtccggcaacacggcctccctgaccatctctggccctcgaggcccgaggaccgaggctgattatactgcaggctacatacacaatcaaataacaagttgggtgttcgggcggtaacgggaaccaaacgtcgacccgtccgtacgggttcacggcccaagggcctaacgcccccgtggttcctaacgttcgttccccg

SEQ ID NO: 309622 - DNA, 573 bp, Homo sapiens
  misc_feature: GZ8MTXP01ASPJJ.51.38.D05.1.454.CMB.2.raw
  modified_base (248)..(248): a, c, t, g, unknown or other
  misc_feature (248)..(248): n is a, c, g, or t
  modified_base (306)..(306): a, c, t, g, unknown or other
  misc_feature (306)..(306): n is a, c, g, or t
  modified_base (446)..(446): a, c, t, g, unknown or other
  misc_feature (446)..(446): n is a, c, g, or t
tcagcgatcgtatacacgaccggtgctcgatttagtatctgatagttgggtttgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggggaccagcggtgacattggtgtttanaactatgtctcctggtaccagcaccacccaggcaaacgcccccaaactcatgatttangatgtcagtgatcggcctgagggggtttcaatcgccttctctggcctccgaaagtcccgggcaaaccgacccgggtccctccctgaccctatcctctcggcctccgaggccgaggacgaggctgattatactgcaggctnatatacaatacaaataactaagttggggtagttacgggcggaacgggaaccaaacgtcgaacccgtcgtaacggttcacggacccgaagggcctcggcccccgtggttcctaaccgttccgttcccg

SEQ ID NO: 309623 - DNA, 730 bp, Homo sapiens
  misc_feature: GZ8MTXP01EAYTU.51.38.D05.1.454.CMB.2.raw
  modified_base (237)..(237): a, c, t, g, unknown or other
  misc_feature (237)..(237): n is a, c, g, or t
  modified_base (240)..(240): a, c, t, g, unknown or other
  misc_feature (240)..(240): n is a, c, g, or t
  modified_base (256)..(256): a, c, t, g, unknown or other
  misc_feature (256)..(256): n is a, c, g, or t
  modified_base (259)..(259): a, c, t, g, unknown or other
  misc_feature (259)..(259): n is a, c, g, or t
  modified_base (263)..(263): a, c, t, g, unknown or other
  misc_feature (263)..(263): n is a, c, g, or t
  modified_base (267)..(267): a, c, t, g, unknown or other
  misc_feature (267)..(267): n is a, c, g, or t
  modified_base (271)..(271): a, c, t, g, unknown or other
  misc_feature (271)..(271): n is a, c, g, or t
  modified_base (330)..(330): a, c, t, g, unknown or other
  misc_feature (330)..(330): n is a, c, g, or t
  modified_base (401)..(401): a, c, t, g, unknown or other
  misc_feature (401)..(401): n is a, c, g, or t
tcagcgatcgtatacacgaccggtgctcgatttagtatctgatagttgggtttgggggaggcgtggtccagcctgggaggtccctgagactcgcctgtaaaccgtccggattcaccttcagtaactatgcaatgcactgggtccgccaggctccaggcaaggggctggactggggtggcaggcatatcatttgatggaagcaagaagtactatgcagactcgtgaaggccatcaccntcncagagatccgatcgancanctanctanacancagtcgagctgtagacgtagaccgtgaaccggactacggtttttctttacgtttttagnggcctacggaaccgaggaacgtcggacgttggggcctacggactaactaattcgattttcgtacgttttanacttacgggttagaccggaaaggacccgtaaaggtacgtacgtacgtacgttacctttgtccgttccgtcccgtacccgtacccgtaccggacccggtaccgtcccgttaccgttccccgttccccgtccccgtcccgtaccctacccgtaccgtaccgtaccgtacccgtacccggtaaccgggtaccgggttaccgggaccggacccgggtacccggtcccgggttcccgggttccgggttacccggttaaccgggttacccggttaaccgggttaacccggttaacccggtttacccgtttaacccggtttaacccggttaacccg

SEQ ID NO: 309624 - DNA, 555 bp, Homo sapiens
  misc_feature: GZ8MTXP01APTGH.51.38.D05.1.454.CMB.2.raw
  modified_base (246)..(246): a, c, t, g, unknown or other
  misc_feature (246)..(246): n is a, c, g, or t
  modified_base (305)..(305): a, c, t, g, unknown or other
  misc_feature (305)..(305): n is a, c, g, or t
  modified_base (389)..(389): a, c, t, g, unknown or other
  misc_feature (389)..(389): n is a, c, g, or t
  modified_base (429)..(429): a, c, t, g, unknown or other
  misc_feature (429)..(429): n is a, c, g, or t
tcagcgatcgtatacacgaccggtgctcgatttagtatctgatagttgggtttgggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactgggaccagcggtgacattggtntttataactatgtctctggtaccagcaccaccaggcaaacgccccaaatcatgatttangatgtcagtgactcggcctgaggggtttcaactcgcttctctggactccaagtcccggacaacgacggcctccctgacccatcnctcggcctccgaggccgaggacgaggctagtattattacngggcagctcaatatacaattacaaataacgaagttggggtggttcggcgggaagggaccaaacgtcgtaacccgttcgacggttccaacggcccaaggcctaccgcccccgtcggttcctaacccg

SEQ ID NO: 309625 - DNA, 541 bp, Homo sapiens
  misc_feature: GZ8MTXP01DI251.51.38.D05.1.454.CMB.2.raw
  modified_base (245)..(245): a, c, t, g, unknown or other
  misc_feature (245)..(245): n is a, c, g, or t
  modified_base (251)..(251): a, c, t, g, unknown or other
  misc_feature (251)..(251): n is a, c, g, or t
  modified_base (307)..(307): a, c, t, g, unknown or other
  misc_feature (307)..(307): n is a, c, g, or t
  modified_base (343)..(343): a, c, t, g, unknown or other
  misc_feature (343)..(343): n is a, c, g, or t
  modified_base (361)..(361): a, c, t, g, unknown or other
  misc_feature (361)..(361): n is a, c, g, or t
  modified_base (375)..(375): a, c, t, g, unknown or other
  misc_feature (375)..(375): n is a, c, g, or t
  modified_base (378)..(378): a, c, t, g, unknown or other
  misc_feature (378)..(378): n is a, c, g, or t
  modified_base (499)..(499): a, c, t, g, unknown or other
  misc_feature (499)..(499): n is a, c, g, or t
tcagcgatcgtatacacgaccggtgctcgatttagtatctgatagttgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggggaccaggcggtgacattggtntttaanaactatgtctctggtaccagcaccacccaggcaaacgcccccaaatcatgatttangatgtcagtgatcggcctgagggttcatcgtcttcntgctcaaagtccgcaacncggcctcctgaccntcnctcgcctcgagccgaggacgagctgattatactgcaggcttacaatactaacaatacgaaataactaagttgggggtctcgggacggaacgggaaccaaacgtcgacccgtctagggttcncgttacccgaaggcctcgccccctggttccaacgttctcccg

SEQ ID NO: 309626 - DNA, 558 bp, Homo sapiens
  misc_feature: GZ8MTXP01CRP0T.51.38.D05.1.454.CMB.2.raw
  modified_base (268)..(268): a, c, t, g, unknown or other
  misc_feature (268)..(268): n is a, c, g, or t
  modified_base (400)..(400): a, c, t, g, unknown or other
  misc_feature (400)..(400): n is a, c, g, or t
  modified_base (404)..(404): a, c, t, g, unknown or other
  misc_feature (404)..(404): n is a, c, g, or t
  modified_base (506)..(506): a, c, t, g, unknown or other
  misc_feature (506)..(506): n is a, c, g, or t
  modified_base (529)..(529): a, c, t, g, unknown or other
  misc_feature (529)..(529): n is a, c, g, or t
tcagcgatcgtatacacgaccggtgctcgatttagtatctgatagttgggtttgggggctttgcctgggctctgctattcctcaccctcctcactcagggcacagggtcctgggcccagtctgccctgactcagcctgcctccgtgtctgggtctcctggacagtcgatcaccatctcctgcactgggaccagcggtgacattggtgtttataactatgtctcctggtaccagcaccaccaggcaaacgcccccaaatcatgatttangatgtcagtgatcggccctgaggggtttcaatcgcttctctggctccgaagtccggacaacgacggcctccctgaccccatctctcggccctaccgagggccgagggacgaggctgatttatactgcagctnatanacaatacaaataacgagttgggtagttcgggacggggaacggaacctaaacgtcgaccgtcgacggtcaaccgcctaaggcctccgccccgtggtcacttcncgttccccaccttcgcttccgtnacctctcgtcggacggtcgggctaacggg

SEQ ID NO: 309627 - DNA, 603 bp, Homo sapiens
  misc_feature: GZ8MTXP01BFSDW.51.38.D05.1.454.CMB.2.raw
  modified_base (321)..(321): a, c, t, g, unknown or other
  misc_feature (321)..(321): n is a, c, g, or t
  modified_base (363)..(363): a, c, t, g, unknown or other
  misc_feature (363)..(363): n is a, c, g, or t
tcagcgatcgtatacacgaccggtgctcgatttagtatctgatagttgggtttgggggaggcgtggtccagcctgggaggtccctgagactcgcctgtaaaccgtccggattcaccttcagtaactatgcaatgcactgggtccgccaggctccaggcaaggggctggactgggtggcaggcatatcatttgatggaagcaagaagtactatgcagactccgtagaaggccattcacatctccagagacagttccgatgacacagtcatctacacatgagcagtgtagagtacctgacgactacggtctttcttttttacngtcgcgccgaggaacgcgagtcggcgtcggcccacaacttcnttgtctttttagattagtcgtgggacgaccgaagggacaagtggtacagtcgtcttcgtccgccctccgaccgaacgggcccctacggttcccggttcccttcccccgtcggccctaccccgtcctaccgaacgccgtacctaccgtcggtcggggccacgacggcccggcccgttggggccttcggttccgttcggaaccgtaacggtccttaccgttcccgttacgtcgttctaaccg

SEQ ID NO: 309628 - DNA, 580 bp, Homo sapiens
  misc_feature: GZ8MTXP01DWR8A.51.38.D05.1.454.CMB.2.raw
  modified_base (413)..(413): a, c, t, g, unknown or other
  misc_feature (413)..(413): n is a, c, g, or t
tcagcgatcgtatacacgaccggtgctcgatttagtatctgatagttgggtttgggggctttgcctgggctctgctattcctcaccctcctcactcagggcacagggtcctgggcccagtctgccctgactcagcctgcctccgtgtctgggtctcctggacagtcgatcaccatctcctgcacgtgggaccaggcggtgacattggtgtttataactatgtctcctggtaccagcaccaccaggacaaacgcccccaaatcatgtatttatgatgtcagtgacgtcggccctgtaggggtttcgaatcgtcttctctggctccaagtcccggacacaccggcctccctcgaccccatctcgtcgccctaccgacgggccggaggacgaggtctagtattattactgcagctnatataacaatacaaataacaagttgggtgttaccgggacgggggtaacggaacctaaacgtcggacccgtcgtacggtcaacgccctaaggcctccgcccctgtccactccgttcgttccccgccttccgttcgttctcgcctaacttcaggcggcggttcgaacgg

SEQ ID NO: 309629 - DNA, 608 bp, Homo sapiens
  misc_feature: GZ8MTXP01DL1V2.51.38.D05.1.454.CMB.2.raw
  modified_base (246)..(246): a, c, t, g, unknown or other
  misc_feature (246)..(246): n is a, c, g, or t
  modified_base (251)..(251): a, c, t, g, unknown or other
  misc_feature (251)..(251): n is a, c, g, or t
  modified_base (397)..(397): a, c, t, g, unknown or other
  misc_feature (397)..(397): n is a, c, g, or t
tcagcgatcgtatacacgaccggtgctcgatttagtatctgatagttgggtttgggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctctgcactgggaccagcggtgactattggtntttanaactatgtctcctggaccagcaccaccaggcaaacgccccaaatcatgattatgatgtcagtgactccggcctagtaggggtttcaactcgtcttctcgtggaccttccgaacggtcccggaccaaacgtcccggccctcccgtanaccctattctcctcggcccctaccgagggacccggagggacgtagggccttagtaattacttacgcgggacaatccttacaattaaactactaaataccgtaaaataaacgtaagtttcgggaggttaacggacgggaagggtaacaaacgtcgtacccttacgttcggacaacgtacccgaagtccctcgcccccgtggttcctaacccg

SEQ ID NO: 309630 - DNA, 568 bp, Homo sapiens
  misc_feature: GZ8MTXP01AJ645.51.38.D05.1.454.CMB.2.raw
  modified_base (314)..(314): a, c, t, g, unknown or other
  misc_feature (314)..(314): n is a, c, g, or t
  modified_base (439)..(439): a, c, t, g, unknown or other
  misc_feature (439)..(439): n is a, c, g, or t
tcagcgatcgtatacacgaccggtgctcgatttagtatctgatagttgggtttgggggctggggtctcaggaggcagcgctctcgggacgtctccaccatggcctgggctctgctattcctcaccctcctcactcagggcacagggtcctgggcccagtctgccctgactcagcctgcctccatgtctgggtctcctggacagtcgatcaccatctcctgcacgtggggaccaggcggtgactatttggtgtttataactatgtctcctggtaccagccaccacccaggcaaacgcccccaaatcatgatttangatgtcagtgatcggcctcgaggggtttccaatcgcttctctggcctcaagtccgacaacacggcctcctgacccatcctctcggccctccgacggccgagggacgaggctagtattacttacgnggacagtcctacaatactaacaatactaaagtaacctaagttcggggtgttcgggacgggtacgggaacctaaacgtcgacccgttcgacggtcacgaacccgaggccttccggtcccccgttggtccc

SEQ ID NO: 309631 - DNA, 609 bp, Homo sapiens
  misc_feature: GZ8MTXP01CME3U.51.38.D05.1.454.CMB.2.raw
  modified_base (311)..(311): a, c, t, g, unknown or other
  misc_feature (311)..(311): n is a, c, g, or t
tcagcgatcgtatacacgaccggtgctcgatttagtatctgatagttgggtttgggggctggggtctcaggaggcagcgctctcgggacgtctccaccatggcctgggctctgctattcctcaccctcctcactcagggcacagggtcctgggcccagtctgccctgactcagcctgcctccgtgtctggtctcctggacagtcgatcacatctcctgcacgtgggaccagcggtgacatttggtatttataactatgtctctggacagcaccaccagacaaacgccccaatcatgattatgatgtcagtnacgtcgcctcgtaggggtttcgaactcgtcttctctcggactccgaacgtcccggacaaaccgacccggccctccctacgacctactcctcgtcggtccctccgaacgggccggaacggacggaggtctagtaatttattacgtaggctagccttacaattaataactaaatacgaaattaactaaggtttggggtagttaacgggacggaacgggtaaaccaaacgtaccgtacccgttacgttaggttacccaacggtacccgaacgccgtacgttcccccgtcggaaccttcccg

SEQ ID NO: 309632 - DNA, 599 bp, Homo sapiens
  misc_feature: GZ8MTXP01BVCBV.51.38.D05.1.454.CMB.2.raw
  modified_base (243)..(243): a, c, t, g, unknown or other
  misc_feature (243)..(243): n is a, c, g, or t
  modified_base (383)..(383): a, c, t, g, unknown or other
  misc_feature (383)..(383): n is a, c, g, or t
  modified_base (438)..(438): a, c, t, g, unknown or other
  misc_feature (438)..(438): n is a, c, g, or t
  modified_base (447)..(447): a, c, t, g, unknown or other
  misc_feature (447)..(447): n is a, c, g, or t
tcagcgatcgtatacacgaccggtgctcgatttagtatctgatagttgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactgggaccagcgtgactattggtntttataactatgtctctggtaccagcaccacccaggacaaacgcccccaaactcatgattttatgatgtcagtgactcggccctgtagggggtttcaatcgtccttctctggcctcaaacgtccgcacaccggccctccngaccatctctcggcctccgacggccggaggaccggaggtcctagtattacttacngcaggtctnaatactaactaatacctaaataaactaagttggggtacggttacgggcggggaacggaaccaaacgtacggttacccgtcgtacggttcgaccgttacccgaacgggcccttccggcccccgttgggttccctaaccgttccgttaaccccg

SEQ ID NO: 309633 - DNA, 563 bp, Homo sapiens
  misc_feature: GZ8MTXP01EEAWP.51.38.D05.1.454.CMB.2.raw
  modified_base (306)..(306): a, c, t, g, unknown or other
  misc_feature (306)..(306): n is a, c, g, or t
  modified_base (393)..(393): a, c, t, g, unknown or other
  misc_feature (393)..(393): n is a, c, g, or t
  modified_base (403)..(403): a, c, t, g, unknown or other
  misc_feature (403)..(403): n is a, c, g, or t
  modified_base (407)..(407): a, c, t, g, unknown or other
  misc_feature (407)..(407): n is a, c, g, or t
  modified_base (430)..(430): a, c, t, g, unknown or other
  misc_feature (430)..(430): n is a, c, g, or t
tcagcgatcgtatacacgaccggtgctcgatttagtatctgatagttgggtttgggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctctgcactgggaccagcggtgactatttggtcttttaataacgtatgtctccttggaccagcaccacccaggccaaaacgcccccaaactnactagtactttaatgatgtcagtgactcgcctcgaggggtttccgaatcggcttcgtctggcctccaagtccgcaaacctacccggncctacctcgnaccnctctctcgcgcgcgcgacgacgngcgtgtatacttactcgtcagtaactacttactaacttaactaaactaacgttaacgttaaacgttaacgttaagggttacggttaacgggtacgggtaacgggttaaccggtaaaccgttaacggtaaccgg

SEQ ID NO: 309634 - DNA, 588 bp, Homo sapiens
  misc_feature: GZ8MTXP01B1PIJ.51.38.D05.1.454.CMB.2.raw
  modified_base (249)..(249): a, c, t, g, unknown or other
  misc_feature (249)..(249): n is a, c, g, or t
  modified_base (312)..(312): a, c, t, g, unknown or other
  misc_feature (312)..(312): n is a, c, g, or t
  modified_base (439)..(439): a, c, t, g, unknown or other
  misc_feature (439)..(439): n is a, c, g, or t
tcagcgatcgtatacacgaccggtgctcgatttagtatctgatagttgggtttggggtggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcacgtgggaccaggcggtgactagtttggtntttaataactatgtctcctggtaccagcaccaccaggcaaacgcccccaaactcatgatttangatgtcagtgatcggcctgaggggtttcaatcccgcttctcgtggctacccgaacgtcccggacaaaccgaccgggtcccctccctacgacccacttcctcgtcgggccctcgacggccgaggacgnggctgtattatctgcagtctcatacacaatacaaataactaagtttggggtcgttcgggaacggaacgggaacctaaacgttcggaacccgtcgttaggttccacgcccgaagggccctaccggccccgttcggtccttccgtttcccg

SEQ ID NO: 309635 - DNA, 676 bp, Homo sapiens
  misc_feature: GZ8MTXP01AELEB.51.38.D05.1.454.CMB.2.raw
  modified_base (414)..(414): a, c, t, g, unknown or other
  misc_feature (414)..(414): n is a, c, g, or t
  modified_base (477)..(477): a, c, t, g, unknown or other
  misc_feature (477)..(477): n is a, c, g, or t
tcagcgatcgtatacacgaccggtgctcgatttagtatctgatagttgggtttgggggctggggtctcaggaggcagcgctctcgggacgtctccaccatggcctgggctctgctattcctcaccctcctcactcagggcacagggtcctgggcccagtctgccctgactcagcctgcctccgtgtctgggtctctggacagtcgatcaccatctctgcacgtgggaccagcggtgactagttggtatttaataactatgtctcctggtaccagccaccaccaggaccaaacgacccccaaactcatgtatttatgatgtcagtgacgtccgcctgtaggggtttcaactcgtcttcgtcgtcgactaccgaacggtcccggacaaaccgacccgccctcccgtacgaaccctnttcctcgtcggccctccgacgggacccggaggaacggtcggtctagtaaacttacgtttaccnggggactacgtacctacctaataacgtaacaaacttaacctaaaattaaccgtaaggtttcggggtacggttcggggaacgggaacggggtaaacccttaaacggtaccggtaacccgttacccggttacggttacccgaacggccccgtaaacgggtcccgtaccccggttccccgttcgggttaacccttaaccccg

SEQ ID NO: 309636 - DNA, 628 bp, Homo sapiens
  misc_feature: GZ8MTXP01DU5QB.51.38.D05.1.454.CMB.2.raw
  modified_base (240)..(240): a, c, t, g, unknown or other
  misc_feature (240)..(240): n is a, c, g, or t
  modified_base (245)..(245): a, c, t, g, unknown or other
  misc_feature (245)..(245): n is a, c, g, or t
  modified_base (322)..(322): a, c, t, g, unknown or other
  misc_feature (322)..(322): n is a, c, g, or t
tcagcgatcgtatacacgaccggtgctcgatttagtatctgatagttgggtttgggggaggcgtggtccagcctgggaggtccctgagactcgcctgtaaaccgtccggattcaccttcagtaaactatgcaatgcactgggtccgccaggctccaggcaaggggctggactgggtggcaggcatatcatttgatggaagcaagaagtactatgcagactcgtgaaggcattcaccatcncaganacagttccgatgacacagtctatctacacaatgagcagtgtagacgacctgacgacgacggtctttcttttttacgngtcgccgacgaaggaacgcgtaggtcggcgtccggacccaacaactctaagttcgttcgttttagactttagtcgtagggaacgaccggtaaagggaactaagtggtactacgttcgttcttccgttccgcctacccgaacgaaccgggccctacgggtcccgttccctttccccgcggccctaccccgtccgtaacccaagccgcctacccggtcggcggggcacggacggcccggccgttcgggcttccgttccgttacggtaacgaacgtaacccttaccgtccgttcgttaacgccgtaacg

SEQ ID NO: 309637 - DNA, 614 bp, Homo sapiens
  misc_feature: GZ8MTXP01DOPWK.51.38.D05.1.454.CMB.2.raw
  modified_base (255)..(255): a, c, t, g, unknown or other
  misc_feature (255)..(255): n is a, c, g, or t
  modified_base (315)..(315): a, c, t, g, unknown or other
  misc_feature (315)..(315): n is a, c, g, or t
  modified_base (482)..(482): a, c, t, g, unknown or other
  misc_feature (482)..(482): n is a, c, g, or t
tcagcgatcgtatacacgaccggtgctcgatttagtatctgatagttggggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcacgtgggaccaggcggtgactagtttggtatttaanaactatgtctctggtaccagccaccaccaggaccaaacgcccccaaactcatgtatttangatgtcagtgacgtccggccttggtaggggtttacaagtccgtcctttcctcgtcggcctaccgaaaacggttcccggaacaaaccgacccggcccctcccgtacgaccctactcctcctcggccctcgacggccgaggacgaggctgtattatactgacaggctanaatataacaatactaaataaacgtaggttgggtacggttcgggacggaacgggaaccttaaagtcgacccgtacgtacggttccgacgacccgaaggccctccgcccctcggttcctaaccgttcttccccg

SEQ ID NO: 309638 - DNA, 533 bp, Homo sapiens
  misc_feature: GZ8MTXP01A8579.51.38.D05.1.454.CMB.2.raw
  modified_base (246)..(246): a, c, t, g, unknown or other
  misc_feature (246)..(246): n is a, c, g, or t
tcagcgatcgtatacacgaccggtgctcgatttagtatctgatagttgggtttgggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactgggaccagcggtgacattggtntttataactatgtctcctggtaccagcaccacccaggcaaacgcccccaaactcatgatttatgatgtcagtgatcggccctgaggggtttcaactcgcttctctggctccaagtcccggcaacgcggcctccctgacccatctctcggcctccaggccgaggacgaggctgattatactgggcagctcatatacaatcaaataaacaagttgggtgttcggcggaggggaccaaacgtcgaccgttcgttggttcaagcccaagcctcgcccctggttccgtaacc

SEQ ID NO: 309639 - DNA, 608 bp, Homo sapiens
  misc_feature: GZ8MTXP01B8S94.51.38.D05.1.454.CMB.2.raw
  modified_base (236)..(236): a, c, t, g, unknown or other
  misc_feature (236)..(236): n is a, c, g, or t
  modified_base (248)..(248): a, c, t, g, unknown or other
  misc_feature (248)..(248): n is a, c, g, or t
  modified_base (311)..(311): a, c, t, g, unknown or other
  misc_feature (311)..(311): n is a, c, g, or t
  modified_base (349)..(349): a, c, t, g, unknown or other
  misc_feature (349)..(349): n is a, c, g, or t
  modified_base (439)..(439): a, c, t, g, unknown or other
  misc_feature (439)..(439): n is a, c, g, or t
tcagcgatcgtatacacgaccggtgctcgatttagtatctgatagttggggtttggggggggtctcaggaggcagcgctctcgggacgtctccaccatggcctgggctctgctattcctcaccctcctcactcagggcacagggtcctgggcccagtctgccctgactcagcctgcctcgtgtctgggtctcctggacagtcgatcaccatctcctgcacgtgggaccaggcggtnactagtttggtntttaataactatgtctcctggtaccagcaccaccaggacaaacgcccccaaatcatgatttangatgtcagtgatcggcctgaggggttcaatcgcttctntggctccaaagtcccggctaaccgaccggccctcccgtgacccatcctcgtcggccctcgaggcccgaggaccgaggctagattattacngtccagtctcaataacgtaacaaataccgaaataacgtaagtttggggtacgttcgggcggggtaaacgaaaccgttaagtaccggacccgttacgtacggttacgaaccggaccccgtaaggtcccgtcccgtcccccgtcggttaccctaaccttcccgttcccccg

SEQ ID NO: 309640 - DNA, 652 bp, Homo sapiens
  misc_feature: GZ8MTXP01DLV3L.51.38.D05.1.454.CMB.2.raw
  modified_base (233)..(233): a, c, t, g, unknown or other
  misc_feature (233)..(233): n is a, c, g, or t
  modified_base (255)..(255): a, c, t, g, unknown or other
  misc_feature (255)..(255): n is a, c, g, or t
  modified_base (307)..(307): a, c, t, g, unknown or other
  misc_feature (307)..(307): n is a, c, g, or t
  modified_base (500)..(500): a, c, t, g, unknown or other
  misc_feature (500)..(500): n is a, c, g, or t
tcagcgatcgtatacacgaccggtgctcgatttagtatctgatagttgggtttgggggctggggtctcaggaggcagcgctctcgggacgtctccaccatggcctgggctctgctattcctcaccctcctcactcagggcacagggtcctgggcccagtctgccctgactcagcctgcctcgtgtctggtctcctggacagtcatcacatctctgcacgtggaccagcggtanactagttggtatttaataactntgtctctgaccagccaccaccgagacaaaccgaccccaaatcatgtatttanagatgtacagtgacgtccggtccccgttaggtacggggtttaccaacgttccgtactttcgtcgtcgggtaacccttaccgaacgggtcccgaacctaaacccgccccggtccccttacccgtagaaccctacttccgtccgtcgggccctcggacgggccggaagggacgacggtctagtacttacttacgngactagtctaatataaactaactaaacgtaactaaagttaacgttagggttcgggtcggtaacgggaacggaacggtaaaccttaacgtcgtacccgttcgcgttaccgaaccgacccgaacggtccctcccgttccccgttcgttccctcg

SEQ ID NO: 309641 - DNA, 642 bp, Homo sapiens
  misc_feature: GZ8MTXP01A93NV.51.38.D05.1.454.CMB.2.raw
  modified_base (314)..(314): a, c, t, g, unknown or other
  misc_feature (314)..(314): n is a, c, g, or t
tcagcgatcgtatacacgaccggtgctcgatttagtatctgatagttgggtttgggggaggcgtggtacagcctgggaggtccctgagactcgcctgtaaaccgtccggattcaccttcagtaactatgcaatgcactgggtccgccaggctccaggcaaggggctggactgggtggcaggcatatcatttgatggaagcaagaagtactatgcagactcgtgaaggccattcaccatctcagagacagttccgatgacacagtcatctacacatgagcagtgtgagacctgacgacacggtcttctttttacngtcgcgccaggaagcagtggctggccacaatctaatgtcttttagattatcgtgggacgacccgaaaggggacctaaagtcgggttacaagttcggtcctttccgttcccgggtccccttacccgaacccgtaacggggccccctacggttcccggggttccctttccccccgtcggccctaacccccgtcctaacccaacgacgcccgtaaccgttccggtccggggggaacaccgacgggtcccgggccccggtgggggtccttcggacccgttcgggttaaccgaacgggtaaccctttaccgtccgttaccgtaagcctaaccg

SEQ ID NO: 309642 - DNA, 595 bp, Homo sapiens
  misc_feature: GZ8MTXP01BKUVZ.51.38.D05.1.454.CMB.2.raw
  modified_base (236)..(236): a, c, t, g, unknown or other
  misc_feature (236)..(236): n is a, c, g, or t
  modified_base (246)..(246): a, c, t, g, unknown or other
  misc_feature (246)..(246): n is a, c, g, or t
  modified_base (347)..(347): a, c, t, g, unknown or other
  misc_feature (347)..(347): n is a, c, g, or t
tcagcgatcgtatacacgaccggtgctcgatttagtatctgatagttgggtttgggggatggggtctcaggaggcagcgctctcgggacgtctccaccatggcctgggctctgctattcctcaccctcctcactcagggcacagggtcctgggcccagtctgccctgactcagcctgcctcgtgtctgggtctcctggacagtcgatcaccatctcctgcactgggaccagcggtnactattggtntttataactatgtctctggtaccagcaccaccaggcaaacgcccccaaatcatgatttatgatgtcagtgactcggcctgaggggtttcaactcgtcttcnctcggcctccgaagtcccggacaaccgaccggccctcccgtgacccacttcgtccgtcggccctaccgacggaccccggaggaccggaagggcctaggtaatttattacgtggacgtaagtcctacaatactaaccgaataacaaacttaacgtaagtttggggtcgttaacgggacggacggggaaccttaaacgtcgacccggttcgttcggcaacgcccgaagcctcgcccctcgttcctaaccg

SEQ ID NO: 309643 - DNA, 599 bp, Homo sapiens
  misc_feature: GZ8MTXP01CTSS9.51.38.D05.1.454.CMB.2.raw
  modified_base (236)..(236): a, c, t, g, unknown or other
  misc_feature (236)..(236): n is a, c, g, or t
  modified_base (247)..(247): a, c, t, g, unknown or other
  misc_feature (247)..(247): n is a, c, g, or t
  modified_base (296)..(296): a, c, t, g, unknown or other
  misc_feature (296)..(296): n is a, c, g, or t
  modified_base (307)..(307): a, c, t, g, unknown or other
  misc_feature (307)..(307): n is a, c, g, or t
  modified_base (400)..(400): a, c, t, g, unknown or other
  misc_feature (400)..(400): n is a, c, g, or t
tcagcgatcgtatacacgaccggtgctcgatttagtatctgatagttgggtttgggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcacatctctgcacgtgggaccagcggtnactattgggtntttaataactatgtctcctgacagcaccaccaggacaaacgccccaaancatagatttangatgtcagtgagtccgcctagaggggtttcaactcgtctctctggaacctcgaacgtccgacaaaccgaccggccctccgtacgacctatccncgtcgcctccgacgggacgaggacgaggtctagtattaatacgtgggactacgtcctaataataacgaaacctaataaacctaaataaacgtaagttggggtaggttaacgggaacgggaacgggtaaccaaacgtcggtaccgttacgttagaccgaacgacccgtaaggtccgtaccgccccgttcggcttaacccg

SEQ ID NO: 309644 - DNA, 694 bp, Homo sapiens
  misc_feature: GZ8MTXP01ETX0F.51.38.D05.1.454.CMB.2.raw
  modified_base (247)..(247): a, c, t, g, unknown or other
  misc_feature (247)..(247): n is a, c, g, or t
  modified_base (306)..(306): a, c, t, g, unknown or other
  misc_feature (306)..(306): n is a, c, g, or t
  modified_base (312)..(312): a, c, t, g, unknown or other
  misc_feature (312)..(312): n is a, c, g, or t
tcagcgatcgtatacacgaccggtgctcgatttagtatctgatagttgggtttgggggctggggtctcaggaggcagcgctctcgggacgtctccaccatggcctgggctctgctattcctcaccctcctcactcagggcacagggtcctgggcccagtctgccctgactcagcctgcctcgtgtctgggtctcctggacagtcgatcaccatctcctgcacgtgggaccagcggtgactattggtntttataactatgtctctggaccagcaccaccagacaaacgcccccaaatcatgatttangatgtnagtgactcggccctgtacggggttcgaactcgtcttctctggcctaccgaacggtcccgactaaaccgacccggtccctcccctcgaccctatccctccgtcgggacccctccggacgggacccggagggaaccgaggggtccttaggtaactttaacgtttaccgtcggggactaacgtaccttacctaattaaacctaaactaaacttaaccgtaaaattaaaaccgttaaaggtttcggggttacggggtttaaccggggaacggggaaacgggtaaaccccttaaaacgtccggtaacccggttaccgttacggttacccgaaccggacccgtaaacggtcccgtacccggcccccgttaaccggttccttaaccccg

SEQ ID NO: 309645 - DNA, 663 bp, Homo sapiens
  misc_feature: GZ8MTXP01CFBCT.51.38.D05.1.454.CMB.2.raw
  modified_base (444)..(444): a, c, t, g, unknown or other
  misc_feature (444)..(444): n is a, c, g, or t
tcagcgatcgtatacacgaccggtgctcgatttagtatctgatagttgggtttgggggctggggtctcaggaggcagcgctctcgggacgtctccaccatggcctgggctctgctattcctcaccctcctcactcagggcacagggtcctgggcccagtctgccctgactcagcctgcctcgtgtctggtctcctggacagtcgatcaccatctctgcacgtgggaccagcggtgactagtttggtatttaataactatgtctcctggaccagcaccaccaggccaaacgcccccaaatcatgatttatgatgtcagtgagtcgcctagtagggggtttacaactccgtcttctcgtcggtcttaccgaacgtcccgggaccaaacgaccggtcccctccctagaccctatcctcgtcgccctaccgacgggaccgagggacgngggaccttgaatttactacgtcgggactagtcctacaattactaaacgtaaacttacgaaaaccttaaagtaacggtttgggggttacgttaacgggggaaccgggaacgggtaaacccaaacggttaccgggtaacccgttaccgttacgggttaccctaacgggacccccgtaaagggtccccgtaccggttaccccccgtcgggttaacctccccg

SEQ ID NO: 309646 - DNA, 565 bp, Homo sapiens
  misc_feature: GZ8MTXP01ERYEP.51.38.D05.1.454.CMB.2.raw
  modified_base (247)..(247): a, c, t, g, unknown or other
  misc_feature (247)..(247): n is a, c, g, or t
  modified_base (308)..(308): a, c, t, g, unknown or other
  misc_feature (308)..(308): n is a, c, g, or t
  modified_base (386)..(386): a, c, t, g, unknown or other
  misc_feature (386)..(386): n is a, c, g, or t
  modified_base (393)..(393): a, c, t, g, unknown or other
  misc_feature (393)..(393): n is a, c, g, or t
  modified_base (444)..(444): a, c, t, g, unknown or other
  misc_feature (444)..(444): n is a, c, g, or t
  modified_base (450)..(450): a, c, t, g, unknown or other
  misc_feature (450)..(450): n is a, c, g, or t
tcagcgatcgtatacacgaccggtgctcgatttagtatctgatagttgggtttgggggctggggtctcaggaggcagcgctctcgggacgtctccaccatggcctgggctctgctattcctcaccctcctcactcagggcacagggtcctgggcccagtctgccctgactcagcctgcctcgtgtctgggtctcctggacagtcgatcaccatctcctgcactgggaccagcggtgactagttggtntttaataactatgtctctggtaccagcaccaccaggcaaacgccccaaactcatgatttangatgtcagtgacgtcgcctgtaggggttcaactcgcttctctggaccttccgaacgtccggacaacgacggccctccncgaaccntctctcgcctcaggccgaggacgaggctagattatactggactgaccttanaataanaactaacgtaactaaataagtaggttgggtcggtaacgggacggaacggtaaccaaacgtcgtaacgttacgttacgttaccgaacgaccgaacgcctccgcccgtcgttctccg

SEQ ID NO: 309647 - DNA, 572 bp, Homo sapiens
  misc_feature: GZ8MTXP01EB5U0.51.38.D05.1.454.CMB.2.raw
  modified_base (234)..(234): a, c, t, g, unknown or other
  misc_feature (234)..(234): n is a, c, g, or t
  modified_base (244)..(244): a, c, t, g, unknown or other
  misc_feature (244)..(244): n is a, c, g, or t
  modified_base (249)..(249): a, c, t, g, unknown or other
  misc_feature (249)..(249): n is a, c, g, or t
  modified_base (379)..(379): a, c, t, g, unknown or other
  misc_feature (379)..(379): n is a, c, g, or t
tcagcgatcgtatacacgaccggtgctcgatttagtatctgatagttgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactgggaccagcggtnactattggtntttanaactatgtctcctggtaccagcaccaccaggacaaacgcccccaaatcatgtatttatgatgtcagtgacgtccggcctgtagggggtttcaattccgcctttctctggcctccaaacgtcccgcaaacnccggccctccctgacctatcctctcgcctccgaggccgaggacgaggctgtaattatacgtcgacaggctacattaataacaactacgtaaataaacgtaagttgggtgttacgggcgggaacgtaacaaacgtcgaccgtcgtaacggcgacgaccgaagccgtccgccccgtggttacctcgttcttcccg

SEQ ID NO: 309648 - DNA, 760 bp, Homo sapiens
  misc_feature: GZ8MTXP01EQII8.51.38.D05.1.454.CMB.2.raw
  modified_base (247)..(247): a, c, t, g, unknown or other
  misc_feature (247)..(247): n is a, c, g, or t
  modified_base (319)..(319): a, c, t, g, unknown or other
  misc_feature (319)..(319): n is a, c, g, or t
tcagcgatcgtatacacgaccggtgctcgatttagtatctgatagttgggtttgggggctggggtctcaggaggcagcgctctcgggacgtctccaccatggcctgggctctgctattcctcaccctcctcactcagggcacagggtcctgggcccagtctgccctgactcagcctgcctccgtgtctggtctcctggacagtcgatcaccatctcctgcacgtgggaccagcggtgactattggtntttaataactatgtctcctggtaccagcaccaccaggaccaaacgacccccaaatcatgtatttatgatgtnagtgacgtcgccctgtagggtttcaactcgtacttctcgtcggtacctaccgaacggtcccggaccaaaccgaccccgggtccccttccccgtacggaaacccctacgttcccttccggtaccgggtcccccgttacccggaacgggggaccccgggaaggggtaacccgacgggggtacccttaggtaaacttttaacgtttaacccgttcggggtaccaacggttcctaaccctaaattaaacgtaaacctaaaacgttaaacctaaaattaaaccgtaaaggtttcgggggttacggttaaccgggggaaccggttaaacgggggtaaacccttaaacggttaccggtaaccccggttaccgttacgggttacccgaaccggtccccgaaacggtccccgtacccggttacccccggtccgggttaacccgtcccccg

SEQ ID NO: 309649 - DNA, 560 bp, Homo sapiens
  misc_feature: GZ8MTXP01A7IL6.51.38.D05.1.454.CMB.2.raw
  modified_base (318)..(318): a, c, t, g, unknown or other
  misc_feature (318)..(318): n is a, c, g, or t
  modified_base (329)..(329): a, c, t, g, unknown or other
  misc_feature (329)..(329): n is a, c, g, or t
  modified_base (468)..(468): a, c, t, g, unknown or other
  misc_feature (468)..(468): n is a, c, g, or t
  modified_base (490)..(490): a, c, t, g, unknown or other
  misc_feature (490)..(490): n is a, c, g, or t
tcagcgatcgtatacacgaccggtgctcgatttagtatctgatagttgggtttgggggaggcgtggtccagcctgggaggtccctgagactcgcctgtaaaccgtccggattcaccttcagtaactatgcaatgcactgggtccgccaggctccaggcaaggggctggactgggtggcaggcatatcatttgatggaagcaagaagtactatgcagactccgtgaagggccattcaccatctccagagacagttccgatgacacagtctatctacacatgagcagtgtgagacctgacgacacggtcttctttttacngtgcgcaggancagtgctggcacaatcaatgtcttttgatatctaggataccgaaggacaagtcggtacagttccgtcttccgttccggccctccaaccgaacgggccccacgttccggtccttcccctcggccaccctcctaccaagcnccacctcggtcggggcaaccgnggcccggccgtcgggccttcggccgttcgggctaacgggtccttaccgtccgttacgtaacgcctaaccg

SEQ ID NO: 309650 - DNA, 737 bp, Homo sapiens
  misc_feature: GZ8MTXP01BES2A.51.38.D05.1.454.CMB.2.raw
  modified_base (235)..(235): a, c, t, g, unknown or other
  misc_feature (235)..(235): n is a, c, g, or t
  modified_base (245)..(245): a, c, t, g, unknown or other
  misc_feature (245)..(245): n is a, c, g, or t
  modified_base (251)..(251): a, c, t, g, unknown or other
  misc_feature (251)..(251): n is a, c, g, or t
  modified_base (256)..(256): a, c, t, g, unknown or other
  misc_feature (256)..(256): n is a, c, g, or t
  modified_base (308)..(308): a, c, t, g, unknown or other
  misc_feature (308)..(308): n is a, c, g, or t
tcagcgatcgtatacacgaccggtgctcgatttagtatctgatagttgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcttgcacgtgggaccagcggtnactattggtntttaanaactntgtctctggtaccagccaccaccaggacaaacgcccccaaatcatgatttangtatgtacagtgactccggcctggtacggggtttcaactccggtccctttcgtcgtcggcctacccgaaacggttcccgaacaaccgaccgggtccctccccgtagaccctacttcctccgtcggcccctacggacgggccggaagggaccggagggtcctaggtaactttacgttaaccgtgtaccgtacgtacttaactaacttaaactaaactaaacgtaaccttaaaagttaaacggttaacggggtttacgggggttacgggttaaccgggggaaacggggtaaaccgggtaaacccgttaaaccgggtccggttaacccgggttaaccgtaacgggttacccgaaccggacccggtaacgggtccccgtaaccccggttacccccgtacggttacccttaacccgtttccccgtttaaccccg

SEQ ID NO: 309651 - DNA, 618 bp, Homo sapiens
  misc_feature: GZ8MTXP01AVY4P.51.38.D05.1.454.CMB.2.raw
tcagcgatcgtatacacgaccggtgctcgatttagtatctgatagttgggtttgggggctggggtctcaggaggcagcgctctcgggacgtctccaccatggcctgggctctgctattcctcaccctcctcactcagggcacagggtcctgggcccagtctgccctgactcagcctgcctcgtgtctggtctcctggacagtcgatcaccatctctgcacgtgggaccagcggtagactagttggtatttaataactatgtctcctggtaccagcaccaccaggcaaacgcccccaaatcatgatttatgatgtcagtgactcgcctgtagggttcaactcgtcttctctgcctaccaacgtccgaccaacaccggtccctccctgacccatctctcgccctacgaggccgaggacgaggctagtattacttacgtggacacgtctactataactaactaattaactaaacttaaacgtaaaggtttcggggttcggttaacggggacggttaacggggaaacccttaaacgtcggtaacccggttaccgttagggttacccgaacgacccgaacgggtcccgtaccggaccccccgttcgggttccctttaaccccg

SEQ ID NO: 309652 - DNA, 598 bp, Homo sapiens
  misc_feature: GZ8MTXP01AX73P.51.38.D05.1.454.CMB.2.raw
  modified_base (318)..(318): a, c, t, g, unknown or other
  misc_feature (318)..(318): n is a, c, g, or t
  modified_base (333)..(333): a, c, t, g, unknown or other
  misc_feature (333)..(333): n is a, c, g, or t
tcagcgatcgtatacacgaccggtgctcgatttagtatctgatagttgggtttgggggagacgtggtccagcctgggaggtccctgagactcgcctgtaaaccgtccggattcaccttcagtaactatgcaatgcactgggtccgccaggctccaggcaaggggctggactgggtggcaggcatatcatttgatggaagcaagaagtactatgcagactcgtgaaggccgattcacatctcagagacagttccgatgacacagtctatctacacatgagcagtgtagacgactgacgacgacggtcttctttttacgngtcgcgacgaggacncgtagtcggctggccataactcaattcggtcttttagattagtcgtagggacgaccgaaagggacaagtggtcattccgtcttcgttccggcctccgaacgacggcccctacggtccgtcccgttccccgacgtcccacccctccgtaccaacgacctccgacgtccgggtcggggcaccggttacggcccggttcccgtgggtccgttacgttccgttacggtaacgaacggtaaccttccgttccgttaccggtcgccttccg

SEQ ID NO: 309653 - DNA, 639 bp, Homo sapiens
  misc_feature: GZ8MTXP01CNT4W.51.38.D05.1.454.CMB.2.raw
  modified_base (240)..(240): a, c, t, g, unknown or other
  misc_feature (240)..(240): n is a, c, g, or t
  modified_base (281)..(281): a, c, t, g, unknown or other
  misc_feature (281)..(281): n is a, c, g, or t
  modified_base (318)..(318): a, c, t, g, unknown or other
  misc_feature (318)..(318): n is a, c, g, or t
tcagcgatcgtatacacgaccggtgctcgatttagtatctgatagttgggtttgggggaggcgtggtccagcctgggaggtccctgagactcgcctgtaaaccgtccggattcaccttcagtaactatgcaatgcactgggtccgccaggctccaggcaaggggctggactgggtggcaggcatatcatttgatggaagcaagaagtactatgcagactcgtgaaggccgattcacatcnccagagacagttccgatcgacacagtctatctacacatgancagtgtgagacctgacgacacggtctttctttttacngtcgcgccgaaggaacgcgtaaggtggacgtcggaccctaacaacgttccaatttggttacctttttagattacgtcgtagggacgacccgaaagggactaaagtggtactagttcgtcttccgttccggcctcccgaacgacgggcccctaggttcccggttccctttcccccgcggacccctaccccgtcccttaccgaaaccgacgtccctacccgtacggtcgggggcccacggacggcccgggcccgttcggggccttccggccgttcggtaacgaaacgggtccttaccgttccgttccgtaacgttcccgtccg

SEQ ID NO: 309654 - DNA, 683 bp, Homo sapiens
  misc_feature: GZ8MTXP01BUSL6.51.38.D05.1.454.CMB.2.raw
  modified_base (318)..(318): a, c, t, g, unknown or other
  misc_feature (318)..(318): n is a, c, g, or t
  modified_base (330)..(330): a, c, t, g, unknown or other
  misc_feature (330)..(330): n is a, c, g, or t
tcagcgatcgtatacacgaccggtgctcgatttagtatctgatagttgggtttgggggaggcgtggtccagcctgggaggtccctgagactcgcctgtaaaccgtccggattcaccttcagtaactatgcaatgcactgggtccgccaggctccaggcaaggggctggactgggtggcaggcatatcatttgatggaagcaagaagtactatgcagactccgtgaaggccattcaccatctccagagacagttccgatgacacagtctatctacacatgagcagtgtgagacctgacgacacggtctttctttttacngtgcgcaggaancagtggctggccacaatcaattgtcttttgatatcgtaggacgccgaaagggacctaagtgggtacaagttccgttcttcgttccgggacccttacccgaacccgtaaacggggtccccctacggggttcccggttcccgtttccccccgtcgggcccctaaacccccgttcccttaacccgaaacggtccgacccgtaaccccgttccgggtccggggggaaccctaaccggaacgggccccgggttccccgttacgggggcccttccgggccccgttacggggttaacccgaaacggggtaaccctttaacccgtttccccggttaccggtttaaccggcccttaacccgg

SEQ ID NO: 309655 - DNA, 638 bp, Homo sapiens
  misc_feature: GZ8MTXP01CWCS2.51.38.D05.1.454.CMB.2.raw
  modified_base (199)..(199): a, c, t, g, unknown or other
  misc_feature (199)..(199): n is a, c, g, or t
  modified_base (316)..(316): a, c, t, g, unknown or other
  misc_feature (316)..(316): n is a, c, g, or t
tcagcgatcgtatacacgaccggtgctcgatttagtatctgatagttgggtttgggggaggcgtggtccagcctgggaggtccctgagactcgcctgtaaaccgtccggattcaccttcagtaactatgcaatgcactgggtccgccaggctccaggcaaggggctggactgggtggcaggcatatcatttgatggaancaagaagtactatgcagactcgtgaaggcatcacatctccagagacagttccgatgacacagtctatctacacatgagcagtgtagagacctgacgactacggtctttctttttacngtcgcgccgaaggagcgtaggtcggactcggcccaactaacttactaagttcgttcctttttaggattagtcgtagggaacgaccgaaagggactaagttcggactagtcgttcttaccgttccggccctaccgaaccgtaacgggcccctacggttccccggttccccttcccccgcggaccctacccccgtcctacccgaaacggcctcccgtacccgtcgggtcggggaaccaacgcgggtccccggccgtcgggccttcggcccgttacggaaccgtaaacggtccttaaccgttccggttacgtccggcctaaccgg

SEQ ID NO: 309656 - DNA, 604 bp, Homo sapiens
  misc_feature: GZ8MTXP01CXDVK.51.38.D05.1.454.CMB.2.raw
  modified_base (233)..(233): a, c, t, g, unknown or other
  misc_feature (233)..(233): n is a, c, g, or t
  modified_base (243)..(243): a, c, t, g, unknown or other
  misc_feature (243)..(243): n is a, c, g, or t
  modified_base (253)..(253): a, c, t, g, unknown or other
  misc_feature (253)..(253): n is a, c, g, or t
  modified_base (303)..(303): a, c, t, g, unknown or other
  misc_feature (303)..(303): n is a, c, g, or t
  modified_base (340)..(340): a, c, t, g, unknown or other
  misc_feature (340)..(340): n is a, c, g, or t
tcagcgatcgtatacacgaccggtgctcgatttagtatctgatagttgggtttgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactgggaccagcggtnactattggtntttataactntgtctctggtaccagcaccaccaggcaaacgcccccaaatcatgatttangatgtcagtgatcggcctgagggttcatcgccttctntggctaccaaagtccgcaacgacggcctccctgaccatcctcgtcgccctccgggcgacggacggacgtcgtctagttattactcgtcgacgtacgtctaattaactaacgtaaactaaccgtaaataaactaacggttaggttcgggttacggtaccggggaagggaaccgtaaaccgttacggtacccgttaccgttaacggacgttaccgccgaaccgaacgtccgtaaccccgtccggtcttacctccgttccgttcccc

SEQ ID NO: 309657 - DNA, 549 bp, Homo sapiens
  misc_feature: GZ8MTXP01B84Q3.51.38.D05.1.454.CMB.2.raw
  modified_base (247)..(247): a, c, t, g, unknown or other
  misc_feature (247)..(247): n is a, c, g, or t
  modified_base (252)..(252): a, c, t, g, unknown or other
  misc_feature (252)..(252): n is a, c, g, or t
  modified_base (311)..(311): a, c, t, g, unknown or other
  misc_feature (311)..(311): n is a, c, g, or t
  modified_base (437)..(437): a, c, t, g, unknown or other
  misc_feature (437)..(437): n is a, c, g, or t
  modified_base (451)..(451): a, c, t, g, unknown or other
  misc_feature (451)..(451): n is a, c, g, or t
  modified_base (464)..(464): a, c, t, g, unknown or other
  misc_feature (464)..(464): n is a, c, g, or t
tcagcgatcgtatacacgaccggtgctcgatttagtatctgatagttgggtttgggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactgggaccagcggtgactattggtntttanaactatgtctcctggaccagccaccacccaggaccaaacgcccccaaatcatgatttangatgtcagtgactcggcctgtaggggtttcaatcgtcttctcgtcgaccttccgaagtcccggacaaccgaccggtccctccctagaccctactctccgtcgccctccgacgggtccgaggtacgngctgtattatacgngctagctacatanacaatacaaatactagtggtgtcggcggacggacacgtcgacgttcgttagttccaagccgaagctccgacccgtcgttccgtcc

SEQ ID NO: 309658 - DNA, 625 bp, Homo sapiens
  misc_feature: GZ8MTXP01DN2B0.51.38.D05.1.454.CMB.2.raw
  modified_base (247)..(247): a, c, t, g, unknown or other
  misc_feature (247)..(247): n is a, c, g, or t
  modified_base (314)..(314): a, c, t, g, unknown or other
  misc_feature (314)..(314): n is a, c, g, or t
  modified_base (403)..(403): a, c, t, g, unknown or other
  misc_feature (403)..(403): n is a, c, g, or t
  modified_base (474)..(474): a, c, t, g, unknown or other
  misc_feature (474)..(474): n is a, c, g, or t
tcagcgatcgtatacacgaccggtgctcgatttagtatctgatagttgggtttggggtggggtctcaggaggcagcgctctcgggacgtctccaccatggcctgggctctgctattcctcaccctcctcactcagggcacagggtcctgggcccagtctgccctgactcagcctgcctccgtgtcgtggtctcctggacagtcgatcaccatctcctgcacgtggaccagcggtgactagttggttntttaataaactatgtctcgtggtaccagcacccaccaggaccaaacgcccccaaatcatgtatttangatgtcagtgacgtccggtcctggtaggggtttcaactcccgtcttctcgtgcctaaccgaacgtccggacaaaccgccggccctcccngacctactcctcgtcggccctcgacggaccgtagggacgaggtctagtattaactacgtcgactagtctanaataataaccaataaccaaattaacgtaaggttcgggtacggttacggggaacggtaacgggaacctaaacggttccggaacccgttacgttacggttcaccggcccgaacggtcctcccggcccccttacggtaaccttccgtttccccg

SEQ ID NO: 309659 - DNA, 522 bp, Homo sapiens
  misc_feature: GZ8MTXP01AHBC5.51.38.D05.1.454.CMB.2.raw
  modified_base (242)..(242): a, c, t, g, unknown or other
  misc_feature (242)..(242): n is a, c, g, or t
  modified_base (247)..(247): a, c, t, g, unknown or other
  misc_feature (247)..(247): n is a, c, g, or t
  modified_base (252)..(252): a, c, t, g, unknown or other
  misc_feature (252)..(252): n is a, c, g, or t
  modified_base (302)..(302): a, c, t, g, unknown or other
  misc_feature (302)..(302): n is a, c, g, or t
  modified_base (454)..(454): a, c, t, g, unknown or other
  misc_feature (454)..(454): n is a, c, g, or t
tcagcgatcgtatacacgaccggtgctcgatttagtatctgatagttgggtttgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactgggaccagcggtgacattggtntttanaactntgtctctggtaccagcaccaccaggcaaacgcccccaaatcatgatttangatgtcagtgatcggcctgagggtttcaatcgcttctctggcctcaaagtccggcaaacaccggcctccctgaccatctctcggcctcgaggccgaggacgagctgattatactgcagctcatacacaatcaaataacagttgggtgtcggnggaaggaccaaagtcgaccgtctaaggttcacgcccaaggcctcgcccctggttccaacgttctcccg

SEQ ID NO: 309660 - DNA, 547 bp, Homo sapiens
  misc_feature: GZ8MTXP01D7VA7.51.38.D05.1.454.CMB.2.raw
  modified_base (247)..(247): a, c, t, g, unknown or other
  misc_feature (247)..(247): n is a, c, g, or t
  modified_base (327)..(327): a, c, t, g, unknown or other
  misc_feature (327)..(327): n is a, c, g, or t
  modified_base (342)..(342): a, c, t, g, unknown or other
  misc_feature (342)..(342): n is a, c, g, or t
  modified_base (347)..(347): a, c, t, g, unknown or other
  misc_feature (347)..(347): n is a, c, g, or t
  modified_base (404)..(404): a, c, t, g, unknown or other
  misc_feature (404)..(404): n is a, c, g, or t
tcagcgatcgtatacacgaccggtgctcgatttagtatctgatagttgggtttgggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactgggaccagcggtgacattgggtntttaataactatgtctcctggtaccagcaccaccaggcaaagcccccaaatcatgatttatgatgtcagtgatcggcctnaggggtttcaatcgnttctntgctcaagtccgcaaacacggcctcctgacccatctctggcctcaggccgaggacgngctgtattatctgcagtctacaatataactaataacaaataagtaagttgggtggttcgggacggaacgggtaaaccaaacgtcggtaccgttacgttacggaccgaacgacccgaaggtccctccgccccgtcggttcctcg

SEQ ID NO: 309661 - DNA, 616 bp, Homo sapiens
  misc_feature: GZ8MTXP01CGWUJ.51.38.D05.1.454.CMB.2.raw
tcagcgatcgtatacacgaccggtgctcgatttagtatctgatagttgggtttgggggctggggtctcaggaggcagcgctctcgggacgtctccaccatggcctgggctctgctattcctcaccctcctcactcagggcacagggtcctgggcccagtctgccctgactcagcctgcctcgtgtctgggtctcctggacagtcgatcaccatctcctgcacgtgggaccaggcggtgactagttggtatttataactatgtctcctggtaccagcaccaccaggcaaacgcccccaactcactgatttatgatgtcagtgatccggcctcgtaggggtttcgaactcgcttctctggcctccgaacgtcccgtacaaccaccgggccctccccgtgaaccctactccgttctcggtccctaccgacgggacccgagggaccggacgggcttacggtattactttaacgtcggctacgctaccataactacaaattaccaaataaactaaagttgggttggttcgggacgggttaacgggaaccaaaccggtcgtacccgttacgttcggttacaacggcccgtaacggcgtccgccccgtcggttccttaacccg

SEQ ID NO: 309662 - DNA, 620 bp, Homo sapiens
  misc_feature: GZ8MTXP01BSPTB.51.38.D05.1.454.CMB.2.raw
  modified_base (239)..(239): a, c, t, g, unknown or other
  misc_feature (239)..(239): n is a, c, g, or t
  modified_base (261)..(261): a, c, t, g, unknown or other
  misc_feature (261)..(261): n is a, c, g, or t
  modified_base (312)..(312): a, c, t, g, unknown or other
  misc_feature (312)..(312): n is a, c, g, or t
tcagcgatcgtatacacgaccggtgctcgatttagtatctgatagttggggtttggggggggtctcaggaggcagcgctctcgggacgtctccaccatggcctgggctctgctattcctcaccctcctcactcagggcacgagggtcctgggcccagtctgccctgactcagcctgcctcgtgtcgtgggtctccgtggacagtcgatcactatcctctgcacgtggaccaggtcggtnacgtagttggttattataactntgtctcgtgtacagcaccaccagacaaaccgccccaaatcatagtatttangtatgtagtagtcgtcgtccgtcgtacggtacggtactacgtctccttcgtcgtacgcctaccgaacgccgaaccgaccgtcccgtcctcctacgtactctctcgcgccgacggaccggacgaggtacggacgtactacgtacttacgtctacgacctaggtactacgtaataactaactaagaacgtaaattacggtaggtcggtacggtacgggacggaacggtaacccgacgtacgttaccgtacgtaacgccgacggaccctcggtcccgcccgtcccgtcgttacctccgttcccgtaacccg

SEQ ID NO: 309663 - DNA, 586 bp, Homo sapiens
  misc_feature: GZ8MTXP01C56HZ.51.38.D05.1.454.CMB.2.raw
  modified_base (247)..(247): a, c, t, g, unknown or other
  misc_feature (247)..(247): n is a, c, g, or t
  modified_base (257)..(257): a, c, t, g, unknown or other
  misc_feature (257)..(257): n is a, c, g, or t
  modified_base (308)..(308): a, c, t, g, unknown or other
  misc_feature (308)..(308): n is a, c, g, or t
tcagcgatcgtatacacgaccggtgctcgatttagtatctgatagttgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcacgtgggaccaggcggtgacagtttggtntttataactntgtctcctggtaccagcaccacccaggcaaagcccccaaatcatgatttangatgtcagtgatcggcctgaggggtttcaatcgccttctctggctccaaagtccggcaaacacggcctccctgaccatctctggccctccgagggccgaggacgagggctgattatactgcaggctcatataacaatcaaataacaagtttggggtagttccgggcgggaacgggaacccaaacgttcggaacccgttccgtaagggttccacggaccccgaaaggggtcccttccggcccccccgttcgggttccctaaccgttcccgtttccccgg

SEQ ID NO: 309664 - DNA, 559 bp, Homo sapiens
  misc_feature: GZ8MTXP01B6BC1.51.38.D05.1.454.CMB.2.raw
  modified_base (236)..(236): a, c, t, g, unknown or other
  misc_feature (236)..(236): n is a, c, g, or t
  modified_base (246)..(246): a, c, t, g, unknown or other
  misc_feature (246)..(246): n is a, c, g, or t
  modified_base (389)..(389): a, c, t, g, unknown or other
  misc_feature (389)..(389): n is a, c, g, or t
  modified_base (394)..(394): a, c, t, g, unknown or other
  misc_feature (394)..(394): n is a, c, g, or t
  modified_base (434)..(434): a, c, t, g, unknown or other
  misc_feature (434)..(434): n is a, c, g, or t
tcagcgatcgtatacacgaccggtgctcgatttagtatctgatagttgggtttgggggctggggtctcaggaggcagcgctctcgggacgtctccaccatggcctgggctctgctattcctcaccctcctcactcagggcacagggtcctgggcccagtctgccctgactcagcctgcctccgtgtctggtctcctggacagtcatcaccatcctctgcacgtgggaccagcggtnactattggtntttaataactatgtctcctggtaccagcaccacccaggccaaacgcccccaaactcatgatttatgatgtcagtgactccggcctcgtaggggtttcaactcgtcttctctggactccaagtccgacaacgaccggcctcccngaccntctctcggcctccgaggccgaggacgaggctgattatacnggcagtcctacatacacaatacaaataactagttgggtgttcgggacggttaacgggaccaacgtcgtaccgttcgttacggttccaacgcccgaacggctccgttcccctcgggttcctaaccg

SEQ ID NO: 309665 - DNA, 611 bp, Homo sapiens
  misc_feature: GZ8MTXP01EIQSX.51.38.D05.1.454.CMB.2.raw
  modified_base (313)..(313): a, c, t, g, unknown or other
  misc_feature (313)..(313): n is a, c, g, or t
  modified_base (517)..(517): a, c, t, g, unknown or other
  misc_feature (517)..(517): n is a, c, g, or t
tcagcgatcgtatacacgaccggtgctcgatttagtatctgatagttgggtttgggggctggggtctcaggaggcagcgctctcgggacgtctccaccatggcctgggctctgctattcctcaccctcctcactcagggcacagggtcctgggcccagtctgccctgactcagcctgcctccgtgtctggtctctggacagtcgatcaccatctcctgcacgtggggaccagcggtagactagtttggtatttaataactatgtctcctggaccagccaccaccaggcaaacgcccccaaatcatgtatttangatgtcagtgactcggcccttgacggggtttcactcgtcttctcgtcggaccctaccgaacggtcccgacgaaacccgccggtccctaccccgtgaccctatcctcgtcgcctccgagggacccgagggaccgagggctagtatttaacgttcgtggactagtcctataataactacaattacgaaataacgtaagtttcgggngttaacgggcggaacggaaccttaaacgtgtacccgttacgttacggttacgaacgtacccgaagtcccgtccgccccgttcggttaactcccg

SEQ ID NO: 309666 - DNA, 608 bp, Homo sapiens
  misc_feature: GZ8MTXP01APU0H.51.38.D05.1.454.CMB.2.raw
  modified_base (307)..(307): a, c, t, g, unknown or other
  misc_feature (307)..(307): n is a, c, g, or t
  modified_base (442)..(442): a, c, t, g, unknown or other
  misc_feature (442)..(442): n is a, c, g, or t
tcagcgatcgtatacacgaccggtgctcgatttagtatctgatagttgggtttgggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcacgtgggaccagcggtgactattggtatttataactatgtctcctggtaccagcaccaccaggcaaacgccccaaatcatgattangatgtcagtgatcgcctgaggggtttcaactcgcttctctggacctccaagtccggcaaaccgccggccctccctgaccctatcctctcggccctccgaggaccgagggaccgaggccttagaactttagttacncgggacagtcctactaatactacaatactaaactaacgtaaagtttcggggtgttccgggacgggttaacggggaacccttaaacgtcggtaacccgttccgttaacggttccgaacgccccgtaaaggtcccgtcggttccccccgttgggttccgttaaccccg

SEQ ID NO: 309667 - DNA, 768 bp, Homo sapiens
  misc_feature: GZ8MTXP01CST5X.51.38.D05.1.454.CMB.2.raw
tcagcgatcgtatacacgaccggtgctcgatttagtatctgatagttgggtttgggggctttgcctgggctctgctattcctcaccctcctcactcagggcacagggtcctgggcccagtctgccctgactcagcctgcctccgtgtctgggtctcctggacagtcgatcaccatctcctgcactgggaccagcggtgactattggtattataactatgtctcctgtaccagcaccaccaggacaaacgccccaaatcatgtatttatgatgtcagtgagtccggcccgtcgtaggggtttcaatccgtcttctctggctaccgtaaacggtcccggaccaaaccgacccggtccctcccgtacgacccccgacttctacgtccggccctaacccgggaacgggcccggaagggaccgggtaacgggtctacgtaagtttaacgttaaccgttcggacctaaggtacttaccaaattaaacttaaaactaaacttactaaaaagtaaaacccgttaaagggtttcgggggttaggtttaacccggggggaacggggggtaaaccggggtaaacccgttaaaaccgttccggggtaaaccccggttaccgtaacggggtttaccaaaccgggtccccgaaagggtccgttaccgtcccgttaacccgtccgggttactacccttcgttacccgttcccccttaccccttccgttaccttaacccgtaaacccgtccgtcttcgggacgggttccgggcgttaaccgggg

SEQ ID NO: 309668 - DNA, 750 bp, Homo sapiens
  misc_feature: GZ8MTXP01A8AEH.51.38.D05.1.454.CMB.2.raw
  modified_base (238)..(238): a, c, t, g, unknown or other
  misc_feature (238)..(238): n is a, c, g, or t
  modified_base (261)..(261): a, c, t, g, unknown or other
  misc_feature (261)..(261): n is a, c, g, or t
  modified_base (318)..(318): a, c, t, g, unknown or other
  misc_feature (318)..(318): n is a, c, g, or t
tcagcgatcgtatacacgaccggtgctcgatttagtatctgatagttggggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcacgtggggaccaggcggtnactagtttggtatttataaactntgtctcgtggtacccagccaccaccaggaccaaaccgcccccaaatcatgtatttangatgtcaggtgactccggccttaggtacgggtttacgaatccgtcctttctcgtacggtccttacccgaaaacgggttccccggaacaaacccgtacccgggtccccttccccgtacggtaaccctacttcccgtaccgttccgggccccttccgggacggacccgggaaggggaaccggacgggtcttacggtaatttacgttacgtacgctacgggtactacctaaacttaaataacctaaaggttaccaaaagtttaaaccgtaaagggttttcgggggtacggttacccggggaaggggtaaaccggggaaaccttaaacggttccgaacccggttaccgtaaaggggttccaccgaccccggttaaagggcccctaacccgggtccccccgttacgggttacccctccgtttaacccggttcccccg

SEQ ID NO: 309669 - DNA, 829 bp, Homo sapiens
  misc_feature: GZ8MTXP01AHMOX.51.38.D05.1.454.CMB.2.raw
  modified_base (317)..(317): a, c, t, g, unknown or other
  misc_feature (317)..(317): n is a, c, g, or t
tcagcgatcgtatacacgaccggtgctcgatttagtatctgatagttgggtttgggggaggcgtggtccagcctgggaggtccctgagactcgcctgtaaaccgtccggattcaccttcagtaactatgcaatgcactgggtccgccaggctccaggcaaggggctggactgggtggcaggcatatcatttgatggaagcaagaagtactatgcagactccgtgaaggccattccaccatctccagagacagttccatgacacagtcatctacacatgagcagtgtgagacctgacgacacggtctttctttttacngttcgcgaccgaggaacgcgtaggtcggactcgggacccaactaaacttcctaagtttcggttaccgttttttaggaactttaacgtccggttaggggaaaccggtaccccggaaaagggggtaaaccctaaaaggtttccggggttaacctaacggtttcccgggttaccctttacccggttttccccggggaccccctttacccccggaaaccccggtaaaccgggggttcccccccttaaacgggggttttccccgggttcccccgttttcccccccggtaacggggtcccccctacccccggttacccccttacccgaaaaacgttcccggacccctaacccggttcccggggtcggggggaaacccccaccgggttacccggggccccgggttcccggggttacggggtcccgttaccgggttcccggttacggggttaaccgtaaacccgggttaacccgttttaccccgtttcccggttaccggtaacccggttcccgttaaccg

SEQ ID NO: 309670 - DNA, 717 bp, Homo sapiens
  misc_feature: GZ8MTXP01BHCWC.51.38.D05.1.454.CMB.2.raw
  modified_base (233)..(233): a, c, t, g, unknown or other
  misc_feature (233)..(233): n is a, c, g, or t
  modified_base (310)..(310): a, c, t, g, unknown or other
  misc_feature (310)..(310): n is a, c, g, or t
  modified_base (660)..(660): a, c, t, g, unknown or other
  misc_feature (660)..(660): n is a, c, g, or t
tcagcgatcgtatacacgaccggtgctcgatttagtatctgatagttggggtttggggggggtctcaggaggcagcgctctcgggacgtctccaccatggcctgggctctgctattcctcaccctcctcactcagggcacagggtcctgggcccagtctgccctgactcagcctgcctccgtgtctggtctcctggacagtcatcaccatctcctgcactgggaccagcggtnactagtttggtatttaataactatgtctcctggtaccagcaccacccaggacaaacgcccccaaatcatgtatttangatgtcagtgactccggtcctagtagggggtttcattcgtccttctcgtcggccctacccgtaaaacggtcccggcaaacccgacccgggtccccttccccgtacgaaccctagttcccttcgtcggtccccgtaccggacgggcccggaacggggacccggagggtaccttggtaaacttttacgttaaccgttggaccctaaggggttccttacgtaaactttaactaaacctaaacttaaccgtaaaattaaaccgttaaagggttttcgggggtacggttaccggggaacggggtaaaccgggaaccttaaaacggtcggttaacccggtaccgtacgggttaccncggacccgaaggtccctaacccgtccccgtcggttacctaaccgttccgttccccgg

SEQ ID NO: 309671 - DNA, 654 bp, Homo sapiens
  misc_feature: GZ8MTXP01C478S.51.38.D05.1.454.CMB.2.raw
  modified_base (317)..(317): a, c, t, g, unknown or other
  misc_feature (317)..(317): n is a, c, g, or t
tcagcgatcgtatacacgaccggtgctcgatttagtatctgatagttgggtttgggggctggggtctcaggaggcagcgctctcgggacgtctccaccatggcctgggctctgctattcctcaccctcctcactcagggcacgagggtcctgggcccagtctgccctgactcagcctgcctcatgtctgggtcctccgtggacagtcgatcaccatctcctgcacgtgggaccaggcggtgactagtttggtagtttataactatgtctctgtaccagcaaccaccgagaccaaacgcccccaaatcatgtatttangatgtacagtgacgtccggcccttgtacggggtttaccaatcgtcttctcgtaacggcctccgaaacggtcccgacaaaccgccggtccctacccgtacgaccctatccgtccgtcggaccctaccggacgggaccggagggacgaggtctagtaactttacgttacggcgacgtaactccttaacaattaactaacgaaacttaactaaaattaacggtaagtttgggggtaacgttaccgggacgggtaaaccgaaccgtaaacgtcggttaacccggttcttaacgggtaaccacgtaacccgaagggcccttacccgtcccccgttgtaaccc

SEQ ID NO: 309672 - DNA, 607 bp, Homo sapiens
  misc_feature: GZ8MTXP01B06HH.51.38.D05.1.454.CMB.2.raw
tcagcgatcgtatacacgaccggtgctcgatttagtatctgatagttgggtttgggggaggcgtggtccagcctgggaggtccctgagactcgcctgtaaaccgtccggattcaccttcagtaactatgcaatgcactgggtccgccaggctccaggcaaggggctggactgggtggcaggcatatcatttgatggaagcaagaagtactatgcagactccgtgaagggccgattcaccatctccagagacagttccgatcgacacagtctatctacacatgagcagtgtgagacctgacgacacggtctttctttttactgtcgcgcaggagcgtaggtcggctcggccacgtaactctaattcggttcttttgacttatcgtaggacgacgaagggactaagtggtactagttccttcttccgtccggcctacccgaaccggaacgggtcccctacggttcccggttccccttccccgcgcccctacccctccaccgaaacgctccgacccgtcgggcggggccacgcgggtcccggccgtcgggtcttccggttccgttcggtaacgtaaccggtcctttaccgtccgttacgtcgcgtaaccg

SEQ ID NO: 309673 - DNA, 596 bp, Homo sapiens
  misc_feature: GZ8MTXP01AWA4E.51.38.D05.1.454.CMB.2.raw
  modified_base (145)..(145): a, c, t, g, unknown or other
  misc_feature (145)..(145): n is a, c, g, or t
  modified_base (265)..(265): a, c, t, g, unknown or other
  misc_feature (265)..(265): n is a, c, g, or t
  modified_base (315)..(315): a, c, t, g, unknown or other
  misc_feature (315)..(315): n is a, c, g, or t
  modified_base (546)..(546): a, c, t, g, unknown or other
  misc_feature (546)..(546): n is a, c, g, or t
tcagcgatcgtatacacgaccggtgctcgatttagtatctgatagttgggtttgggggaggcgtggtccagcctgggaggtccctgagactcgcctgtaaaccgtccggattcaccttcagtaactatgcaatgcactgggtccnccaggctccaggcaaggggctggactgggtgccaggcatatcatttgatggaagcaagaagtactatgcagactccgtgaaggcattcaccatctcagagacagttccgatgacacagtnatactacacatgagcagtgagagacctgacgacacggtcttctttttacngtcgcgaccgaaggagcgtacgtggctcggacccacgtaatcctaagttctcgtttttagatttacgtcgtaggaacgacccgtaaagggactaaagtcggtactattcgtctcgttccggccctaccacgaacggtcccacggttccgtcccgttccccgtcggaccctacccctccgtaccaacgactcccgaccgttcggcggggccaacgcggccggcccgtgggcncgttccgttagggtaaccacgtaacctacgtccgttcgtaacgcctaacg

SEQ ID NO: 309674 - DNA, 719 bp, Homo sapiens
  misc_feature: GZ8MTXP01ALVJO.51.38.D05.1.454.CMB.2.raw
  modified_base (237)..(237): a, c, t, g, unknown or other
  misc_feature (237)..(237): n is a, c, g, or t
  modified_base (301)..(301): a, c, t, g, unknown or other
  misc_feature (301)..(301): n is a, c, g, or t
  modified_base (313)..(313): a, c, t, g, unknown or other
  misc_feature (313)..(313): n is a, c, g, or t
tcagcgatcgtatacacgaccggtgctcgatttagtatctgatagttgggtttgggggctggggtctcaggaggcagcgctctcgggacgtctccaccatggcctgggctctgctattcctcaccctcctcactcagggcacagggtcctgggcccagtctgccctgactcagcctgcctccgtgtctggtctcctggacagtcgatcaccatctcctgcacgtgggaccagcggtnactattggttatttatactatgtctctgaccagccaccaccgagaccaaacgccccaaatcatntattatgatgtnagtgacgtccgtccgtagtacgggtttacaacttcgtcttctcgtcgtaccctacgaacggtccgaccgaaccgtacccgtccctcccgtacgtaccctacgtccttccgtcggtccctaccggacgggaccggtacgggacgtacggtctagttaactttacgttaccgacggggtactacgtaccttaacgtaaacttaaacgtaaacttaaacttaaacccgtaaaagttaaaccggttaaacggggtttcggggttaccggggttaaccggggaaacgggttaaaccggggtaaacccttaaaccggtaacccgggtaacccgttaccggttacggacccgaacccggtacccgaaccgggttccctaccccgggccccgtttcggttaacccttaaccccg

SEQ ID NO: 309675 - DNA, 708 bp, Homo sapiens
  misc_feature: GZ8MTXP01EL9E7.51.38.D05.1.454.CMB.2.raw
tcagcgatcgtatacacgaccggtgctcgatttagtatctgatagttgggtttgggggaggcgtggtccagcctgggaggtccctgagactcgcctgtaaaccgtccggattcaccttcagtaactatgcaatgcactgggtccgccaggctccaggcaaggggctggactgggtggcaggcatatcatttgatggaagcaagagtactatgcagactccgtgaaggccgattcaccatctccagagacagttccgatgacacagtctatctacacatgagcagtgtgagacctgacgacacggcttctttttactgtgcgtccgaggaacgcgtagtggctgggccacaatcaatgtcttttgattagtctagggacgaccgaagggtactaaagtcgggtactaacgttaccggttctttccgtttccgggccccttaccccgtaaccccgaaaccggggtcccccgtaacgggtttaccccggtttccccgtttacccccccgttaccggggtccccgtaacccccgttaccccttaccccgtaaacgtacgaccccgtaaccccgttccgttacgggggggtcccaaccggttaacgggccccgggttccccggttcggggcccgttcggttccccgttcggggttaaccgaaaccgggtaaccctttaaccgttcccgttaccgtaacggttcccttaacccg

SEQ ID NO: 309676 - DNA, 625 bp, Homo sapiens
  misc_feature: GZ8MTXP01BDDSY.51.38.D05.1.454.CMB.2.raw
  modified_base (238)..(238): a, c, t, g, unknown or other
  misc_feature (238)..(238): n is a, c, g, or t
  modified_base (258)..(258): a, c, t, g, unknown or other
  misc_feature (258)..(258): n is a, c, g, or t
  modified_base (297)..(297): a, c, t, g, unknown or other
  misc_feature (297)..(297): n is a, c, g, or t
  modified_base (307)..(307): a, c, t, g, unknown or other
  misc_feature (307)..(307): n is a, c, g, or t
  modified_base (313)..(313): a, c, t, g, unknown or other
  misc_feature (313)..(313): n is a, c, g, or t
tcagcgatcgtatacacgaccggtgctcgatttagtatctgatagttgggtttgggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcacgtgggaccagcggtnactattggtatttataactntgtctctgaccagccaccaccaggacaaacgccccaaancatgatttangatgtnagtgacgtcggccctggtaggggtttcaattccgctttcgtcgtcggtacctaccgaacggtcccgaccaaaccgccgggccccttccgacgaccctactcctcgtcgccctccgagggccgagggaccgaggtctagtaactttatacgtggactacgtctactaataacgtactaaatacaaataacgtaaggttgggtcgttcggggaacggacgggtaaaccaagtaccggtaccgttaccggaggttccgaaccgacccggaacggtcccgtacccggttacccccgtcgggttaaccgtaaccccg

SEQ ID NO: 309677 - DNA, 700 bp, Homo sapiens
  misc_feature: GZ8MTXP01CSQO7.51.38.D05.1.454.CMB.2.raw
  modified_base (258)..(258): a, c, t, g, unknown or other
  misc_feature (258)..(258): n is a, c, g, or t
  modified_base (313)..(313): a, c, t, g, unknown or other
  misc_feature (313)..(313): n is a, c, g, or t
tcagcgatcgtatacacgaccggtgctcgatttagtatctgatagttgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctgacagtcatcaccatctcctgcacgtgggaccaggcggtgactagtttggtatttaataacttntgtctcctggtaccagcaccaccaggacaaacgcccccaaatcatagtatttagngatgtaccagtcgtaacgtccggacccttggtaacgggggtttacaagttccgtcctttcgtcgtggtacctacccgaaacgttcccggaacaaaccgtcccgggacccttccccgagacccctattcccgtcgtcccgccctacccggagggcccggaaagggtacggagggtaccttaggtaactttaacgtaactcggtaccgacgggtaccttaaccgtaaatttaaccaaactaaactaaccgaaatttaaaccgtagtttcggggtacgttacgggacgggaaacggaaacccttaaaggtccgacccgttacgacggaccgttacggaccccgaagggtccctccgtcccccggttagccctaaccgttccgtttccccg

SEQ ID NO: 309678 - DNA, 661 bp, Homo sapiens
  misc_feature: GZ8MTXP01A7I93.51.38.D05.1.454.CMB.2.raw
  modified_base (316)..(316): a, c, t, g, unknown or other
  misc_feature (316)..(316): n is a, c, g, or t
  modified_base (323)..(323): a, c, t, g, unknown or other
  misc_feature (323)..(323): n is a, c, g, or t
tcagcgatcgtatacacgaccggtgctcgatttagtatctgatagttgggtttgggggctgggggtctcaggaggcagcgctctcgggacgtctccaccatggcctgggctctgctattcctcaccctcctcactcagggcacagggtcctgggcccagtctgccctgactcagcctgcctcgtgtctgggtctctggacagtcgatcacatctctgcacgtgggaccagcggtagactagttggtatttaataactatcgtctccgtggaccagccaccaccgaggaccaaaccgccccaaatcatagtatttangatgtanagtacgacgtccggcccgtaggtacggggtttacaacttccggtcttcgtcgtacggacctaccgaacgtccggaccaaaccgccggtccctacctagaaccctactctccggtcgcccgtaccggacggaccgggaacggtacggacggtctagtaacttacgttacgcggactacgtctactaaattaactactaaactaactaaacgtaaacgttaggttagggtcggtaacgggaacgggacggtaaaccttaaacggtccgaacccggttcgacggttaccgaaccggtaccgaacggtccccgtccggttccccgttaacgttccttcccgg

SEQ ID NO: 309679 - DNA, 571 bp, Homo sapiens
  misc_feature: GZ8MTXP01DCEVX.51.38.D05.1.454.CMB.2.raw
  modified_base (246)..(246): a, c, t, g, unknown or other
  misc_feature (246)..(246): n is a, c, g, or t
  modified_base (436)..(436): a, c, t, g, unknown or other
  misc_feature (436)..(436): n is a, c, g, or t
  modified_base (530)..(530): a, c, t, g, unknown or other
  misc_feature (530)..(530): n is a, c, g, or t
tcagcgatcgtatacacgaccggtgctcgatttagtatctgatagttgggtttgggggctggggtctcaggaggcagcgctctcgggactctccaccatggcctgggctctgctattcctcaccctcctcactcagggcacagggtcctgggcccagtctgccctgactcagcctgcctcgtgtctggtctcctggacagtcgatcacatctcctgcacgtgggaccagcggtgactagtttggtntttaataactatgtctctggtaccagcaccacccaggacaaacgcccccaaatcatgtatttatgatgtcagtgactcggcctcgaggggtttcaactcgcttctctggactccaagtccggacaaacgaccggcctccctgaccatctctcggcctcaggccgaggacgaggctgattatactgggacngctacatatacaaatacaaataaactaagttgggtggttaacgggcgggaacggggaaaccaaacgtcgtaacccgttaccgttacggttaccncgaacccgaacggtcctccgcccccttcggttctaaccccg

SEQ ID NO: 309680 - DNA, 666 bp, Homo sapiens
  misc_feature: GZ8MTXP01DJ2K4.51.38.D05.1.454.CMB.2.raw
  modified_base (234)..(234): a, c, t, g, unknown or other
  misc_feature (234)..(234): n is a, c, g, or t
  modified_base (504)..(504): a, c, t, g, unknown or other
  misc_feature (504)..(504): n is a, c, g, or t
tcagcgatcgtatacacgaccggtgctcgatttagtatctgatagttgggtttgggggctggggtctcaggaggcagcgctctcgggactctccaccatggcctgggctctgctattcctcaccctcctcactcagggcacagggtcctgggcccagtctgccctgactcagcctgcctcgtgtctggtctcctggacagtcatcaccatcctctgcacgtgggaccagcggtnactgtttggtatttaataactatcgtctctggaccagccaccaccaggaccaaaccgaccccaaatcatgtaatttatagtatgtctagtgacgttccggtacccgttacggtaggggtttacaaccgtccgtcttcgtaccgtcggtaccctaccgaacggtccggaaccaaacccgtacccggtcccctccctacgaccctacttccgtcgtccggaccctccgaacggggaccggacgggacgagggtaccttgtaattacttacgngggactagtactacaactactaacctaataaactaaactaaacgttaaggttgggttacggttaacgggacgggaaacgggtaaccaaacggttccgtacgttacgttcggttaccgaacgaccgtaacggtccgtcccggttccctcggttccttaacccg

SEQ ID NO: 309681 - DNA, 624 bp, Homo sapiens
  misc_feature: GZ8MTXP01ENKW9.51.38.D05.1.454.CMB.2.raw
  modified_base (276)..(276): a, c, t, g, unknown or other
  misc_feature (276)..(276): n is a, c, g, or t
  modified_base (336)..(336): a, c, t, g, unknown or other
  misc_feature (336)..(336): n is a, c, g, or t
tcagcgatcgtatacacgaccggtgctcgattttagtatctgatagttggggtttgggggaggcgtggtccagcctgggaggtccctgagactcgcctgtaaaccgtccggattcaccttcagtaactatgcaatgcactgggtccgccaggctccaggcaaggggctgggactggggtggcaggcatatcatttgatggaaagaaagaagtactatgcagactccgtgaacgggccattcacatctcagagactagttccgatgacacagtctanctacacatgagcaggtgtagaacgacctgaccgaactaccggtcttttactttttttacnggttcgacgaccgaggaagcaggtcggctcggaccacatcatgtcttttgatatcgtgggacaccgaagggacaagtggacattcgtacttcgttcggccctcaccgaacggtcccacgttccggggtccctttcccccgacggtcccctaaccctccctacgaacgtaccgccctaccgttccggcgggggcaaccgcggttcccggcccggttcggcgtccggttccgttcgggttaccgtaaacggtccttaacccttaccgttccgacgtcttaaccgttcggg

SEQ ID NO: 309682 - DNA, 612 bp, Homo sapiens
  misc_feature: GZ8MTXP01B8DC9.51.38.D05.1.454.CMB.2.raw
  modified_base (237)..(237): a, c, t, g, unknown or other
  misc_feature (237)..(237): n is a, c, g, or t
  modified_base (247)..(247): a, c, t, g, unknown or other
  misc_feature (247)..(247): n is a, c, g, or t
  modified_base (257)..(257): a, c, t, g, unknown or other
  misc_feature (257)..(257): n is a, c, g, or t
tcagcgatcgtatacacgaccggtgctcgatttagtatctgatagttggggtttgggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcacgtgggaccagcggtnactgttggtntttataactntgtctctggtaccagcacacccaggcaaacgacccccaaatcatgtatttatgatgtcagtgactcggcctgagggttcatcgtccttctctcggcctaccgaacgtcccggcaaccgaccgggccctcccgtagaccctatcctctcggccctccgaggaccgagggacgaggtctagtattagttactcgctacggtctacaattaacaactaaactacgaaattaacgtaggttcggggttagttcgggagggaaacgggtaaccaaagtccggaaccgttcgtacggttaccgacgacccggtaagcccgtccgcccccgtacggttccctaaccgttccccgttcccccg

SEQ ID NO: 309683 - DNA, 609 bp, Homo sapiens
  misc_feature: GZ8MTXP01A1GIQ.51.38.D05.1.454.CMB.2.raw
  modified_base (237)..(237): a, c, t, g, unknown or other
  misc_feature (237)..(237): n is a, c, g, or t
  modified_base (315)..(315): a, c, t, g, unknown or other
  misc_feature (315)..(315): n is a, c, g, or t
  modified_base (357)..(357): a, c, t, g, unknown or other
  misc_feature (357)..(357): n is a, c, g, or t
  modified_base (376)..(376): a, c, t, g, unknown or other
  misc_feature (376)..(376): n is a, c, g, or t
tcagcgatcgtatacacgaccggtgctcgatttagtatctgatagttggggtttggggggggtctcaggaggcagcgctctcgggacgtctccaccatggcctgggctctgctattcctcaccctcctcactcagggcacagggtcctgggcccagtctgccctgactcagcctgcctcgtgtctgggtctcctggacagtcgatcaccatcctcctgcacgtgggaccaggcggtnactagttggtagtttaataactatgtctcctggtaccagcaccacccaggaccaaacgcccccaaaatcatgatttangatgtcagtgactcggccctagaggggtttcaatcgcttctntggctcaaagtccgcaacnccggcctcctcgaccatcctctcggccctccgacgggcccgagggaccgagggtctacggtatttacttactcggacaacggtctacaatactaacaaataccaaattaaaccgtagttggggtagttacgggacgggtaacggaaccaaacgtcggacccgtcgtaacggttccgacggcccgaaggtccgtcccggtcccccttcgggttcctaaccgttccgttccccgg

SEQ ID NO: 309684 - DNA, 620 bp, Homo sapiens
  misc_feature: GZ8MTXP01EOOP6.51.38.D05.1.454.CMB.2.raw
  modified_base (200)..(200): a, c, t, g, unknown or other
  misc_feature (200)..(200): n is a, c, g, or t
  modified_base (210)..(210): a, c, t, g, unknown or other
  misc_feature (210)..(210): n is a, c, g, or t
  modified_base (215)..(215): a, c, t, g, unknown or other
  misc_feature (215)..(215): n is a, c, g, or t
  modified_base (226)..(226): a, c, t, g, unknown or other
  misc_feature (226)..(226): n is a, c, g, or t
  modified_base (232)..(232): a, c, t, g, unknown or other
  misc_feature (232)..(232): n is a, c, g, or t
  modified_base (248)..(248): a, c, t, g, unknown or other
  misc_feature (248)..(248): n is a, c, g, or t
  modified_base (299)..(300): a, c, t, g, unknown or other
  misc_feature (299)..(300): n is a, c, g, or t
  modified_base (394)..(394): a, c, t, g, unknown or other
  misc_feature (394)..(394): n is a, c, g, or t
  modified_base (397)..(397): a, c, t, g, unknown or other
  misc_feature (397)..(397): n is a, c, g, or t
tcagcgatcgtatacacgaccggtgctcgatttagtatctgatagttgggtttgggggctggggtctcaggaggcagcgctctcgggacgtctccaccatggcctgggctctgctattcctcaccctcctcactcagggcacgagggtcctgggcccagtctgccctgactcagcctgcctcgtgtctggtctctggacngtcgatcacntctcngcacgtggacngcgtanactagttgtatttaanaatatgtctctgaccagcaccacagaccaaacgccccaatcatgtatttannatgacagtgacgtcgccgtagtagggttcaactccgtcttcgtcgtcgaaccttacgaacgtccgacctaaaccgccgccctaccgtcgacctntcncgttcgccctacgacggtaccgagggacgacggtctagttaacttacgtacgtggactagtctaactaagtaccttaagaaactagtaaacttaacgtaagttgggtcggttaacggacggttaaacggaacccttaaagtccgtaaccgttcggttacggacccgaaaccgtcccgaaggtccccgtccggttaacccccgttcggttaacccttaaccccg

SEQ ID NO: 309685 - DNA, 748 bp, Homo sapiens
  misc_feature: GZ8MTXP01AE8BB.51.38.D05.1.454.CMB.2.raw
  modified_base (238)..(238): a, c, t, g, unknown or other
  misc_feature (238)..(238): n is a, c, g, or t
tcagcgatcgtatacacgaccggtgctcgatttagtatctgatagttgggtttgggggctggggtctcaggaggcagcgctctcgggacgtctccaccatggcctgggctctgctattcctcaccctcctcactcagggcacgagggtcctgggcccagtctgccctgactcagcctgcctcgtgtctgggtctcctggacagtcgatcacatctcctgcacgtgggaccaggcggtnactgttggtatttataactatgtctctggacagcaccaccaggacaaacgaccccaaactcatgtatttatgatgtcgagtgacgtccggtcctacggtacggggtttacgaacgttccgtacgtttctcgtcggtcctaccgtaacggttcccgggacctaaaccggtacccggcccttacccgtacgtaaaccctacttcctaccggttccggacccttacccggaacggggacccggaacgggaaccggacggggtaccttaggttaactttaacgttaacgtcggggactaacgtcctaacctaattaacgtaaacctaaacttaacgtaaaacgttaaaccgttaaagggtttcggggtttacgggttaaccgggggaacggggttaaacccgggtaaaccgttaaacggtaccggtaacccggttaccggttacgggttaaccgaaccggacccggtaaacgggtcccgtaccccggaccccggttccggttaacgttcccccg

SEQ ID NO: 309686 - DNA, 762 bp, Homo sapiens
  misc_feature: GZ8MTXP01B36CI.51.38.D05.1.454.CMB.2.raw
  modified_base (264)..(264): a, c, t, g, unknown or other
  misc_feature (264)..(264): n is a, c, g, or t
  modified_base (325)..(325): a, c, t, g, unknown or other
  misc_feature (325)..(325): n is a, c, g, or t
tcagcgatcgtatacacgaccggtgctcgatttagtatctgatagttgggtttgggggaggcgtggtccagcctgggaggtccctgagactcgcctgtaaaccgtccggattcaccttcagtaactatgcaatgcactgggtccgccaggctccaggcaaggggctggactgggtggcaggcatatcatttgatggaagcaagaagtactatgcagactccggtgaagggccattcacatctccagagacagttccgatgacanagtctatctacacatgagcaggtgtagacgaccgtagacgaacacggtctttctttttacngtcgcgaccgaggaagcgacgtggcgtacggcccaactaatacctaagttcgttacgttttaggactttagtaccgggtagggaaacggtaacccggtaaaaggggaaccttaaacggttggggttaccttaacgtttacccgggtttccgttcccggtttaccccgggaccccttaaccccggaaacccggaaaccggggtcccccgttaaccggggtttccccggggtttcccccttcccccccggtcgggtaccccctaacccccgttaccccgtaccgaaaacggccgtacccgtaacccggtcggggtcgggggaaccaccgggcgggtccccgttccccgggtacgggtcgttccggttccccggttagggttaacccaacgggttaaccctttacccggttaccgttccgggtaaccgccgttaacccgg

SEQ ID NO: 309687 - DNA, 771 bp, Homo sapiens
  misc_feature: GZ8MTXP01C2P98.51.38.D05.1.454.CMB.2.raw
  modified_base (262)..(262): a, c, t, g, unknown or other
  misc_feature (262)..(262): n is a, c, g, or t
  modified_base (325)..(325): a, c, t, g, unknown or other
  misc_feature (325)..(325): n is a, c, g, or t
tcagcgatcgtatacacgaccggtgctcgatttagtatctgatagttgggtttgggggaggcgtggtccagcctgggaggtccctgagactcgcctgtaaaccgtccggattcaccttcagtaactatgcaatgcactgggtccgccaggctccagggcaaggggctggactgggtggcaggcatatcatttgatggaagcaagaagtactatgcagactcgtgaaggccattcacatctacagagacagttccatcgacanactcatctacacagtgagctagtgtagacgacctgaccgtacgacggtctttcttttttacgngtcgaccgtacgaggacgcagtacgactcggaccactaactcgtaattcgttacttttagaatactcgtaggaacgtaccgaaagggactaagtcggtactacgttaccgttcgttccgttcccgggtaccccttaccccgtaacccgggaacgggtacccccgttaacgggtttacccccggggttttacccccttcccccggtacgggttacccccctacccccggttccccttaaacccggaaaccgacccgtttaccccggaacccgtttcccggggtaccgggggaaccccaacccgggttaccggttccccgggggcccggttcccgggggtccttccccggggttacccggtttacccggggtaaaccgtaaaccggggttaaccctttaaccccgggtttcccgttaacccgggtttccggaaccctttaacccgggg

SEQ ID NO: 309688 - DNA, 685 bp, Homo sapiens
  misc_feature: GZ8MTXP01ENKAI.51.38.D05.1.454.CMB.2.raw
  modified_base (236)..(236): a, c, t, g, unknown or other
  misc_feature (236)..(236): n is a, c, g, or t
  modified_base (246)..(246): a, c, t, g, unknown or other
  misc_feature (246)..(246): n is a, c, g, or t
  modified_base (312)..(312): a, c, t, g, unknown or other
  misc_feature (312)..(312): n is a, c, g, or t
tcagcgatcgtatacacgaccggtgctcgatttagtatctgatagttgggtttgggggctggggtctcaggaggcagcgctctcgggacgtctccaccatggcctgggctctgctattcctcaccctcctcactcagggcacagggtcctgggcccagtctgccctgactcagcctgcctcgtgtctggtctcctggacagtcatcaccatctcctgcacgtgggaccagcggtanactattggtntttaataactatgtctcctggaccagccaccacccaggaccaaacgcccccaaatcatgtatttangatgtcagtgactccggcccttaggtaggggtttcaacgtccggtctttcgtacgtcggtacctacccgaacggtcccgggacaaacccgcccgggtccccttaccccgtacggaaccctattcccgtcgttaccggcccctaccgaggggaccccggaagggaaccggaccgggaaggttactttaagtttaaccgtcgaccgtaacgtacttaactaattaaacgtaaactaaacttaaacgttaaaacgttaacgttagggtttcggggttacggtacgggaacggaaaccggttaaccgaacgttcggtaccgtacgttacgccaccgaacccgacgtcccgtcccgcccgttcgtccttccgttcccg

SEQ ID NO: 309689 - DNA, 616 bp, Homo sapiens
  misc_feature: GZ8MTXP01ANSJO.51.38.D05.1.454.CMB.2.raw
  modified_base (185)..(185): a, c, t, g, unknown or other
  misc_feature (185)..(185): n is a, c, g, or t
  modified_base (237)..(237): a, c, t, g, unknown or other
  misc_feature (237)..(237): n is a, c, g, or t
  modified_base (252)..(252): a, c, t, g, unknown or other
  misc_feature (252)..(252): n is a, c, g, or t
  modified_base (301)..(301): a, c, t, g, unknown or other
  misc_feature (301)..(301): n is a, c, g, or t
  modified_base (303)..(303): a, c, t, g, unknown or other
  misc_feature (303)..(303): n is a, c, g, or t
tcagcgatcgtatacacgaccggtgctcgatttagtatctgatagttgggtttgggggctggggtctcaggaggcagcgctctcgggacgtctccaccatggcctgggctctgctattcctcaccctcctcactcagggcacagggtcctgggcccagtctgccctgactcagcctgcctccgtntctgggtctcctggacagtcgatcaccatctcctgcactgggaccagcggtnactattggtatttanactatcgtctctggacagcaccaccaggcaacgccccaatcatgatttntnatgtcagtgactcggccctgaggggtttcaactcgtcttcgtctcggacctccgaagtcccgacaaacgcccggtcccttcctagacccatttccgcttcggccccttacgacgggcccgaagggaacgcggtacttagtaattacgttacgtcgggactaacgtcctactaataactaaccaaatacctaaataaaccgtaagtttcgggtcgggttaacggcggttaacggtaaccaaacgttcggtacccgttcgttacggttaccaacggtaccctaaggcctcccgttacccccgtggttaacctccg

SEQ ID NO: 309690 - DNA, 686 bp, Homo sapiens
  misc_feature: GZ8MTXP01EQCDN.51.38.D05.1.454.CMB.2.raw
  modified_base (236)..(236): a, c, t, g, unknown or other
  misc_feature (236)..(236): n is a, c, g, or t
  modified_base (246)..(246): a, c, t, g, unknown or other
  misc_feature (246)..(246): n is a, c, g, or t
  modified_base (302)..(302): a, c, t, g, unknown or other
  misc_feature (302)..(302): n is a, c, g, or t
tcagcgatcgtatacacgaccggtgctcgatttagtatctgatagttgggtttgggggctggggtctcaggaggcagcgctctcgggacgtctccaccatggcctgggctctgctattcctcaccctcctcactcagggcacagggtcctgggcccagtctgccctgactcagcctgcctcgtgtctgggtctcctggacagtcgatcaccatctcctgcactgggaccagcggtnactattggtnttaataactatgtctctgaccagcaccaccaggcaaacgccccaatcatgatttangatgtcagtcgacgtccggtcctacgtacggggttacaacgtccgtcttcgtcgtcggtaacctaacgaacggtcccgggacaaaccgacccgggtcccttaccccgagtaccctattcccgttcgtccgggcccttaccggaacgggtacccggaagggtaccggaacgggtccttagtaactttaacgttacgttcgggaccagtacctactaactaaactactaaactaacctaaaacttaaacgtaacggtttggggttacggttaacgggacggggttaaacgggaaacccaaacggtcgtaacccggttacgttcgggttaccgaacggtaccccgtaaacggtcccgttcccgaccccgttcggttcccgtaacccg

SEQ ID NO: 309691 - DNA, 617 bp, Homo sapiens
  misc_feature: GZ8MTXP01A5303.51.38.D05.1.454.CMB.2.raw
  modified_base (235)..(235): a, c, t, g, unknown or other
  misc_feature (235)..(235): n is a, c, g, or t
  modified_base (252)..(252): a, c, t, g, unknown or other
  misc_feature (252)..(252): n is a, c, g, or t
  modified_base (468)..(468): a, c, t, g, unknown or other
  misc_feature (468)..(468): n is a, c, g, or t
tcagcgatcgtatacacgaccggtgctcgatttagtatctgatagttgggtttggggggggtctcaggaggcagcgctctcgggacgtctccaccatggcctgggctctgctattcctcaccctcctcactcagggcacagggtcctgggcccagtctgccctgactcagcctgcctcgtgtctgggtctcctggacagtcgatcaccatctcctgcacgtgggaccaggcggtnactagttggtatttaanaactatgtctcctggtaccagcaccaccaggacaaacgccccaaatcatgtatttatgatgtacagtgacgtccggcctcgtagggtttcgaatcgtccttctcgtggtcctaccgaaaacggtcccggcaaaccgacccgggtccctccccgtcgacctatcccgtctcggtccctacgacgggccgaagggacgaggtctagtattattaccgngcacgtctactataactaactaactaactaaataacgtaggttggggtacggtacgggaacgggaacggtaaccttaacgtcggttaccgtacgtacgacgaccgaccgaacgtccgtccgtcccgtcggttacctccgttccgtcccg

SEQ ID NO: 309692 - DNA, 631 bp, Homo sapiens
  misc_feature: GZ8MTXP01DAHG6.51.38.D05.1.454.CMB.2.raw
  modified_base (234)..(234): a, c, t, g, unknown or other
  misc_feature (234)..(234): n is a, c, g, or t
  modified_base (301)..(301): a, c, t, g, unknown or other
  misc_feature (301)..(301): n is a, c, g, or t
tcagcgatcgtatacacgaccggtgctcgatttagtatctgatagttgggtttggggtggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcatcaccatctcctgcactgggaccagcggtnactattggtattaataactatgtctctgtacagcaccaccagcaaacgaccccaatcatgtatttangtatgtcagtgactcggcctcgtaggggtttcaatccgtctctctggtcctaaccgaagtcccggacaaaccgaccggccctccctacgacctactcctcgtacggtccctaccgacgggacccgaacgggacgagggtcctagtaacttagttacccgtgacgtacgtactactaataactaaactaaactaacgtaaattaacgttaggtttacggggtcgttaacgggaacgggaacggttaaaccgtaaacgttcgtaacccgtcgttaacggcgaccggaacccgtacgtcccgtcccgtaccccgttcgtcccttccgttcccg

SEQ ID NO: 309693 - DNA, 579 bp, Homo sapiens
  misc_feature: GZ8MTXP01CRCTE.51.38.D05.1.454.CMB.2.raw
  modified_base (235)..(235): a, c, t, g, unknown or other
  misc_feature (235)..(235): n is a, c, g, or t
  modified_base (297)..(297): a, c, t, g, unknown or other
  misc_feature (297)..(297): n is a, c, g, or t
  modified_base (308)..(308): a, c, t, g, unknown or other
  misc_feature (308)..(308): n is a, c, g, or t
  modified_base (392)..(392): a, c, t, g, unknown or other
  misc_feature (392)..(392): n is a, c, g, or t
  modified_base (398)..(398): a, c, t, g, unknown or other
  misc_feature (398)..(398): n is a, c, g, or t
  modified_base (424)..(424): a, c, t, g, unknown or other
  misc_feature (424)..(424): n is a, c, g, or t
  modified_base (433)..(433): a, c, t, g, unknown or other
  misc_feature (433)..(433): n is a, c, g, or t
  modified_base (448)..(448): a, c, t, g, unknown or other
  misc_feature (448)..(448): n is a, c, g, or t
tcagcgatcgtatacacgaccggtgctcgatttagtatctgatagttgggtttgggggctggggtctcaggaggcagcgctctcgggacgtctccaccatggcctgggctctgctattcctcaccctcctcactcagggcacagggtcctgggcccagtctgccctgactcagcctgcctcgtgtctgggtctcctggacagtcgatcacatctctgcacgtgggaccagcggtnactgttggttatttaatactatgtctctggaccagccaccaccaggaccaaaccgccccaancatgtatttangatgtacagtcgacgtccggccgttaggtacgggttcaccgtcgtcttctcgcgtcctacgaacgtccgacaccgcgccctccngacctntctcgcgcctcgacggcgaggcgagntagtaattnttacggcgatcctanatataacagtaactaataacggtaggttcgggtcggtcggggaacggaaacggaccttaaacggtacgtacccggttacgttcgacgaaccggcgaaccgtccgtcccggttccctcggttaaccttcccg

SEQ ID NO: 309694 - DNA, 737 bp, Homo sapiens
  misc_feature: GZ8MTXP01E5FW4.51.38.D05.1.454.CMB.2.raw
  modified_base (261)..(261): a, c, t, g, unknown or other
  misc_feature (261)..(261): n is a, c, g, or t
  modified_base (316)..(316): a, c, t, g, unknown or other
  misc_feature (316)..(316): n is a, c, g, or t
tcagcgatcgtatacacgaccggtgctcgatttagtatctgatagttggggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatccaccatctcctgcacgtgggaccaggcggtgactagtttggtatttaataactntgtctctggtaccagccaccaccgaggaccaaacgcccccaaatcatgtatttangatgtacagtcgtacgtcccggtccgttaggtagggtttactagttcgtcccctttctcgtacggtaccctaccggtaaaaccggtcccggaaccaaacccggtcccgtccctacccgtacaacccttctcccgttcgtacccggtcccctacgggaaccggggaccggaaggggtaaccggagttaccgttagttaactttaacgttacgcgacctagtaccttaactaaattaacctaaaacaaattaaccgaaaattaaacggttaagggtttgggggtacggttaccggggaacgggtaaacccgggtaaaccttaacggtcccgttaaccggttaccgtaaggacccgaaccggacccggtaaggcccccgtccccggtccccggtacgttacctaacccgtttccgttccccccg

SEQ ID NO: 309695 - DNA, 607 bp, Homo sapiens
  misc_feature: GZ8MTXP01DQKM0.51.38.D05.1.454.CMB.2.raw
  modified_base (246)..(246): a, c, t, g, unknown or other
  misc_feature (246)..(246): n is a, c, g, or t
  modified_base (252)..(252): a, c, t, g, unknown or other
  misc_feature (252)..(252): n is a, c, g, or t
  modified_base (309)..(309): a, c, t, g, unknown or other
  misc_feature (309)..(309): n is a, c, g, or t
  modified_base (396)..(396): a, c, t, g, unknown or other
  misc_feature (396)..(396): n is a, c, g, or t
tcagcgatcgtatacacgaccggtgctcgatttagtatctgatagttgggtttgggggctggggtctcaggaggcagcgctctcgggacgtctccaccatggcctgggctctgctattcctcaccctcctcactcagggcacagggtcctgggcccagtctgccctgactcagcctgcctccgtgtctggtctcctggacagtcatcacatctctgcacgtgggaccagcggtgactagtttggtntttaanaactatgtctctggaccagccaccaccgagacaaaccgccccaaatcatgtatttangatgtcagtgatccggcctgagggttcaactccgtcttctcgtgacctaccgaaggtccgacaacgaccgccctcctagacccatcncgtcgcctcgaggaccgagacgagctagaatttactctggactagctacaaattacaactaagtacaaattaacgtaggtttgggtcgttaacgggacggttaaagggtaaaccccaaagttccggtaacccgttacggttacggaaccgaaccggaccccgtaacgggtccctaccccggttcccccgttaacggttaacccttccccgg

SEQ ID NO: 309696 - DNA, 657 bp, Homo sapiens
  misc_feature: GZ8MTXP01AKO7Y.51.38.D05.1.454.CMB.2.raw
tcagcgatcgtatacacgaccggtgctcgatttagtatctgatagttgggtttgggggaggcgtggtccagcctgggaggtccctgagactcgcctgtaaaccgtccggattcaccttcagtaactatgcaatgcactgggtccgccaggctccaggcaaggggctggactggggtggcaggcatatcatttgatggaagcaagaagtactatgcagactcgtgaaggcatcaccatctccagagacagttccgatcgacacatctatctaacacatgagcagtgtagagacctagaccgacgtacgtcttttctttttacgtcgtcgtaccgaccgaaggaacgcgtaggttcggcgtggacccaactaattctaagttcgttcttttgtatacgtacgtgggaacgaccgaaaggggactaacgttggttacagtttccgtccttacccgttccggacccttacccgaaccggacggtccccacggttcccggttccccgtttccccacggcccctacccctcccgtaaccgaacgtaccgccctaccgtccgggtcgggggaaccacgttccgggcccgttccggtcgggtcccgttcgttcccgttacgggtaacacggtaaccttaccgttcccgttcgtaacgcttaaccg

SEQ ID NO: 309697 - DNA, 698 bp, Homo sapiens
  misc_feature: GZ8MTXP01EB6I3.51.38.D05.1.454.CMB.2.raw
  modified_base (234)..(234): a, c, t, g, unknown or other
  misc_feature (234)..(234): n is a, c, g, or t
  modified_base (244)..(244): a, c, t, g, unknown or other
  misc_feature (244)..(244): n is a, c, g, or t
tcagcgatcgtatacacgaccggtgctcgatttagtatctgatagttgggtttgggggctggggtctcaggaggcagcgctctcgggacgtctccaccatggcctgggctctgctattcctcaccctcctcactcagggcacagggtcctgggcccagtctgccctgactcagcctgcctccgtgtctggtctcgtggacagtcatcaccatctctgcactgggaccagcggtnacagttggtntttaataactatgtctcctggtaccagccaccacccaggaccaaaccgcccccaaatcatgtatttatgatgtcagtgactccggtccctggtaggggtttcaactcgtcttcgtcgtcggtaccctaccgaacggtcccgggacctaaacccgacccgggtccctaccccgtcgaaccctatcctcgtcggccccttaccgacgggaccccggaggacgagggtaccttagtaactttaacttaccgtggggaccctacggtaccttaccgtaaataacgttaaaccctaaagtaaaccctaaaattaaaccgttaaggtttggggttacgggttaaccggggacggggttaaacgggtaaacccttaaaacgttcggtaaccccgttaccgttaggacccgaaccggacccgtaacggtccgtccccgaccccgttcggttaacccttcccg

SEQ ID NO: 309698 - DNA, 662 bp, Homo sapiens
  misc_feature: GZ8MTXP01A70EE.51.38.D05.1.454.CMB.2.raw
  modified_base (225)..(225): a, c, t, g, unknown or other
  misc_feature (225)..(225): n is a, c, g, or t
  modified_base (290)..(290): a, c, t, g, unknown or other
  misc_feature (290)..(290): n is a, c, g, or t
  modified_base (391)..(391): a, c, t, g, unknown or other
  misc_feature (391)..(391): n is a, c, g, or t
  modified_base (443)..(443): a, c, t, g, unknown or other
  misc_feature (443)..(443): n is a, c, g, or t
  modified_base (447)..(447): a, c, t, g, unknown or other
  misc_feature (447)..(447): n is a, c, g, or t
  modified_base (452)..(452): a, c, t, g, unknown or other
  misc_feature (452)..(452): n is a, c, g, or t
  modified_base (648)..(648): a, c, t, g, unknown or other
  misc_feature (648)..(648): n is a, c, g, or t
tcagcgatcgtatacacgaccggtgctcgatttagtatctgatagttgggtttgggggctttgcctgggctctgctattcctcaccctcctcactcagggcacagggtcctgggcccagtctgccctgactcagcctgcctccgtgtctgggtctcctggacagtcgatcacatctcctgcacgtgggaccaggcggtgactagtttggttattttaataacttnttcgtcctccgtggtaccagccaaccaacccgaggaccaaaccgcccccaaatcatagtatttangatgtcagtgacgtccggccttaggtacggggtttacattccgtctttcgtcgtcgctaccgaacggtcccggacaaccgccggcctcccgagaccccctntctcgtccgaccctacgacgggccggagacgacgtctagtaatttactacgnacanactanaattaagtaaacctaaagttaactaaaacgttaacgtaagggtttcggggttacggtaccgggacgggggaaacggtaaacctaaacgtcccggtaaccgtcggtaacgccgaaccggccgtacggcccttccccgcccgttcgtacttaccgttccttacccgtccccaccgttcttcgctaacgcctcgtcggnggacgtcggttgcg

SEQ ID NO: 309699 - DNA, 637 bp, Homo sapiens
  misc_feature: GZ8MTXP01CCJXS.51.38.D05.1.454.CMB.2.raw
tcagcgatcgtatacacgaccggtgctcgatttagtatctgatagttgggtttgggggaggcgtggtccagcctgggaggtccctgagactcgcctgtaaaccgtccggattcaccttcagtaactatgcaatgcactgggtccgccaggctccaggcaaggggctggactgggtggcaggcatatcatttgatggaagcaagaagtactatgcagactccgtgaaggccatcacatctcagagacagttccgatgacacagtctatctacacatgagcagtgtgacgactgacgacacgtctttctttttactgtcgcgcaggagcgagtcggctcggccactactctaactgttccttttagaattacgtcgtacggggaacgtaccgaaaggggtaacctaaaggttcgggttacagtttccgttcttaccgtttccggcccttacccgaccgtaacggggcccctacggggtttccccggtaccctttcccccgtacggtcccctaccccttccccaccgtaaacgccgtcccgtacccgtcggtcgggggccaacgcggtcccggccggtcgggcttcggccgttacggtaaccgtacgggtaaccttaccttccgttcgtaacgctaaccg

SEQ ID NO: 309700 - DNA, 635 bp, Homo sapiens
  misc_feature: GZ8MTXP01CLTZF.51.38.D05.1.454.CMB.2.raw
  modified_base (207)..(207): a, c, t, g, unknown or other
  misc_feature (207)..(207): n is a, c, g, or t
  modified_base (270)..(270): a, c, t, g, unknown or other
  misc_feature (270)..(270): n is a, c, g, or t
  modified_base (395)..(395): a, c, t, g, unknown or other
  misc_feature (395)..(395): n is a, c, g, or t
tcagcgatcgtatacacgaccggtgctcgatttagtatctgatagttgggtttgggggctttgcctgggctctgctattcctcaccctcctcactcagggcacagggtcctgggcccagtctgccctgactcagcctgcctccgtgtctgggtctcctggacagtcgatcaccatctcctgcactgggaccagcggtgacattggtntttaataactatgtctcctggtaccagcaccacccaggcaaacgcccccaaatcatgtattangatgtcagtgactcggccctgtaggggtttcaatcggcttctctggcctccgaacgtccggactaaccgaccggtccctcccgtgacccccatcctcgtcgccctaaccgaggccgagggtacgnggctgatttactactgcagtctacataataactaaattacaaattaacgtaagttcggggttacggttccgggaacgggggtaacgggtaacccaaaacgttccggaacccggttacctagggtaccacggacccgtaacggccttacccgccccgttaacggtccacgttccttccgtttacccccctccttccgttcgttaccgaactcctaacgtcgacggcggtcgggttcgtcgg

SEQ ID NO: 309701 - DNA, 656 bp, Homo sapiens
  misc_feature: GZ8MTXP01APPAG.51.38.D05.1.454.CMB.2.raw
  modified_base (237)..(237): a, c, t, g, unknown or other
  misc_feature (237)..(237): n is a, c, g, or t
  modified_base (247)..(247): a, c, t, g, unknown or other
  misc_feature (247)..(247): n is a, c, g, or t
  modified_base (307)..(307): a, c, t, g, unknown or other
  misc_feature (307)..(307): n is a, c, g, or t
  modified_base (468)..(468): a, c, t, g, unknown or other
  misc_feature (468)..(468): n is a, c, g, or t
tcagcgatcgtatacacgaccggtgctcgatttagtatctgatagttgggtttgggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactgggaccagcggtnactattggtntttataactatgtctctggtaccagcaccacccaggcaaagcccccaaatcatgatttangatgtcagtgatcggccctgaggggtttcgaactcggtacttctcgtggtacctaccgaagtcccgggacaaccgtaccggccctccctagaccctatccgtctcgggcctaccgacggaccggagggacgacgggtactaggtaactttagtttaaccgnggtcgtacgtacctaactaaactaactaaacgtaaactaaacgtaaacttaaacggttaaggtttggggtacgggttaaccggggaacgggttaaccggaaaccgttaaacgtcccgtaacccgttaccgttacggttacccgaacgacccgtaacggtcccgtcccggttccccgtcgttccgtccg

SEQ ID NO: 309702 - DNA, 637 bp, Homo sapiens
  misc_feature: GZ8MTXP01CC1MK.51.38.D05.1.454.CMB.2.raw
tcagcgatcgtatacacgaccggtgctcgatttagtatctgatagttgggtttgggggaggcgtggtccagcctgggaggtccctgagactcgcctgtaaaccgtccggattcaccttcagtaactatgcaatgcactgggtccgccaggctccaggcaaggggctggactgggtgcaggcatatcatttgatggaagcaagaagtactatgcagactccgtgaaggccgatcaccatctccagagacacgttccgatgacacagtctatctacacatgagcagtgagacgtacctagacgacacggtctttacttttttactggtcgtccgtacgaggaagcgtacggtggaccgtgggacccacgaactacgtaagtgttacttttgattacgttcgtagggaccgacgaaacgggactaagtggtactacgttacgttccttccgttcggacccttaccgaaccgacggacccctacgggtcccgtttcccgttccccgtcgtaccctaccccgttccaccgtaaacgcgtaccctaccgttccgggcgggggaacccacgttcccggccggttcccggcggtccgttcgcccgttgggaacacggtaaccttacttccgaggtaacgcgtccg

SEQ ID NO: 309703 - DNA, 568 bp, Homo sapiens
  misc_feature: GZ8MTXP01BSB5B.51.38.D05.1.454.CMB.2.raw
  modified_base (267)..(267): a, c, t, g, unknown or other
  misc_feature (267)..(267): n is a, c, g, or t
  modified_base (318)..(318): a, c, t, g, unknown or other
  misc_feature (318)..(318): n is a, c, g, or t
  modified_base (334)..(334): a, c, t, g, unknown or other
  misc_feature (334)..(334): n is a, c, g, or t
  modified_base (338)..(338): a, c, t, g, unknown or other
  misc_feature (338)..(338): n is a, c, g, or t
  modified_base (341)..(341): a, c, t, g, unknown or other
  misc_feature (341)..(341): n is a, c, g, or t
  modified_base (346)..(346): a, c, t, g, unknown or other
  misc_feature (346)..(346): n is a, c, g, or t
  modified_base (350)..(350): a, c, t, g, unknown or other
  misc_feature (350)..(350): n is a, c, g, or t
  modified_base (360)..(360): a, c, t, g, unknown or other
  misc_feature (360)..(360): n is a, c, g, or t
tcagcgatcgtatacacgaccggtgctcgatttagtatctgatagttgggtttgggggaggcgtggtccagcctgggaggtccctgagactcgcctgtaaaccgtccggattcaccttcagtaactatgcaatgcactgggtccgccaggctccaggcaaggggctggactgggtggcaggcatatcatttgatggaagcaagaagtactatgcagactccgtgaaggccattcaccatctccagagacagttccgatgacacagtnatctacacatgagcagtgtgagacctgacgacaacggcttcttttttaacngtgcgccagggaaacnacgngcngacanaatngtgtctttanatatcgtaggacacgaaaggacaagtcgtactacgtcgtcttcgtccgtacctaccgaaccgaacggtacccgtacgtcgttcccgttccccgtccgccctaccctccctaccgaacgacgtcctaccgtccgtcgggcgacgacggccggccgtcggtcgttcgcgttcgtaacgaacgtaactacttccgttcgtaacgcgtaacg

SEQ ID NO: 309704 - DNA, 746 bp, Homo sapiens
  misc_feature: GZ8MTXP01A1BCX.51.38.D05.1.454.CMB.2.raw
  modified_base (744)..(744): a, c, t, g, unknown or other
  misc_feature (744)..(744): n is a, c, g, or t
tcagcgatcgtatacacgaccggtgctcgatttagtatctgatagttgggtttgggggctttgcctgggctctgctattcctcaccctcctcactcagggcacagggtcctgggcccagtctgccctgactcagcctgcctccgtgtctgggtctcctggacagtcgatcaccatctcctgcacgtgggaccaggcggtgactagtttggtagtttaataactatcgttctccgtaggtaccagccaaccgacccaaggacccaaaccgaccccctaaatcatagtatttatgatgtcagtgacgtccggacctcggtaggggtttacaacgttcgtcttcgtcgtacggtcctaccgaacggtcccggaccaaaccgtcccgggtcccctaccccgtacgtaacccccctactccgtaccgttccgggaccccgttaacccgggaaccgggtccgggaaacgggggaccggtacggggtcttagggttaactttacgttaacgtggtacacggtctaacgtaaccttaagtaaactaaactaacggtaaaacttaaacgtaggttacgggtacgggttaccgggaacggggggacggtaaacctaaaccgtccgggtaccggtaccgtacggacggaacgacccgtacggtcctcccggccctaacggtccttaccggtccttccgttcctaccccgttcttccgttacggcctgtaacctggacgcgggtcggttaaccggngg

SEQ ID NO: 309705 - DNA, 705 bp, Homo sapiens
  misc_feature: GZ8MTXP01A3MT6.51.38.D05.1.454.CMB.2.raw
  modified_base (251)..(251): a, c, t, g, unknown or other
  misc_feature (251)..(251): n is a, c, g, or t
  modified_base (319)..(319): a, c, t, g, unknown or other
  misc_feature (319)..(319): n is a, c, g, or t
tcagcgatcgtatacacgaccggtgctcgatttagtatctgatagttggggtttgggggggggtctcaggaggcagcgctctcgggacgtctccaccatggcctgggctctgctattcctcaccctcctcactcagggcacgagggtcctgggcccagtctcgccctgactcagcctgcctcgtgtctgggtctcctggacagtcgatcaccatctcctgcacgtcggaccaggcggtgactagttggttntttaataactatgtctcgtcgtaccagccaccaccgaggaccaaacgacccccaatcatagtatttangatgtacagtgactccggccgttggtaggggtttacacgtccgtctttccgtcgtcggcctaccgaaacggtccgaacctaaaccgtcccgggtaccctccccgtagaaccctcgttcctccggttccgacccgtccggacgggaccggagggaccggacgtcttacgtactttaacgtctggacctaggggtcttaactaataactaaactaacttaacaaacttaaccggtagttccgggggttacgttacggggaaaccggtaacggggtaaacccttaaacggttaccggaccgtaccgttaaccggggaccaaccggttaccccgtaacggtccccgtaacccgtccccgtcggttacctcccgttccgtttaaccccccg

SEQ ID NO: 309706 - DNA, 710 bp, Homo sapiens
  misc_feature: GZ8MTXP01BI73Q.51.38.D05.1.454.CMB.2.raw
  modified_base (234)..(234): a, c, t, g, unknown or other
  misc_feature (234)..(234): n is a, c, g, or t
  modified_base (238)..(238): a, c, t, g, unknown or other
  misc_feature (238)..(238): n is a, c, g, or t
  modified_base (253)..(253): a, c, t, g, unknown or other
  misc_feature (253)..(253): n is a, c, g, or t
  modified_base (303)..(303): a, c, t, g, unknown or other
  misc_feature (303)..(303): n is a, c, g, or t
  modified_base (336)..(336): a, c, t, g, unknown or other
  misc_feature (336)..(336): n is a, c, g, or t
tcagcgatcgtatacacgaccggtgctcgatttagtatctgatagttgggtttggggggggtctcaggaggcagcgctctcgggacgtctccaccatggcctgggctctgctattcctcaccctcctcactcagggcacagggtcctgggcccagtctgccctgactcagcctgcctcgtgtctgggtctcctggacagtcgatcaccatctcctgcacgtgggaccaggcgtnactnttggtattataactntgtctctgacagcaccaccaggaccaacgcccccaaatcatcgtatttangatgtacagtgactccggtccgtgtacgggttnacgtcgtccttcgtctgtcctaccgaaacgtcccggaacaaccgaccggtccctccctacgtacccacttccctcgtccgggtaccctcccggacggggaccggaaggggaccggtacggtaccttacggtaactttacgtaccgtacggtacctaacggggtctaaaccttaattaacgtaaacctaagttaaacctaaaacgtttaacgttaaacggtttgggggttaccgggttccgggaacgggtaaccggtaaaccggttaaaacccgtcgggttaacccgtacccgttaacgggttccgaccggttcccgaacggtcccgtcccggtacccccgttcgggttaccctaacccgtttcccgttcccccg

SEQ ID NO: 309707 - DNA, 663 bp, Homo sapiens
  misc_feature: GZ8MTXP01ES5C3.51.38.D05.1.454.CMB.2.raw
  modified_base (245)..(245): a, c, t, g, unknown or other
  misc_feature (245)..(245): n is a, c, g, or t
  modified_base (272)..(272): a, c, t, g, unknown or other
  misc_feature (272)..(272): n is a, c, g, or t
tcagcgatcgtatacacgaccggtgctcgatttagtatctgatagttgggtttgggggctggggtctcaggaggcagcgctctcgggacgtctccaccatggcctgggctctgctattcctcaccctcctcactcagggcacgagggtcctgggcccagtctgccctgactcagcctgcctcgtgtctgggtctcgtggactagtcgatccaccatcctcctgcctacgtcggaccaggcggtanactgttagggttatttaaactaacttntcgtccgtccgtacggaccacgcccaaccaaccgaggaccaaacccgtcccccaaatcaagttcgtaatttagagtaagttcgtacgtaagtcgtaccggtccggtacccgttaggtaggggttacaccttcgtctctacgcggtaaccctacgaacggtccgaacgaacccgtacccggtccctaccgtacaacctcttccgccgtccggacctccggacgggtacggacgtacgagcttagtaatttaactcgagactacgtactaacaattaacaactaagtaataacgttagtagggttcggtacggtaacggtaacgggaactacgttacgtcgtaacgttcgaccgacgtccgacgtaacgtccctccgttaccgtcgccgtaac

SEQ ID NO: 309708 - DNA, 650 bp, Homo sapiens
  misc_feature: GZ8MTXP01E28K3.51.38.D05.1.454.CMB.2.raw
  modified_base (517)..(517): a, c, t, g, unknown or other
  misc_feature (517)..(517): n is a, c, g, or t
  modified_base (629)..(629): a, c, t, g, unknown or other
  misc_feature (629)..(629): n is a, c, g, or t
tcagcgatcgtatacacgaccggtgctcgatttagtatctgatagttgggtttgggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcacgtgggaccagcggtgactagtttggtatttataactatgtctcctggaccagccaccacccgaggaccaaacccgaccccctaaatcaattgtaatttatgatgtacagtcgacgtccggaccctaggtagggttcaactcgtcttctacgtcggtaactacccgaacggtccccggacaaacccgtacccggtccctaccccgagaaccctatccgtccgtcggacccgtaccgacggggccggaagggtaaccgacggtatagttaacttactacgcggtcaactaccttanaaactaactaaacgaactaacaaataaccggtagtttcgggggtacgtaacgggacggaaacggaaccttaaacgccgtaccgttacgccggttcaacgccgtaacgtcccncccgacccttcgaacctcccg

SEQ ID NO: 309709 - DNA, 688 bp, Homo sapiens
  misc_feature: GZ8MTXP01EWF1V.51.38.D05.1.454.CMB.2.raw
  modified_base (329)..(329): a, c, t, g, unknown or other
  misc_feature (329)..(329): n is a, c, g, or t
  modified_base (506)..(506): a, c, t, g, unknown or other
  misc_feature (506)..(506): n is a, c, g, or t
tcagcgatcgtatacacgaccggtgctcgatttagtatctgatagttgggtttgggggctggggtctcaggaggcagcgctctcgggacgtctccaccatggcctgggctctgctattcctcaccctcctcactcagggcacagggtcctgggcccagtctgccctgactcagcctgcctcgtgtctgggtctccgtggacagtcatcacatctcctgcacgtgggaccaggcggtgactagtttgggttatttaataacttagtcgtctccgtaggtacccagaccaccacccgaggaccaaaccgacccccaaatcatagtatttangtatgtacagtgacgtcgcctaggtaggggttcacttcgtcttgtacgtcggtaccacgaacggtccgaccgtaaaccgacccggtcccctaccacgacctacgtctccggacgcctacgacgggaccggaacgggacggaggtacttgttaaatttacgtacgtacgggtactacnccttaaataacttaaactaactaaaccgtaaataaacgttaaacgtaaggttttgggggtaccggttaacggggaacggttaacgggtaaacccaaacggtcccggtaaccgttaccggttagacccgaaccggacccgtaacggtccctcccgggttccccgttcggttaaccccttcccg

SEQ ID NO: 309710 - DNA, 509 bp, Homo sapiens
  misc_feature: GZ8MTXP02JUWUL.51.38.D05.1.454.CMB.2.raw
  modified_base (316)..(316): a, c, t, g, unknown or other
  misc_feature (316)..(316): n is a, c, g, or t
  modified_base (444)..(444): a, c, t, g, unknown or other
  misc_feature (444)..(444): n is a, c, g, or t
  modified_base (461)..(461): a, c, t, g, unknown or other
  misc_feature (461)..(461): n is a, c, g, or t
  modified_base (499)..(499): a, c, t, g, unknown or other
  misc_feature (499)..(499): n is a, c, g, or t
  modified_base (506)..(506): a, c, t, g, unknown or other
  misc_feature (506)..(506): n is a, c, g, or t
tcagcgatcgtatacacgaccggtgctcgatttagtatctgatagttgggtttggggaggcgtggtccagcctgggaggtccctgagactcgcctgtaaaccgtccggattcaccttcagtaactatgcaatgcactgggtccgccaggctccaggcaaggggctggactgggtggcaggcatatcatttgatggaagcaagaagtactatgcagactccgtgaagggccgattcaccatctccagagacagttccgatgacacagtctatctacacatgagcagtgtgagacctgacgacacggctctttttacngtgcgccaggaagcagtgctggccacatcatgcttttgattatctggacgccaaagggacaatggtcatcgtctcttcggcctccaccaagggcccatcggtctccccctggccaccctctccaagcncacctcgtggggccacngcggccctgggcctgccctggtcaaggtctacgttccncggtacnctc

SEQ ID NO: 309711 - DNA, 527 bp, Homo sapiens
  misc_feature: GZ8MTXP02H11W2.51.38.D05.1.454.CMB.2.raw
  modified_base (348)..(348): a, c, t, g, unknown or other
  misc_feature (348)..(348): n is a, c, g, or t
  modified_base (352)..(352): a, c, t, g, unknown or other
  misc_feature (352)..(352): n is a, c, g, or t
tcagcgatcgtatacacgaccggtgctcgatttagtatctgatagttgggtttgggggaggcgtggtccagcctgggaggtccctgagactcgcctgtaaaccgtccggattcaccttcagtaactatgcaatgcactgggtccgccaggctccaggcaaggggctggactgggtggcaggcatatcatttgatggaagcaagaagtactatgcagactccgtgaagggccgattcaccatctccagagacagttccgatgacacagtctatctacacatgagcagtgtgagacctgacgacacggtcttcttttttactgttgcgccaggaagcagtggctggccanatcntgtcttttgatatctggagccaagggacaatggtcatcgtctcttcggcctcaccaggcccatcggtccttccccctggccacccctcctaccaagacgccacctcgtcgggggcacgacgccggcccgtcgggcctcgcctcggtcaacggtacctacttccgtcgtacgctac

SEQ ID NO: 309712 - DNA, 524 bp, Homo sapiens
  misc_feature: GZ8MTXP02I0VS3.51.38.D05.1.454.CMB.2.raw
  modified_base (307)..(307): a, c, t, g, unknown or other
  misc_feature (307)..(307): n is a, c, g, or t
  modified_base (369)..(369): a, c, t, g, unknown or other
  misc_feature (369)..(369): n is a, c, g, or t
  modified_base (434)..(434): a, c, t, g, unknown or other
  misc_feature (434)..(434): n is a, c, g, or t
tcagcgatcgtatacacgaccggtgctcgatttagtatctgatagttgggtttggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactgggaccagcggtgacattggtgtttataactatgtctcctggtaccagcaccacccaggcaaacgcccccaaatcatgatttangatgtcagtgatcggccctcgaggggtttcaactcgcttctctggcctcagtccggacaacncgcctcctgaccatctctcggccctcgaggcccgaggacgaggctgattatactgcagctcatanacaatcaaatacaagttgggtgttacggcggtagggaccaaacgtcgaccgtactaggtcaagcccaaggcctcgcccccgtgtctaccg

SEQ ID NO: 309713 - DNA, 535 bp, Homo sapiens
  misc_feature: GZ8MTXP02G9B8E.51.38.D05.1.454.CMB.2.raw
  modified_base (207)..(207): a, c, t, g, unknown or other
  misc_feature (207)..(207): n is a, c, g, or t
  modified_base (213)..(213): a, c, t, g, unknown or other
  misc_feature (213)..(213): n is a, c, g, or t
  modified_base (268)..(268): a, c, t, g, unknown or other
  misc_feature (268)..(268): n is a, c, g, or t
tcagcgatcgtatacacgaccggtgctcgatttagtatctgatagttgggtttggggctttgcctgggctctgctattcctcaccctcctcactcagggcacagggtcctgggcccagtctgccctgactcagcctgcctccgtgtctgggtctcctggacagtcgatcaccatctcctgcactgggaccagcggtgacatttggtntttaanaactatgtctcctggtaccagcaccaccaggcaaagcccccaaatcatgatttangatgtcagtgatcggcctgaggggtttcaatcgcttctctggctccaagtccggacaacacggcctcctgaccccatctctggccctcgaggccgaggacgaggctgatttatactgcagctcatatacaatcaaataacaagttgggtagttcggacggagggaccaaaacgtgaaccgtccgtaggtcaggcccaaggctcgccccctggtcactctacgttccccacctcctctacgtaacgctactcgtcgacgcgggctagg

SEQ ID NO: 309714 - DNA, 545 bp, Homo sapiens
  misc_feature: GZ8MTXP02GDFC1.51.38.D05.1.454.CMB.2.raw
tcagcgatcgtatacacgaccggtgctcgatttagtatctgatagttgggtttgggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactgggaccagcggtgacattggtgtttataactatgtctcctggtaccagcaccacccaggcaaacgcccccaaatcatgatttatgatgtcagtgatcggcctgaggggtttcaatcgcttctctgctcagtccgcaacacgcctcctgaccatctctcggccctccgagcccgaggacgaggctgattatactgcagctacataatacaatacaaataacaagtttggggtattcgggacggaaggggaacccaaaacgtcggaacccgtccgtaagggtacaacggacccaaagggcctcggccccctcggtcctacccg

SEQ ID NO: 309715 - DNA, 522 bp, Homo sapiens
  misc_feature: GZ8MTXP02GCVFP.51.38.D05.1.454.CMB.2.raw
  modified_base (240)..(240): a, c, t, g, unknown or other
  misc_feature (240)..(240): n is a, c, g, or t
  modified_base (302)..(302): a, c, t, g, unknown or other
  misc_feature (302)..(302): n is a, c, g, or t
  modified_base (341)..(341): a, c, t, g, unknown or other
  misc_feature (341)..(341): n is a, c, g, or t
tcagcgatcgtatacacgaccggtgctcgatttagtatctgatagttgggtttgggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactgggaccagcggtgacattggtntttataactatgtctcctggtaccagcaccacccaggcaaagcccccaaactcatgatttangatgtcagtgatcggcctcaggggtttcaatcgccttcnctgctcaagtccgcaacacggcctcctgaccatctctgccctcgaggccgagacgaggctgattatactgcagctcatatacaatcaaataacaagttgggtgttcgggacggaagggacccaaaagtcgaacccgtctacggtccacgacccaaggcctcgccccctggtccactctccg

SEQ ID NO: 309716 - DNA, 529 bp, Homo sapiens
  misc_feature: GZ8MTXP02HA6GO.51.38.D05.1.454.CMB.2.raw
  modified_base (306)..(306): a, c, t, g, unknown or other
  misc_feature (306)..(306): n is a, c, g, or t
  modified_base (380)..(380): a, c, t, g, unknown or other
  misc_feature (380)..(380): n is a, c, g, or t
  modified_base (398)..(398): a, c, t, g, unknown or other
  misc_feature (398)..(398): n is a, c, g, or t
  modified_base (511)..(511): a, c, t, g, unknown or other
  misc_feature (511)..(511): n is a, c, g, or t
tcagcgatcgtatacacgaccggtgctcgatttagtatctgatagttgggtttggggtggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactgggaccagcggtgactattggtatttataactatgtctcctggtaccagcaccacccaggcaaacgccccaaatcatgatttangatgtcagtgatcggcctcgtagggtttcgaatccgcttctctggctcaacgtccggacaacgaccggcctccngaccatctcgtcgtcccncgacggaccgacggacgaggctagatttatactgccagctacatatacaatcaaagtacaagttggtgttcggacggaggaccaaacgtcgaccgtctacggcagccgaagcncgccccgtcgctactccg

SEQ ID NO: 309717 - DNA, 514 bp, Homo sapiens
  misc_feature: GZ8MTXP02HHHXQ.51.38.D05.1.454.CMB.2.raw
  modified_base (306)..(306): a, c, t, g, unknown or other
  misc_feature (306)..(306): n is a, c, g, or t
  modified_base (362)..(362): a, c, t, g, unknown or other
  misc_feature (362)..(362): n is a, c, g, or t
  modified_base (449)..(449): a, c, t, g, unknown or other
  misc_feature (449)..(449): n is a, c, g, or t
tcagcgatcgtatacacgaccggtgctcgatttagtatctgatagttgggtttggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactgggaccagcggtgacattggtgtttataactatgtctcctggtaccagcaccacccaggcaaagcccccaaatcatgatttangatgtcagtgatcggccctgaggggtttcaatcgcttctctgctcagtccgcaacncgcctcctgaccatctctggccctccgaggccgaggacgaggctgatttatactgcagctcatatacaatcaaataacaattgggtnttcggcggagggaccaaacgtcgaccgtctaggtcaagcccaaggcctcgccccctggtctaccg

SEQ ID NO: 309718 - DNA, 611 bp, Homo sapiens
  misc_feature: GZ8MTXP02IW0LA.51.38.D05.1.454.CMB.2.raw
tcagcgatcgtatacacgaccggtgctcgatttagtatctgatagttgggtttgggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactgggaccagcggtgacattggtgtttataactatgtctctggtaccagcaccaccaggcaaacgcccccaaatcatgatttatgactgactagtagacgtccgtcctaggggtacgggttactaccgtcgtccttcgtcgtcgtccctaacgaccggtccgaaccaaccgcccgtccctccgacactctctcgcgtccacggacgacggacggacggcgtagtagtatttactcgcgactactacctataaactaactaaactaagtaactaaaacgttaacgttaaggggttcggttacggtacgggaacgggaacgtaaactaacgtccgtaccgtacgtacgaccgaaccgaccgacggtccctcccgtcccgtcgtacttcccg

SEQ ID NO: 309719 - DNA, 558 bp, Homo sapiens
  misc_feature: GZ8MTXP02HC2IS.51.38.D05.1.454.CMB.2.raw
  modified_base (268)..(268): a, c, t, g, unknown or other
  misc_feature (268)..(268): n is a, c, g, or t
tcagcgatcgtatacacgaccggtgctcgatttagtatctgatagttgggtttggggctttgcctgggctctgctattcctcaccctcctcactcagggcacagggtcctgggcccagtctgccctgactcagcctgcctccgtgtctgggtctcctggacagtcgatcaccatctcctgcactgggaccagcggtgacatttggtgtttaataactatgtctcctggtaccagcaccacccaggcaaacgccccaaatcatgattangatgtcagtgatcggccctcgaggggtttcaatcgcttctctggctccaagtccggacaacgacgcctcctgaccccatctctcgcctccgaggccgaggacgaggctgattattactgcagctcatataacaatacaaataaacaagttgggtagttcgggacggaacgggaaccaaacgtcggacccgtaccgtacggtacacgacccgaaggccgtcgcccccttcggtccacctctccgttccccacccttcctcctcgtaacgctactcgtagcgcgggtctcgg

SEQ ID NO: 309720 - DNA, 598 bp, Homo sapiens
  misc_feature: GZ8MTXP02HZXIC.51.38.D05.1.454.CMB.2.raw
  modified_base (241)..(241): a, c, t, g, unknown or other
  misc_feature (241)..(241): n is a, c, g, or t
  modified_base (246)..(246): a, c, t, g, unknown or other
  misc_feature (246)..(246): n is a, c, g, or t
  modified_base (302)..(302): a, c, t, g, unknown or other
  misc_feature (302)..(302): n is a, c, g, or t
  modified_base (456)..(456): a, c, t, g, unknown or other
  misc_feature (456)..(456): n is a, c, g, or t
tcagcgatcgtatacacgaccggtgctcgatttagtatctgatagttgggtttggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactgggaccagcggtgacattggtntttanaactatgtctcctggtaccagcaccaccaggcaaagcccccaaatcatgattttangatgtcagtgacgtccggcctcggtaggggtttacaatcgtccttctcgtgcctacgaacgtccgcaaaccgccggtccctcccgtagaccctattcctcgtcgccctaccgacgggaccgaaggacgagctagtaattactactgcagtctanaataactaacaaatactaaaattaacgtaaggtttggggtagtcgggacgggtaaacggaacctaaaacgtcgtaaccgtacgtacggtaccaacgacccgaaggtcctacccgcccccgtacgtacctaccgttccgtccg

SEQ ID NO: 309721 - DNA, 516 bp, Homo sapiens
  misc_feature: GZ8MTXP02GNNI3.51.38.D05.1.454.CMB.2.raw
  modified_base (305)..(305): a, c, t, g, unknown or other
  misc_feature (305)..(305): n is a, c, g, or t
  modified_base (452)..(452): a, c, t, g, unknown or other
  misc_feature (452)..(452): n is a, c, g, or t
tcagcgatcgtatacacgaccggtgctcgatttagtatctgatagttgggtttggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactgggaccagcggtgacattggtgtttataactatgtctcctggtaccagcaccaccaggcaaagcccccaaatcatgatttangatgtcagtgatcggcctgaggggtttcaatcgcttctctggcttcagtccggcaacacggcctcctgacccatctctggccctcgaggccgaggacgaggctgattatactgcagctacatatacaatcaaataacaattggggtnttcggcggagggacctaaatcggaccgtctaggtcaagcccaaggctcgccccctaggtctacc

SEQ ID NO: 309722 - DNA, 529 bp, Homo sapiens
  misc_feature: GZ8MTXP02I4NX4.51.38.D05.1.454.CMB.2.raw
  modified_base (307)..(307): a, c, t, g, unknown or other
  misc_feature (307)..(307): n is a, c, g, or t
  modified_base (365)..(365): a, c, t, g, unknown or other
  misc_feature (365)..(365): n is a, c, g, or t
  modified_base (430)..(430): a, c, t, g, unknown or other
  misc_feature (430)..(430): n is a, c, g, or t
tcagcgatcgtatacacgaccggtgctcgatttagtatctgatagttgggtttgggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactgggaccagcggtgacattggtgtttataactatgtctcctggtaccagcaccacccaggcaaagcccccaaatcatgatttangatgtcagtgatcggccctgaggggtttcaatcgcttctctggctccagtccgcaacnccgcctcctgaccatctctcggccctcgaggcccgaggacgaggctgattagttactgcagctanatatacaatcaaataacattgggtatcgggacggaggaccaaaacgtcgacccgttcgtaggtccaacggtcccaaggcctcgccccctcggtctaccg

SEQ ID NO: 309723 - DNA, 607 bp, Homo sapiens
  misc_feature: GZ8MTXP02I7FU4.51.38.D05.1.454.CMB.2.raw
  modified_base (237)..(237): a, c, t, g, unknown or other
  misc_feature (237)..(237): n is a, c, g, or t
  modified_base (247)..(247): a, c, t, g, unknown or other
  misc_feature (247)..(247): n is a, c, g, or t
  modified_base (286)..(286): a, c, t, g, unknown or other
  misc_feature (286)..(286): n is a, c, g, or t
  modified_base (304)..(304): a, c, t, g, unknown or other
  misc_feature (304)..(304): n is a, c, g, or t
tcagcgatcgtatacacgaccggtgctcgatttagtatctgatagttgggtttgggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactgggaccagcggtnacattgggtnttataactatgtctctgtaccagcaccaccagacaaacnccccaaatcatgatttangatgtcagtgatcgcctcgtagggttcgtaactctcttctctgctcacgtccgacaacacgcctccctcaccactctctcgtcctccgacggaccggacggaacggaacggacgtagtaatttaaatttaacttacgtacacgactactaactaaactaaactaaaactaactaaaataaaaactaaaagttaagggttacgggttacgggtacggggaacgggaaaccgaaaaccgtaacgtaaccgtaccgtaacggtacgaacgaccgaaacgacgtaccgccccgtacccgtacgtacg

SEQ ID NO: 309724 - DNA, 537 bp, Homo sapiens
  misc_feature: GZ8MTXP02HANBU.51.38.D05.1.454.CMB.2.raw
  modified_base (306)..(306): a, c, t, g, unknown or other
  misc_feature (306)..(306): n is a, c, g, or t
  modified_base (472)..(472): a, c, t, g, unknown or other
  misc_feature (472)..(472): n is a, c, g, or t
tcagcgatcgtatacacgaccggtgctcgatttagtatctgatagttgggtttggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactgggaccagcggtgacattggtgtttataactatgtctcctggtaccagcaccaccaggcaaacgcccccaaatcatgatttangatgtcagtgatcggcctgaggggtttcaactcgcttctctggctccagtcccggacaaaccaccggcctccctgaccctatcctcgtcggccctccgagggcccgaagggaccgaggcctgatttattactgcagctcatatacaatacaaatacaagttgggtnttcggacggaggaccaaacgtcgaccgtctaggacaagcccaaggcctacgccccctggactaac

SEQ ID NO: 309725 - DNA, 552 bp, Homo sapiens
  misc_feature: GZ8MTXP02IF5MZ.51.38.D05.1.454.CMB.2.raw
  modified_base (233)..(233): a, c, t, g, unknown or other
  misc_feature (233)..(233): n is a, c, g, or t
  modified_base (252)..(252): a, c, t, g, unknown or other
  misc_feature (252)..(252): n is a, c, g, or t
  modified_base (306)..(306): a, c, t, g, unknown or other
  misc_feature (306)..(306): n is a, c, g, or t
tcagcgatcgtatacacgaccggtgctcgatttagtatctgatagttgggtttgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactgggaccagcggtnacattggtgtttataactntgtctcctggtaccagcaccacccaggcaaacgcccccaaactcatgattttangatgtcagtgatcggcctcgtaggggtttcaatcgccttctctgctcaagtccgcaacacggccctccctgaccatcctctcggccctccgacggcccgaagggacgacggctaggtacttattactgcagctacattataacaatacaaataacaagttggtgtacggacggtacggacaaacgtgacccgtactacggtacacgcccgaagggcctacggccccctggtcccaccttcgtcccg

SEQ ID NO: 309726 - DNA, 503 bp, Homo sapiens
  misc_feature: GZ8MTXP02JNCQO.51.38.D05.1.454.CMB.2.raw
  modified_base (245)..(245): a, c, t, g, unknown or other
  misc_feature (245)..(245): n is a, c, g, or t
  modified_base (306)..(306): a, c, t, g, unknown or other
  misc_feature (306)..(306): n is a, c, g, or t
  modified_base (444)..(444): a, c, t, g, unknown or other
  misc_feature (444)..(444): n is a, c, g, or t
tcagcgatcgtatacacgaccggtgctcgatttagtatctgatagttgggtttggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactgggaccagcggtgacattggtntttataactatgtctcctggtaccagcaccacccaggcaaagcccccaaatcatgatttangatgtcagtgatcggcctcgaggggtttcaactcgcttctctggctcagtccgcaacacgcctcctgaccatctctgcctcaggccgaggacgaggctgattatactgcagctacatatacaatcaataacagttggnttcggcggaggaccaaacgtgaccgtctaggcaagcccaaggctcgccccctggtctac

SEQ ID NO: 309727 - DNA, 515 bp, Homo sapiens
  misc_feature: GZ8MTXP02F1L4W.51.38.D05.1.454.CMB.2.raw
  modified_base (251)..(251): a, c, t, g, unknown or other
  misc_feature (251)..(251): n is a, c, g, or t
  modified_base (307)..(307): a, c, t, g, unknown or other
  misc_feature (307)..(307): n is a, c, g, or t
  modified_base (363)..(363): a, c, t, g, unknown or other
  misc_feature (363)..(363): n is a, c, g, or t
  modified_base (371)..(371): a, c, t, g, unknown or other
  misc_feature (371)..(371): n is a, c, g, or t
tcagcgatcgtatacacgaccggtgctcgatttagtatctgatagttgggtttgggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactgggaccagcggtgacattggtgtttanaactatgtctcctggtaccagcaccacccaggcaaagcccccaaatcatgatttangatgtcagtgatcggcctgaggggtttcaatcgcttctctggctcagtccgcaacncgcctccngaccatctctggccctcaggcccgaggacaggctgattattactgcagctcatatacaatcaaataacaattggggtattcgggcggagggaccaaaagtcgaaccgtctaggtcaacgcccaaggcctcgccccctggcctac

SEQ ID NO: 309728 - DNA, 492 bp, Homo sapiens
  misc_feature: GZ8MTXP02HIH8I.51.38.D05.1.454.CMB.2.raw
  modified_base (342)..(342): a, c, t, g, unknown or other
  misc_feature (342)..(342): n is a, c, g, or t
  modified_base (434)..(434): a, c, t, g, unknown or other
  misc_feature (434)..(434): n is a, c, g, or t
  modified_base (441)..(441): a, c, t, g, unknown or other
  misc_feature (441)..(441): n is a, c, g, or t
  modified_base (449)..(449): a, c, t, g, unknown or other
  misc_feature (449)..(449): n is a, c, g, or t
  modified_base (481)..(481): a, c, t, g, unknown or other
  misc_feature (481)..(481): n is a, c, g, or t
tcagcgatcgtatacacgaccggtgctcgatttagtatctgatagttgggtttgggggaggcgtggtccagcctgggaggtccctgagactcgcctgtaaaccgtccggattcaccttcagtaactatgcaatgcactgggtccgccaggctccaggcaaggggctggactgggtggcaggcatatcatttgatggaagcaagaagtactatgcagactccgtgaaggccgattcaccatctcagagacagttccgatgacacagtctatctacacatgagcagtgtgagacctgacgacacggtctctttttactgtgcgccaggaagcagtgctggccanatcatgcttttgattatctgagccaaagggacaatggtacagtcgtctcgttcgcctcacaggccatcgtctcccctgccacctcacaacgngcactcngggccagngcgcctggctcgcctggtcaacggctactccncgtacgctacg

SEQ ID NO: 309729 - DNA, 540 bp, Homo sapiens
  misc_feature: GZ8MTXP02GYQNK.51.38.D05.1.454.CMB.2.raw
  modified_base (436)..(436): a, c, t, g, unknown or other
  misc_feature (436)..(436): n is a, c, g, or t
tcagcgatcgtatacacgaccggtgctcgatttagtatctgatagttgggtttggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactgggaccagcggtgacattggtgtttataactatgtctcctggtaccagcaccacccaggcaaacgcccccaaatcatgatttatgatgtcagtgatcggcctcgaggggtttcaatcgcttctctggctcagtccggcaacaccggcctccctgacccatctctggccctcgaggccgaggacgagggctgattatactgcagctcatactanaatacaaataacaagtttgggtacgttcgggacggtagggaaccaaacgtggacccgtaccgtaggtcaacgacccgaaggtcctcgccccgtcggtctacccg

SEQ ID NO: 309730 - DNA, 565 bp, Homo sapiens
  misc_feature: GZ8MTXP02IPXO7.51.38.D05.1.454.CMB.2.raw
  modified_base (247)..(247): a, c, t, g, unknown or other
  misc_feature (247)..(247): n is a, c, g, or t
tcagcgatcgtatacacgaccggtgctcgatttagtatctgatagttgggtttgggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactgggaccagcggtgactattggtntttaataactatgtctctggtaccagcaccaccaggcaaacgcccccaaactcatgtatttatgatgtcagtgatccggccctgaggggtttcgaactcgcttctctggctccagtccgcaacgacgtccctctgaccatctctcggcctcgacgcgaggacgaggctgattatactgcagctcaatatacaatacaaataactaagtggggttgttaccgggacgggacgggaaacctaaacgtcggtaacccgttacccgtaggttaccaacggtacccaacggtccgtccgacccccgttcggtaccctaacccg

SEQ ID NO: 309731 - DNA, 538 bp, Homo sapiens
  misc_feature: GZ8MTXP02HG8LJ.51.38.D05.1.454.CMB.2.raw
  modified_base (436)..(436): a, c, t, g, unknown or other
  misc_feature (436)..(436): n is a, c, g, or t
tcagcgatcgtatacacgaccggtgctcgatttagtatctgatagttgggtttgggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactgggaccagcggtgacattggtgtttataactatgtctcctggtaccagcaccaccaggcaaacgcccccaaactcatgatttatgatgtcagtgatcggcctgaggggtttcatcgcttctctggctccagtccggacaacacgccctccctgacccatctctcggcctccacggccgaggacgaggctagatttatactgctagctcatanacaatacaaataactaagttgggtagttcggacgggaggaccaaaacgtcgaccgtcgtacggtcaacgcccgaacggcctcgcccccgtcggtactacccg

SEQ ID NO: 309732 - DNA, 575 bp, Homo sapiens
  misc_feature: GZ8MTXP02G9R7X.51.38.D05.1.454.CMB.2.raw
  modified_base (241)..(241): a, c, t, g, unknown or other
  misc_feature (241)..(241): n is a, c, g, or t
  modified_base (251)..(251): a, c, t, g, unknown or other
  misc_feature (251)..(251): n is a, c, g, or t
tcagcgatcgtatacacgaccggtgctcgatttagtatctgatagttgggtttggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactgggaccagcggtgacattggtntttataactntgtctctgtacagcaccaccagacaacgccccaatcatgtatttatgatgtcagtgacgtccggcctcggtaggggtttcatcgtccttctcgtcggcctacgaacgtccgcaacgaccggtcctccctacgacctctctcgtcgccctcgacggccgaggacgacgctagtattactactgacacgtctacaatactaacaactacaaataacgtaaggttgggttagttcgggacgggtaacggaacctaaacgtcgaccgttacgtacgtacgacgacccgaacggtccgtccgtcccccgtcggtacctaccgtcctccg

SEQ ID NO: 309733 - DNA, 536 bp, Homo sapiens
  misc_feature: GZ8MTXP02H9MPP.51.38.D05.1.454.CMB.2.raw
  modified_base (274)..(274): a, c, t, g, unknown or other
  misc_feature (274)..(274): n is a, c, g, or t
  modified_base (313)..(313): a, c, t, g, unknown or other
  misc_feature (313)..(313): n is a, c, g, or t
  modified_base (330)..(330): a, c, t, g, unknown or other
  misc_feature (330)..(330): n is a, c, g, or t
  modified_base (357)..(357): a, c, t, g, unknown or other
  misc_feature (357)..(357): n is a, c, g, or t
  modified_base (391)..(391): a, c, t, g, unknown or other
  misc_feature (391)..(391): n is a, c, g, or t
  modified_base (394)..(394): a, c, t, g, unknown or other
  misc_feature (394)..(394): n is a, c, g, or t
  modified_base (398)..(398): a, c, t, g, unknown or other
  misc_feature (398)..(398): n is a, c, g, or t
  modified_base (402)..(402): a, c, t, g, unknown or other
  misc_feature (402)..(402): n is a, c, g, or t
  modified_base (404)..(404): a, c, t, g, unknown or other
  misc_feature (404)..(404): n is a, c, g, or t
  modified_base (495)..(495): a, c, t, g, unknown or other
  misc_feature (495)..(495): n is a, c, g, or t
tcagcgatcgtatacacgaccggtgctcgatttagtatctgatagttgggtttgggggctttgcctgggctctgctattcctcaccctcctcactcagggcacagggtcctgggcccagtctgccctgactcagcctgcctccgtgtctgggtctcctggacagtcgatcaccatctcctgcactgggaccaggcggtgactatttggtgttttaataactatgtctccgtggtaccagccaccaccaggacaaacgccccaaatcatgattangatgtcagtgatcggccctgaggggtttcaatcgcttcnctggctccaagtccggnaaacaccggcctcctgaccccatctcnggcctccgaggccgaggacagctgattattacgncanctanatananaatacaataagagttggtagtcggacggaacgaacaacgtcgaccgtacgagacacgaccagcctccgccctcgctctccttccgtacccnccctcctacgtcgtaacgcacgtcgacgacggcggacgcgg

SEQ ID NO: 309734 - DNA, 573 bp, Homo sapiens
  misc_feature: GZ8MTXP02FLPYC.51.38.D05.1.454.CMB.2.raw
  modified_base (247)..(247): a, c, t, g, unknown or other
  misc_feature (247)..(247): n is a, c, g, or t
  modified_base (308)..(308): a, c, t, g, unknown or other
  misc_feature (308)..(308): n is a, c, g, or t
tcagcgatcgtatacacgaccggtgctcgatttagtatctgatagttgggtttgggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactgggaccagcggtgacatttggtntttataactatgtctcctggtaccagcaccaccaggcaaacgcccccaaatcatgatttangatgtcagtgatcggcctgtaggggtttcaactcgcttctctggcctccgagtccggacaaacaccggccctccctagaccctatctctcggcctccgaggcccgaggacgaggctagatttatactgcagtctcaatactacaaatcaaaattaacaagtttgggtgttaccgggacgggaacggtaaccaaaacgtcggaacccgttacgtacgggtaccaacgcccgaaacggtcctcccgtacccccgtcggtacctaccg

SEQ ID NO: 309735 - DNA, 520 bp, Homo sapiens
  misc_feature: GZ8MTXP02IG2S6.51.38.D05.1.454.CMB.2.raw
  modified_base (326)..(326): a, c, t, g, unknown or other
  misc_feature (326)..(326): n is a, c, g, or t
  modified_base (451)..(451): a, c, t, g, unknown or other
  misc_feature (451)..(451): n is a, c, g, or t
  modified_base (457)..(457): a, c, t, g, unknown or other
  misc_feature (457)..(457): n is a, c, g, or t
tcagcgatcgtatacacgaccggtgctcgatttagtatctgatagttgggtttggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactgggaccagcggtgacattggtgtttataactatgtctcctggtaccagcaccacccaggcaaagcccccaaatcatgatttatgatgtcagtgatcggccctnaggggtttcaatcgcttctctggcctccagtccggcaacgacgccctcctgacccatctctgccctcaggccgaggacaggctgattattactgcagctcatatacaatcaaatacaattgggtnttcggnggtagggaccaaaacgtcgaaccgtcctaggtccaagcccaaggtctcgccccctggtctacc

SEQ ID NO: 309736 - DNA, 528 bp, Homo sapiens
  misc_feature: GZ8MTXP02H5NYA.51.38.D05.1.454.CMB.2.raw
  modified_base (206)..(206): a, c, t, g, unknown or other
  misc_feature (206)..(206): n is a, c, g, or t
  modified_base (266)..(266): a, c, t, g, unknown or other
  misc_feature (266)..(266): n is a, c, g, or t
tcagcgatcgtatacacgaccggtgctcgatttagtatctgatagttgggtttggggctttgcctgggctctgctattcctcaccctcctcactcagggcacagggtcctgggcccagtctgccctgactcagcctgcctccgtgtctgggtctcctggacagtcgatcaccatctcctgcactgggaccagcggtgacattggtntttataactatgtctcctggtaccagcaccacccaggcaaagccccaaatcatgatttangatgtcagtgatcggccctcgaggggtttcaaatcgcttctctggctccaagtccggcaacacggcctccctgaccccatctctcggcctccgaggccgaggacgaggctgattattactgcagctcatatacaatcaaataacattggtgttcggcggacgggtaccaaactcgaccgtccgtaggtcacgacccaaggcctcgccccctcggtcactctcgttcccaccctcctctcgtaagcactctgacgcggctcgg

SEQ ID NO: 309737 - DNA, 567 bp, Homo sapiens
  misc_feature: GZ8MTXP02JFZKU.51.38.D05.1.454.CMB.2.raw
  modified_base (308)..(308): a, c, t, g, unknown or other
  misc_feature (308)..(308): n is a, c, g, or t
tcagcgatcgtatacacgaccggtgctcgatttagtatctgatagttgggtttgggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactgggaccagcggtgacattggtgtttataactatgtctcctggtaccagcaccacccaggcaaacgcccccaaatcatgatttangatgtcagtgatcggcctgaggggtttcaactcgcttctctggcctcagtcccggacaaacgccgcctccctgacccatcctctcggcctccgaggcccgaggacgagctagatttatacgtgcagctacatacaacaatacaaataacgtagttgggtgttacgggacggtaacgggaaccctaaaagtcggtacccgtaccgtaggtaccaacggaccccgaaaggtccctacggccccccttagggtacctacccg

SEQ ID NO: 309738 - DNA, 514 bp, Homo sapiens
  misc_feature: GZ8MTXP02GCEZK.51.38.D05.1.454.CMB.2.raw
  modified_base (322)..(322): a, c, t, g, unknown or other
  misc_feature (322)..(322): n is a, c, g, or t
  modified_base (358)..(358): a, c, t, g, unknown or other
  misc_feature (358)..(358): n is a, c, g, or t
tcagcgatcgtatacacgaccggtgctcgatttagtatctgatagttgggtttgggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactgggaccagcggtgacattggtgtttataactatgtctcctggtaccagcaccacccaggcaaagcccccaaactcatgatttatgatgtcagtgatcggccctnaggggtttcaatcgcttctctgctcagtccgcaacncggcctcctgaccatctctggccctcaggccgaggacgaggctgattattactgcagctcatatacaatcaaataacaattgggtagttcggacggagggaccaaagtcgaccgtctacggtcagcccaaggcctacgccccctggtcactctccg

SEQ ID NO: 309739 - DNA, 613 bp, Homo sapiens
  misc_feature: GZ8MTXP02H9NYZ.51.38.D05.1.454.CMB.2.raw
  modified_base (266)..(266): a, c, t, g, unknown or other
  misc_feature (266)..(266): n is a, c, g, or t
  modified_base (406)..(406): a, c, t, g, unknown or other
  misc_feature (406)..(406): n is a, c, g, or t
tcagcgatcgtatacacgaccggtgctcgatttagtatctgatagttgggtttggggctttgcctgggctctgctattcctcacctcctcactcagggcacagggtcctgggcccagtctgccctgactcagcctgcctccgtgtctgggtctcctggacagtcgatcaccatctcctgcactgggaccagcggtgacatttggtgtttataactatgtctctggtaccagcaccaccaggacaaacgcccccaaatcatgattangatgtcagtgatcggcctcgaggggtttcaatcgtcttctcgtggcctaccgaaggtcccggacaaaccgaccggccctcccgtgaccccctattcctctcggcctccgagggccgagggacgaggctgacttattacgngcagctacaatataacaataacaaattaacgtagttgggtacggttacgggacgggaacggtaacctaaacgtacggaccgtaccgtaaggtaccacgaccgaacggtccgtcccgaccccgttcgtacctaccttccgttcccgttacccctacccttccgttcgtaccgtaacgcctacgtcgtacggacggtccgggtacgcgg

SEQ ID NO: 309740 - DNA, 659 bp, Homo sapiens
  misc_feature: GZ8MTXP02F2KPL.51.38.D05.1.454.CMB.2.raw
  modified_base (319)..(319): a, c, t, g, unknown or other
  misc_feature (319)..(319): n is a, c, g, or t
  modified_base (346)..(346): a, c, t, g, unknown or other
  misc_feature (346)..(346): n is a, c, g, or t
tcagcgatcgtatacacgaccggtgctcgatttagtatctgatagttgggtttgggggaggcgtggtccagcctgggaggtccctgagactcgcctgtaaaccgtccggattcaccttcagtaactatgcaatgcactgggtccgccaggctccaggcaaggggctggactgggtggcaggcatatcatttgatggaagcaagaagtactatgcagactccgtgaagggccgattcaccatctccagagacagttccgatgacacagtctatctacacatgagcagtgtgagacctgacgacacggtcttctttttacngtgcgccaggaagcagtggctggccanatcatgctttttgatatcgtagggagacccgaaaggggaccaaagttggtacaagttccggtcttcgtttccgggcccttacccgaacccgaaacggggtcccccaagttcccgggttccctttccccccgttacgggcccctaacccccgtcccttacccgaaacgacgtccctaacccgttccggcggggggaccaaccggacggtccccggggccccgttcgggggcccttcgggccccgtttacggggaacccgtaaaacggggtaccctttaacccgtttcccgttaccggtaacggtccctaacccg

SEQ ID NO: 309741 - DNA, 543 bp, Homo sapiens
  misc_feature: GZ8MTXP02IF9IK.51.38.D05.1.454.CMB.2.raw
  modified_base (309)..(309): a, c, t, g, unknown or other
  misc_feature (309)..(309): n is a, c, g, or t
  modified_base (397)..(397): a, c, t, g, unknown or other
  misc_feature (397)..(397): n is a, c, g, or t
  modified_base (443)..(443): a, c, t, g, unknown or other
  misc_feature (443)..(443): n is a, c, g, or t
tcagcgatcgtatacacgaccggtgctcgatttagtatctgatagttgggtttgggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactgggaccagcggtgacattggtagtttataactatgtctcctggtaccagcaccacccaggcaaacgcccccaaatcatgatttangatgtcagtgatccggccctgtaggggtttcaatcgcttctctggcctccagtcccggacaaaccgaccggccctccctgacccatcnctggccctcgagccgaggacgaggctgattatactgcagctcatanacaatcaaataacaagttggggtagttcgggacggagggaccaaaacgtcgacccgtcgtagtcaacgcccgaaggcctaccgcccccgtggtactaccg

SEQ ID NO: 309742 - DNA, 505 bp, Homo sapiens
  misc_feature: GZ8MTXP02HUHR5.51.38.D05.1.454.CMB.2.raw
  modified_base (241)..(241): a, c, t, g, unknown or other
  misc_feature (241)..(241): n is a, c, g, or t
  modified_base (246)..(246): a, c, t, g, unknown or other
  misc_feature (246)..(246): n is a, c, g, or t
  modified_base (251)..(251): a, c, t, g, unknown or other
  misc_feature (251)..(251): n is a, c, g, or t
  modified_base (300)..(300): a, c, t, g, unknown or other
  misc_feature (300)..(300): n is a, c, g, or t
  modified_base (310)..(310): a, c, t, g, unknown or other
  misc_feature (310)..(310): n is a, c, g, or t
  modified_base (335)..(335): a, c, t, g, unknown or other
  misc_feature (335)..(335): n is a, c, g, or t
  modified_base (352)..(352): a, c, t, g, unknown or other
  misc_feature (352)..(352): n is a, c, g, or t
  modified_base (360)..(360): a, c, t, g, unknown or other
  misc_feature (360)..(360): n is a, c, g, or t
  modified_base (365)..(365): a, c, t, g, unknown or other
  misc_feature (365)..(365): n is a, c, g, or t
  modified_base (369)..(369): a, c, t, g, unknown or other
  misc_feature (369)..(369): n is a, c, g, or t
  modified_base (402)..(402): a, c, t, g, unknown or other
  misc_feature (402)..(402): n is a, c, g, or t
  modified_base (410)..(410): a, c, t, g, unknown or other
  misc_feature (410)..(410): n is a, c, g, or t
  modified_base (414)..(414): a, c, t, g, unknown or other
  misc_feature (414)..(414): n is a, c, g, or t
  modified_base (419)..(419): a, c, t, g, unknown or other
  misc_feature (419)..(419): n is a, c, g, or t
  modified_base (496)..(496): a, c, t, g, unknown or other
  misc_feature (496)..(496): n is a, c, g, or t
tcagcgatcgtatacacgaccggtgctcgatttagtatctgatagttgggtttggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactgggaccagcggtgacattggtntttanaactntgtctctggtacagcaccaccaggcaaacgcccccaaatcatgatttangatgtcagtnatcggcctgaggggtttcatcgctntctgctcagtccgcacncgcctccngaccntctntcgccctcaggccgagacgaggctgattatacngcagctanatanacaanacaaatactagttggtgtcggacggacgaccaaagtcgaccgtacacggacacgaccaagcctccgcccctgtaccncttcgtccg

SEQ ID NO: 309743 - DNA, 589 bp, Homo sapiens
  misc_feature: GZ8MTXP02F75PL.51.38.D05.1.454.CMB.2.raw
  modified_base (319)..(319): a, c, t, g, unknown or other
  misc_feature (319)..(319): n is a, c, g, or t
  modified_base (347)..(347): a, c, t, g, unknown or other
  misc_feature (347)..(347): n is a, c, g, or t
tcagcgatcgtatacacgaccggtgctcgatttagtatctgatagttgggtttgggggaggcgtggtccagcctgggaggtccctgagactcgcctgtaaaccgtccggattcaccttcagtaactatgcaatgcactgggtccgccaggctccaggcaaggggctggactgggtggcaggcatatcatttgatggaagcaagaagtactatgcagactccgtgaagggccgattcaccatctccagagacagttccgatgacacagtctatctacacatgagcagtgtgagacctgacgacacggtcttctttttacngtgcgcaggaagcagtgctgccacatcntgctttgatatcgtggacgaccgaaagggacaagtggtactatccgttcttccgttccggtccctacccgaaccgaaacggggcccctacgttcccgggttcccttccccccgtcgggccctacccccgtccctacccaacgaccgtccgacccgtcgtcgggggaccaccgacggcccggcccgtcggggcctcggcccgtcggtaacgaacggaccttaccttcccgtacgtacgctacg

SEQ ID NO: 309744 - DNA, 501 bp, Homo sapiens
  misc_feature: GZ8MTXP02G5UXA.51.38.D05.1.454.CMB.2.raw
  modified_base (315)..(315): a, c, t, g, unknown or other
  misc_feature (315)..(315): n is a, c, g, or t
  modified_base (365)..(365): a, c, t, g, unknown or other
  misc_feature (365)..(365): n is a, c, g, or t
  modified_base (444)..(444): a, c, t, g, unknown or other
  misc_feature (444)..(444): n is a, c, g, or t
  modified_base (452)..(452): a, c, t, g, unknown or other
  misc_feature (452)..(452): n is a, c, g, or t
  modified_base (492)..(492): a, c, t, g, unknown or other
  misc_feature (492)..(492): n is a, c, g, or t
tcagcgatcgtatacacgaccggtgctcgatttagtatctgatagttgggtttgggggaggcgtggtccagcctgggaggtccctgagactcgcctgtaaaccgtccggattcaccttcagtaactatgcaatgcactgggtccgccaggctccaggcaaggggctggactgggtggcaggcatatcatttgatggaagcaagaagtactatgcagactccgtgaaggccattcaccatctccagagacagttccgatgacacagtctatctacacatgagcagtgtgagacctgacgacacggctctttttacngtgcgccaggaagcagtggctggccacatcatgctttttgatatctgganccaaagggacaaatggtcatcgtctcttcggcctccaccaaagggcccatcggtctccccctggcaccctcctccaagngcacctcnggggcacagcgccctgggctgcctggcaaggactactccncgtacgcac

SEQ ID NO: 309745 - DNA, 528 bp, Homo sapiens
  misc_feature: GZ8MTXP02GJSH5.51.38.D05.1.454.CMB.2.raw
  modified_base (349)..(349): a, c, t, g, unknown or other
  misc_feature (349)..(349): n is a, c, g, or t
tcagcgatcgtatacacgaccggtgctcgatttagtatctgatagttgggtttgggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactgggaccagcggtgacattggtgtttataactatgtctcctggtaccagcaccacccaggcaaacgcccccaaactcatgatttatgatgtcagtgatcggccctgaggggtttcaactcgcttcnctggctcagtccgcaacacgcctcctgacccatctctcggcctccgaggccgaggacgaggctgattattctgcagctcatatacatacaagtaacaagttgggtagttcggacggtagggaccaaacgttcgaccgtactaggtacaacgcccaaggcctcgcccccgttcggcgtcc

SEQ ID NO: 309746 - DNA, 542 bp, Homo sapiens
  misc_feature: GZ8MTXP02GIZVN.51.38.D05.1.454.CMB.2.raw
  modified_base (308)..(308): a, c, t, g, unknown or other
  misc_feature (308)..(308): n is a, c, g, or t
tcagcgatcgtatacacgaccggtgctcgatttagtatctgatagttgggtttgggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactgggaccagcggtgacattggtgtttataactatgtctcctggtaccagcaccacccaggcaaacgcccccaaatcatgatttangatgtcagtgatcggcctcgaggggtttcaatcgcttctctggctcagtccgcaacacgcctcctgaccatctctcggcctcgaggccgaggacgagctagattatactgcagctacatactacaatacaaataactaaagtttggggtacgttacgggacggagggaaccaaacgtcgacccgtctacggtcaacgtacccgaagggcctaccggccccctcggtacctaccg

SEQ ID NO: 309747 - DNA, 553 bp, Homo sapiens
  misc_feature: GZ8MTXP02JMNFK.51.38.D05.1.454.CMB.2.raw
  modified_base (241)..(241): a, c, t, g, unknown or other
  misc_feature (241)..(241): n is a, c, g, or t
  modified_base (246)..(246): a, c, t, g, unknown or other
  misc_feature (246)..(246): n is a, c, g, or t
tcagcgatcgtatacacgaccggtgctcgatttagtatctgatagttgggtttggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactgggaccagcggtgacattggtntttanaactatgtctcctggtaccagcaccaccaggcaaagcccccaaatcatgatttatgatgtcagtgatcggccctcgaggggtttcaatcgccttctctggctcaagtcgcaacacggcctcctgaccatctctggccctcgaggccgagacgacggctgattatactgcagctacatatacaatacaaataactaagttggggtagttcgggacggaacgggaccaaaacgtcggaaccgtaccgtacggtaccgacgacccgtaagggcctaccggccccctcggtacctaccgtcctttaccccg

SEQ ID NO: 309748 - DNA, 559 bp, Homo sapiens
  misc_feature: GZ8MTXP02FE0V8.51.38.D05.1.454.CMB.2.raw
  modified_base (210)..(210): a, c, t, g, unknown or other
  misc_feature (210)..(210): n is a, c, g, or t
  modified_base (309)..(309): a, c, t, g, unknown or other
  misc_feature (309)..(309): n is a, c, g, or t
  modified_base (333)..(333): a, c, t, g, unknown or other
  misc_feature (333)..(333): n is a, c, g, or t
  modified_base (355)..(355): a, c, t, g, unknown or other
  misc_feature (355)..(355): n is a, c, g, or t
tcagcgatcgtatacacgaccggtgctcgatttagtatctgatagttgggtttgggggctttgcctgggctctgctattcctcaccctcctcactcagggcacagggtcctgggcccagtctgccctgactcagcctgcctccgtgtctgggtctcctggacagtcgatcaccatctcctgcacgtgggaccaggcggtgactattggtntttaataactatgtctcctggtaccagcaccacccaggcaaacgccccaaatcatgattatgatgtcagtgatcggcctgaggggtttcaatcgcttcnctggctccgaagtccggacaaacnccggcctccctgaccccatccnctcggccctccgagggccgagggacgaggctagtatttatactgcagctacataatacaattacaaaatacaagttgggtagttcggacggacggaccaaaactggaccgtccgtaaggacacgaccgacgaccgtcgccccgtcccgtacgccttcctcgttccctaccctcctctaccgtgaccactcgagacggcggcgcg

SEQ ID NO: 309749 - DNA, 520 bp, Homo sapiens
  misc_feature: GZ8MTXP02HBRX0.51.38.D05.1.454.CMB.2.raw
  modified_base (241)..(241): a, c, t, g, unknown or other
  misc_feature (241)..(241): n is a, c, g, or t
  modified_base (302)..(302): a, c, t, g, unknown or other
  misc_feature (302)..(302): n is a, c, g, or t
tcagcgatcgtatacacgaccggtgctcgatttagtatctgatagttgggtttggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactgggaccagcggtgacattggtntttataactatgtctctggtaccagcaccaccaggcaaacgcccccaaatcatgattttangatgtcagtgatcggcctcgaggggtttcatcgctctctgctcagtccgcacacgcctcctgacatctctcggcctccaggcccgaggaccgaggctgattatactgcagcttacatactacaatacaataacaagttgggtagttcggacggtacgggaccaaacgtcgaccgtctacgcacgccgaaggctccgccccgtcggtccacgtctcccg

SEQ ID NO: 309750 - DNA, 530 bp, Homo sapiens
  misc_feature: GZ8MTXP02GFBNM.51.38.D05.1.454.CMB.2.raw
  modified_base (427)..(427): a, c, t, g, unknown or other
  misc_feature (427)..(427): n is a, c, g, or t
tcagcgatcgtatacacgaccggtgctcgatttagtatctgatagttgggtttgggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcacgtgggaccagcggtgactattggtgtttataactatgtctcctggtaccagcaccaccaggcaaacgcccccaaatcatgatttatgatgtcagtgatcggcctgaggggtttcaatcgcttctctggctcagtccggcaacacgccctcctgaccatctctgcctccaggccgaggacgaggctagattagttactgcagctnatatacaatacaaataacaagttgggtgttcgggacggagggaccaaaacgtcgacccgtcgtagtccaacgacccgaaggcctcgccccctcggtactaccg

SEQ ID NO: 309751 - DNA, 543 bp, Homo sapiens
  misc_feature: GZ8MTXP02G6WLE.51.38.D05.1.454.CMB.2.raw
  modified_base (267)..(267): a, c, t, g, unknown or other
  misc_feature (267)..(267): n is a, c, g, or t
  modified_base (286)..(286): a, c, t, g, unknown or other
  misc_feature (286)..(286): n is a, c, g, or t
tcagcgatcgtatacacgaccggtgctcgatttagtatctgatagttgggtttggggctttgcctgggctctgctattcctcaccctcctcactcagggcacagggtcctgggcccagtctgccctgactcagcctgcctccgtgtctgggtctcctggacagtcgatcaccatctcctgcactgggaccagcggtgacattggtgtttataactatgtctcctggtaccagcaccacccaggcaaagcccccaaatcatgatttangatgtcagtgatcggcctnaggggtttcaatcgcttctctggctccaagtccggcaacacggcctccctgaccccatctctggcctccagggccgaggacgaggctgatttatactgcagctcatatacaatcaaataacaagttgggtgttcgggcggaggggaccaaaacgtcggacccgtcccgtaaggtccaagccccaaaggcctcgccccctcggtcactcctcgttcccgcccttcctcctcgtaacgcactctgacgcggggctcggg

SEQ ID NO: 309752 - DNA, 570 bp, Homo sapiens
  misc_feature: GZ8MTXP02HZUPP.51.38.D05.1.454.CMB.2.raw
tcagcgatcgtatacacgaccggtgctcgatttagtatctgatagttgggtttggggtggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactgggaccagcggtgacattggtgtttataactatgtctcctggtaccagcaccacccaggcaaacgcccccaaactcatgatttatgatgtcagtgatcggccctgaggggttcaatccgcttctctggctccaagtccggcaacacggcctccctgaccatctctggcctccaggcccgaggaccgaggctgattatactgcagctcatatacaatacaaataacaagttgggtgttcggcggtaaggggaacccaaaacgtcggaaacccgttcccgtaaggtacccgaacggcccccgtaaaagggtccgtaccggaccccccttacgggtcctaaccgtttcccg

SEQ ID NO: 309753 - DNA, 560 bp, Homo sapiens
  misc_feature: GZ8MTXP02JU5UR.51.38.D05.1.454.CMB.2.raw
  modified_base (319)..(319): a, c, t, g, unknown or other
  misc_feature (319)..(319): n is a, c, g, or t
  modified_base (349)..(349): a, c, t, g, unknown or other
  misc_feature (349)..(349): n is a, c, g, or t
tcagcgatcgtatacacgaccggtgctcgatttagtatctgatagttgggtttgggggaggcgtggtccagcctgggaggtccctgagactcgcctgtaaaccgtccggattcaccttcagtaactatgcaatgcactgggtccgccaggctccaggcaaggggctggactgggtggcaggcatatcatttgatggaagcaagaagtactatgcagactccgtgaagggccgattcaccatctccagagacagttccgatgacacagtctatctacacatgagcagtgtgagacctgacgacacggtcttctttttacngtgcgccaggaagcagtgctggccacatcntgtctttgatatctggacgccaaagggacaagtggtacagtcgtctcgttcggcctcccacgaacgggccctagtccggtccttcccccgtgccaccctcctaccaagcgccacctcgtcggggccacgcggcccggtcccgtcggggcctcggtcccgtggtaacccgtaacgggtacccttacgttcccgtacggttaccgctaacccg

SEQ ID NO: 309754 - DNA, 562 bp, Homo sapiens
  misc_feature: GZ8MTXP02HKKH2.51.38.D05.1.454.CMB.2.raw
  modified_base (313)..(313): a, c, t, g, unknown or other
  misc_feature (313)..(313): n is a, c, g, or t
tcagcgatcgtatacacgaccggtgctcgatttagtatctgatagttgggtttgggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcacgtgggaccaggcggtgactatttggtgtttaataactatgtctcctggtaccagcaccacccaggcaaacgcccccaaatcatgatttangatgtcagtgatcggcctgaggggttcatcgcttctcttggctcgagtccgacaacgaccgccctccctgaccctatcctctcggccctcgacggaccgaggacgaggctggaatttacgtactgctagctacataatacaatacaaataactagttgggttagttcggacggtacggaacctaaagtcgaaccgtcgttaaggccaacgaccccgaaggtccctccggtcccccgtacggtcctaccg

SEQ ID NO: 309755 - DNA, 525 bp, Homo sapiens
  misc_feature: GZ8MTXP02FPW3Y.51.38.D05.1.454.CMB.2.raw
  modified_base (327)..(327): a, c, t, g, unknown or other
  misc_feature (327)..(327): n is a, c, g, or t
  modified_base (508)..(508): a, c, t, g, unknown or other
  misc_feature (508)..(508): n is a, c, g, or t
tcagcgatcgtatacacgaccggtgctcgatttagtatctgatagttgggtttgggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactgggaccagcggtgacattggtgtttataactatgtctcctggtaccagcaccacccaggcaaacgccccaaactcatgatttatgatgtcagtgatcggcctnaggggtttcaactcgcttctctggcctcgagtccggacaacaccgcctccctgacccatctctggcctccaggccgaggacgaggctgattattactgcagctacatatacaatacaaataacaattgggtagttcgggacggaggacaaactcgaccgtactaggtcaagcccaaggccncgccccctcggctaccg

SEQ ID NO: 309756 - DNA, 621 bp, Homo sapiens
  misc_feature: GZ8MTXP02IZQLA.51.38.D05.1.454.CMB.2.raw
  modified_base (350)..(350): a, c, t, g, unknown or other
  misc_feature (350)..(350): n is a, c, g, or t
tcagcgatcgtatacacgaccggtgctcgatttagtatctgatagttgggtttgggggaggcgtggtccagcctgggaggtccctgagactcgcctgtaaaccgtccggattcaccttcagtaactatgcaatgcactgggtccgccaggctccaggcaaggggctggactgggtggcaggcatatcatttgatggaagcaagaagtactatgcagactccgtgaagggccgattcaccatctccagagacagttccgatgacacagtctatctacacatgagcagtgtgagacctgacgacacggtcttctttttactgtgcgccaggaagcagtggctggccacatcntgtcttttgattatctggacgccgaaagggacaagtggtacagttcgtcttcgttccggccctccgaaccgtaaacgggccccctaagttccccgggttccctttcccccccgtgggtacccccacccccgttcccttacccgaaacggaccgccctaacccgtccggtcgggggaccaccgacggcccgggtcccgtcggggtccctcggccccgttgggtaaccgtaaacgggtaccttaccgttcccgttcggtaacgcccgtaaccg

SEQ ID NO: 309757 - DNA, 558 bp, Homo sapiens
  misc_feature: GZ8MTXP02HVRHN.51.38.D05.1.454.CMB.2.raw
  modified_base (313)..(313): a, c, t, g, unknown or other
  misc_feature (313)..(313): n is a, c, g, or t
tcagcgatcgtatacacgaccggtgctcgatttagtatctgatagttgggtttgggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcacgtgggaccaggcggtgactatttggtgtttaataactatgtctctggtaccagcaccacccaggacaaacgcccccaaatcatgatttangatgtcagtgatcggcctgtaggggttcaatcgctttctctgctcacgtccggacaacaccgcctccctgacccactctctcgccctccgacgccgaggacgagctgtattattactgcagctacatataaccaataccaaataaactagttagggtcgttcgggacgggtaacggaaccaaacgtacgaccgtaccgtaggtacaacgacccgaacggcctaccgcccccgtcggtactacccg

SEQ ID NO: 309758 - DNA, 517 bp, Homo sapiens
  misc_feature: GZ8MTXP02FO05H.51.38.D05.1.454.CMB.2.raw
  modified_base (363)..(363): a, c, t, g, unknown or other
  misc_feature (363)..(363): n is a, c, g, or t
  modified_base (371)..(371): a, c, t, g, unknown or other
  misc_feature (371)..(371): n is a, c, g, or t
tcagcgatcgtatacacgaccggtgctcgatttagtatctgatagttgggtttgggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactgggaccagcggtgacattggtgtttataactatgtctcctggtaccagcaccaccaggcaaacgcccccaaatcatgatttatgatgtcagtgatcggcctgaggggtttcaatcgcttctctggctcagtccgcaacncgcctccngaccatctctggcctccgaggcccgaggacgaggctagattatactgcagctacatatacaatacaaataacagttgggtgttcggcggaggaccaaacgtcgaccgtctaggtcaagcccaaggcctacgcccctcggtcctacg

SEQ ID NO: 309759 - DNA, 563 bp, Homo sapiens
  misc_feature: GZ8MTXP02GRT8P.51.38.D05.1.454.CMB.2.raw
  modified_base (242)..(242): a, c, t, g, unknown or other
  misc_feature (242)..(242): n is a, c, g, or t
  modified_base (248)..(248): a, c, t, g, unknown or other
  misc_feature (248)..(248): n is a, c, g, or t
  modified_base (305)..(305): a, c, t, g, unknown or other
  misc_feature (305)..(305): n is a, c, g, or t
tcagcgatcgtatacacgaccggtgctcgatttagtatctgatagttgggtttggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactgggaccagcggtgactattggtntttaanaactatgtctcctggtaccagcaccacccaggcaaacgcccccaaatcatgatttangatgtcagtgatcggcctcgaggggtttcaatcgccttctctgctcaagtccgcaacacggcctccctgaccatcctctcggccctcaggccgagacgaggctgattatactgcagctacatatacaatacaaataactaagttgggtagttacggacggtaacgggaaccaaacgtcggaaaccgtaccgtacggtaccacgtacccgaaaggtccctaccggtccccccgtcggtccaaccgttcgtttcccccgg

SEQ ID NO: 309760 - DNA, 568 bp, Homo sapiens
  misc_feature: GZ8MTXP02GX6AH.51.38.D05.1.454.CMB.2.raw
  modified_base (244)..(244): a, c, t, g, unknown or other
  misc_feature (244)..(244): n is a, c, g, or t
  modified_base (250)..(250): a, c, t, g, unknown or other
  misc_feature (250)..(250): n is a, c, g, or t
  modified_base (307)..(307): a, c, t, g, unknown or other
  misc_feature (307)..(307): n is a, c, g, or t
  modified_base (432)..(432): a, c, t, g, unknown or other
  misc_feature (432)..(432): n is a, c, g, or t
tcagcgatcgtatacacgaccggtgctcgatttagtatctgatagttgggtttgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcacgtgggaccagcggtgactattggtntttaanaactatgtctcctggtaccagcaccacccaggcaaacgcccccaaatcatgatttangatgtcagtgatcggcctgaggggtttcaatcgccttctctggctccaagtccggcaacacggcctccctgaccatcctctcgccctccgaggccgaggacgaggctgaattatactgcagctanatatacaattacaaataacaagttgggtagttacggcggtaacgggaccaaaacgtcgaaccgtcgtaacggtccacgtacccgaaaggtccctacccggaccccctacgggtacctaaccgttcccgtttcccgg

SEQ ID NO: 309761 - DNA, 561 bp, Homo sapiens
  misc_feature: GZ8MTXP02IEL32.51.38.D05.1.454.CMB.2.raw
  modified_base (321)..(321): a, c, t, g, unknown or other
  misc_feature (321)..(321): n is a, c, g, or t
  modified_base (346)..(346): a, c, t, g, unknown or other
  misc_feature (346)..(346): n is a, c, g, or t
  modified_base (350)..(350): a, c, t, g, unknown or other
  misc_feature (350)..(350): n is a, c, g, or t
tcagcgatcgtatacacgaccggtgctcgatttagtatctgatagttgggtttgggggaggcgtggtccagcctgggaggtccctgagactcgcctgtaaaccgtccggattcaccttcagtaactatgcaatgcactgggtccgccaggctccaggcaaggggctggactgggtggcaggcatatcattttgatggaagcaagaagtactatgcagactccgtgaagggccgattcaccatctccagagacagttccgatgacacagtctatctacacatgagcagtgtgagacctgacgacacggtcttcttttttacngtgcgccaggagcagtgctggccanatcntgtcttttgattatcgtggagccgaaagggacaagtggtacagttcgtctcttcggccctccaccgaacgggccccagtccggttcccttcccccgtggcccaccccgtcctaccaagacgcctaccgtcgtcggggcacgacggccggcccgtgggcctcgtcccgtcggtccgtaaacggtacttaccgttccgtacgtacgcctaccg

SEQ ID NO: 309762 - DNA, 565 bp, Homo sapiens
  misc_feature: GZ8MTXP02GNJYD.51.38.D05.1.454.CMB.2.raw
  modified_base (320)..(320): a, c, t, g, unknown or other
  misc_feature (320)..(320): n is a, c, g, or t
tcagcgatcgtatacacgaccggtgctcgatttagtatctgatagttgggtttgggggaggcgtggtccagcctgggaggtccctgagactcgcctgtaaaccgtccggattcaccttcagtaactatgcaatgcactgggtccgccaggctccaggcaaggggctggactgggtggcaggcatatcatttgatggaagcaagaagtactatgcagactccgtgaagggccgattcaccatctccagagacagttccgatgacacagtctatctacacatgagcagtgtgagacctgacgacacggtcttcttttttacngtgcgccaggaagcagtggctggccacatcatgtctttttgattatcgtggacgaccgaaagggacaagtggtacagttcgtctcgttccggcctccaccgaaacgggcccagtccggtccttcccccgtggcccacccctcctaccgaacgacgccaccgtcgtcgggggccacgacggccggcccgtcgggcctcggcccgtcggtaaccgaacggtcttaccttccgtcgtacgtcctaccg

SEQ ID NO: 309763 - DNA, 541 bp, Homo sapiens
  misc_feature: GZ8MTXP02FQHOE.51.38.D05.1.454.CMB.2.raw
  modified_base (320)..(320): a, c, t, g, unknown or other
  misc_feature (320)..(320): n is a, c, g, or t
  modified_base (352)..(352): a, c, t, g, unknown or other
  misc_feature (352)..(352): n is a, c, g, or t
tcagcgatcgtatacacgaccggtgctcgatttagtatctgatagttgggtttgggggaggcgtggtccagcctgggaggtccctgagactcgcctgtaaaccgtccggattcaccttcagtaactatgcaatgcactgggtccgccaggctccaggcaaggggctgggactgggtggcaggcatatcatttgatggaagcaagaagtactatgcagactccgtgaagggccattcaccatctccagagacagttccgatgacacagtctatctacacatgagcagtgtgagacctgacgacacggtcttcttttttacngtgcgccgaggaagcagtggctggccacatcntgcttttgatatctggagccgaaagggacaagtggtcatcgtcttcttccggcctccaccaaacgggcccagtccggtccttcccccgtcggccctaccctccctaccaagacgccacctcgtcgggggcacgacgcggcccgtcgggcctcgcctggtcgaacggacttacgttcctcgtacgctacg

SEQ ID NO: 309764 - DNA, 548 bp, Homo sapiens
  misc_feature: GZ8MTXP02JJONZ.51.38.D05.1.454.CMB.2.raw
  modified_base (247)..(247): a, c, t, g, unknown or other
  misc_feature (247)..(247): n is a, c, g, or t
  modified_base (466)..(466): a, c, t, g, unknown or other
  misc_feature (466)..(466): n is a, c, g, or t
tcagcgatcgtatacacgaccggtgctcgatttagtatctgatagttgggtttgggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactgggaccagcggtgactattggtntttataactatgtctcctggtaccagcaccacccaggacaacgcccccaaatcatgatttatgatgtcagtgatccggcctcgtaggggttcaatcgcttctctgctcagtccggacaacaccgcctcctcgacctatctcgtcgcctccgaggccgaggacgaggctgattactactgcagctcatatacaatcaaataacagttgggtgttacgggnggaacgggaaccaaacgtcggaacccgtacgtaggtaccaacggacccgaaacggtctccgacccccgttcggtactacccg

SEQ ID NO: 309765 - DNA, 542 bp, Homo sapiens
  misc_feature: GZ8MTXP02GP7OO.51.38.D05.1.454.CMB.2.raw
  modified_base (241)..(241): a, c, t, g, unknown or other
  misc_feature (241)..(241): n is a, c, g, or t
tcagcgatcgtatacacgaccggtgctcgatttagtatctgatagttgggtttggggggtctcaggaggcagcgctctcgggacgtctccaccatggcctgggctctgctattcctcaccctcctcactcagggcacagggtcctgggcccagtctgtcctgactcagcctgcctccgtgtctgggtctcctggacagtcgatcaccatctcctgcactgggaccagcggtgacattggtntttataactatgtctctggtaccagcaccacccaggcaaacgcccccaaactcatgatttatgatgtcagtgatcggccctgaggggtttcaatcgccttctctgctcagtccgcaacacggcctcctgaccatctcgtcggaccctccgaggccgaggacgaggctagattattactgacagctcatataacaatacaataactaagttgggtgttcgggacggaacggaccaaaacgtcgaccgtccgtaggtcgacgacccgaacggctccggcccctcggtaccaccttcgttcccg

SEQ ID NO: 309766 - DNA, 649 bp, Homo sapiens
  misc_feature: GZ8MTXP02HSQNY.51.38.D05.1.454.CMB.2.raw
  modified_base (271)..(271): a, c, t, g, unknown or other
  misc_feature (271)..(271): n is a, c, g, or t
tcagcgatcgtatacacgaccggtgctcgatttagtatctgatagttgggtttgggggctttgcctgggctctgctattcctcaccctcctcactcagggcacagggtcctgggcccagtctgccctgactcagcctgcctccgtgtctgggtctcctggacagtcgatcaccatctcctgcactgggaccagcggtgacattggtgtttataactatgtcctcgtggtaccagccaccaccaggacaaaccgaccccaatcatgtattangatgtcagtgatccggcctgtaggggtttcaagtcgtcttctcgtgctaccgaagtccgacaacgaccggtcctcctacgaccccatcctcgtcggcctccgaggccggagggacgacgcttagtaactttacttacgtcgactacgcctacattaactaactaaactactaaaacgtaaactaaaggttggggttacggttaccggggacgggtaaacgggtaacctaaacgtacgggtaacccgttcgtacggttaccgaacgacccgtaaaggccgtcccgtcccccgtcggtacctaccgttcgttcccgttcccccgtcccgtccttccgttacgtccgactaccgttcgacggtcggccggttcgtaccggg

SEQ ID NO: 309767 - DNA, 611 bp, Homo sapiens
  misc_feature: GZ8MTXP02IRKT8.51.38.D05.1.454.CMB.2.raw
  modified_base (347)..(347): a, c, t, g, unknown or other
  misc_feature (347)..(347): n is a, c, g, or t
tcagcgatcgtatacacgaccggtgctcgatttagtatctgatagttgggtttggggaggcgtggtccagcctgggaggtccctgagactcgcctgtaaaccgtccggattcaccttcagtaactatgcaatgcactgggtccgccaggctccaggcaaggggctggactgggtggcaggcatatcatttgatggaagcaagaagtactatgcagactccgtgaaggccgattcaccatctccagagacagttccgatgacacagtctatctacacatgagcagtgtgagacctgacgacacggtcttctttttactgtgcgccaggaagcagtgctggccacatcnttgtcttttgattatcgtagggacgtaccgaaagggaacaaagttggtactaagttcgttccttcgttccgggtccctacccgaacccgaaacggggcccctaacgttcccgggtttccctttcccccccgtgggccccctaccccttccctaccaacgacgcctaacccgtcgtccgggggacacgacggccggtcccgtcggggtcctcggcccgtcggtaacgaaacggtaccttaccgttcctaccggttacgcctaccg

SEQ ID NO: 309768 - DNA, 547 bp, Homo sapiens
  misc_feature: GZ8MTXP02F0NI2.51.38.D05.1.454.CMB.2.raw
  modified_base (246)..(246): a, c, t, g, unknown or other
  misc_feature (246)..(246): n is a, c, g, or t
tcagcgatcgtatacacgaccggtgctcgatttagtatctgatagttgggtttgggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactgggaccagcggtgacattggtntttataactatgtctcctggtaccagcaccacccaggcaaacgcccccaaactcatgatttatgatgtcagtgatcggcctgaggggtttcaatcgcttctctggctcagtccgcacgaccgcctcctgaccatctctcggcctcacggccgaggacgaggctgattatactgcagctcatacacaatacaaataacaagttggggtagtttacgggcggaaggaaccaaaacgttcggacccgttaccgtaaggtaccaacggaccccgaaaggccctccggccccctcggtcctacccg

SEQ ID NO: 309769 - DNA, 515 bp, Homo sapiens
  misc_feature: GZ8MTXP02IO1KJ.51.38.D05.1.454.CMB.2.raw
  modified_base (241)..(241): a, c, t, g, unknown or other
  misc_feature (241)..(241): n is a, c, g, or t
tcagcgatcgtatacacgaccggtgctcgatttagtatctgatagttgggtttggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactgggaccagcggtgacattggtnttataactatgtctctggtaccagcaccaccaggcaaacgcccccaaactcatgatttatgatgtcagtgatcggcctcgaggggtttcaatcgcttctctgctcaagtccgcaacacggcctccctgaccatctctgccctcacggccgaggacgaggctgattatctgcagctcatatacaatcaaataacaattgggtgttcggacggtacggaccaaatcgaaccgtcgtacgtcagcccaaggcctacgccccctggtccactctcccg

SEQ ID NO: 309770 - DNA, 573 bp, Homo sapiens
  misc_feature: GZ8MTXP02G5WMA.51.38.D05.1.454.CMB.2.raw
  modified_base (247)..(247): a, c, t, g, unknown or other
  misc_feature (247)..(247): n is a, c, g, or t
  modified_base (309)..(309): a, c, t, g, unknown or other
  misc_feature (309)..(309): n is a, c, g, or t
tcagcgatcgtatacacgaccggtgctcgatttagtatctgatagttgggtttggggtggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcacgtgggaccagcggtgactagttggtntttataactatgtctcctggtaccagcaccacccaggcaaacgccccaaactcatgatttangatgtcagtgatcggccctgaggggttcatccgcttctctggcctccgaacgtcccggacaaacgtaccggccctcccgtgaccctactctctcggccctccgaggcccgaggccgaggctgtattatactgacagctacatatacaatacgaataacgtaagttgggtgttacggacgggtacgggaaccaaacgtcggaacccgttcgtacggtccacgaacccgaaggcccgtacgacccccgtcggtaccacctttcccg

SEQ ID NO: 309771 - DNA, 547 bp, Homo sapiens
  misc_feature: GZ8MTXP02IJ4PA.51.38.D05.1.454.CMB.2.raw
  modified_base (246)..(246): a, c, t, g, unknown or other
  misc_feature (246)..(246): n is a, c, g, or t
  modified_base (373)..(373): a, c, t, g, unknown or other
  misc_feature (373)..(373): n is a, c, g, or t
  modified_base (378)..(378): a, c, t, g, unknown or other
  misc_feature (378)..(378): n is a, c, g, or t
  modified_base (381)..(381): a, c, t, g, unknown or other
  misc_feature (381)..(381): n is a, c, g, or t
  modified_base (400)..(400): a, c, t, g, unknown or other
  misc_feature (400)..(400): n is a, c, g, or t
  modified_base (426)..(426): a, c, t, g, unknown or other
  misc_feature (426)..(426): n is a, c, g, or t
tcagcgatcgtatacacgaccggtgctcgatttagtatctgatagttgggtttgggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactgggaccagcggtgacattggtntttataactatgtctctggtaccagcaccaccaggcaaacgccccccaaatcatgatttatgatgtcagtgatcggccctgaggggtttcaatcgcttctctggctccagtccgcaacacgccctcngaccntcnctgcctcagccgaggacgnggctgattattacgtgcagctcatanacaatcaaagtacaagtttgggtgttcggagggaaacgggacctaaaacgtcggacccgtaccgtaggtaccaacggtaccccgaaaggtcccttaccggcccccgttcggtacctacccg

SEQ ID NO: 309772 - DNA, 622 bp, Homo sapiens
  misc_feature: GZ8MTXP02GS4SG.51.38.D05.1.454.CMB.2.raw
  modified_base (319)..(319): a, c, t, g, unknown or other
  misc_feature (319)..(319): n is a, c, g, or t
  modified_base (332)..(332): a, c, t, g, unknown or other
  misc_feature (332)..(332): n is a, c, g, or t
tcagcgatcgtatacacgaccggtgctcgatttagtatctgatagttgggtttgggggaggcgtggtccagcctgggaggtccctgagactcgcctgtaaaccgtccggattcaccttcagtaactatgcaatgcactgggtccgccaggctccaggcaaggggctggactgggtggcaggcatatcatttgatggaagcaagaagtactatgcagactccgtgaagggccgattcaccatctccagagacagttccgatgacacagtctatctacacatgagcagtgtgagacctgacgacacggtcttctttttacngtgcgccaggaancagtgctggccacatcatgcttttgatatctgacgaccaaagggacaaagtcggtacagttcgtccttccgttccggcccctacccgaacccgtaaacgggccccctaacgttcccggttccctttccccccgtcgggccctaaccccccgttccctacccgaaaacgacgtacccgaacccgttccggtcgggggaccaccgacggccccggtcccgttcggggccttccggcccgttcggtaaccgaaacgggtacccttaccgttcccgtacggtacgtacctaccg

SEQ ID NO: 309773 - DNA, 579 bp, Homo sapiens
  misc_feature: GZ8MTXP02H33QQ.51.38.D05.1.454.CMB.2.raw
  modified_base (252)..(252): a, c, t, g, unknown or other
  misc_feature (252)..(252): n is a, c, g, or t
  modified_base (312)..(312): a, c, t, g, unknown or other
  misc_feature (312)..(312): n is a, c, g, or t
tcagcgatcgtatacacgaccggtgctcgatttagtatctgatagttgggtttgggggggtctcaggaggcagcgctctcgggacgtctccaccatggcctgggctctgctattcctcaccctcctcactcagggcacagggtcctgggcccagtctgccctgactcagcctgcctccgtgtctgggtctctggacagtcatcaccatctcctgcacgtgggaccagcggtgactagtttggttagttttanaacttattgtctcctggtaccagccaccaccaggacaaacgcccccaaatcatgatttangatgtcagtgagtccggcctgtaggggtttcaatcgtcctctctggctcaacggtccgcaaaccgaccggccctccctagacccatcctctacggcctccgacggccgagggacgaggtctagaactttatactagcacgcttacaatactacaaataacaaattaaacgagtttgggtacgttacgggacggaacggacccaaagtacgaccgtaccgtacgcaacgaccgaaggcctaccgccccgtagtcctactccttccccg

SEQ ID NO: 309774 - DNA, 559 bp, Homo sapiens
  misc_feature: GZ8MTXP02GECUD.51.38.D05.1.454.CMB.2.raw
tcagcgatcgtatacacgaccggtgctcgatttagtatctgatagttgggtttgggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactgggaccagcggtgacattggtgtttataactatgtctcctggtaccagcaccaccaggcaaacgcccccaaactcatgattatgatgtcagtgatcggcctgaggggtttcaactcgcttctctggctcagtccgcaacacggcctcctgaccatctctcggcctccgaggccgaggacgagggctgtattattactgcagctcatatacaatcaaataactaagttgggtgtttacgggacgggaacggggaaacctaaaacgtcggtaacccgtccgtaaggttaccgaacgcccgaaaggccctaccggacccccttcggtaccttaccccg

SEQ ID NO: 309775 - DNA, 555 bp, Homo sapiens
  misc_feature: GZ8MTXP02IEZAP.51.38.D05.1.454.CMB.2.raw
  modified_base (310)..(310): a, c, t, g, unknown or other
  misc_feature (310)..(310): n is a, c, g, or t
  modified_base (316)..(316): a, c, t, g, unknown or other
  misc_feature (316)..(316): n is a, c, g, or t
  modified_base (377)..(377): a, c, t, g, unknown or other
  misc_feature (377)..(377): n is a, c, g, or t
  modified_base (399)..(399): a, c, t, g, unknown or other
  misc_feature (399)..(399): n is a, c, g, or t
  modified_base (409)..(409): a, c, t, g, unknown or other
  misc_feature (409)..(409): n is a, c, g, or t
  modified_base (455)..(455): a, c, t, g, unknown or other
  misc_feature (455)..(455): n is a, c, g, or t
  modified_base (518)..(518): a, c, t, g, unknown or other
  misc_feature (518)..(518): n is a, c, g, or t
tcagcgatcgtatacacgaccggtgctcgatttagtatctgatagttgggtttgggggctggggtctcaggaggcagcgctctcgggacgtctccaccatggcctgggctctgctattcctcaccctcctcactcagggcacagggtcctgggcccagtctgccctgactcagcctgcctcgtgtctggtctcctggacagtcgatcaccatctcctgcactgggaccagcggtgactattggttgtttataactatgtctcctggtaccagcacccacccaggcaaacgcccccaaactcatgatttangatgtnagtgactccggcccctcgtaggggtttcaactcgcttctctggcctccaggtccgacaacnccggcctccctgacccatctcncggcctccgnggccgaggacgaggctagtattagttactgccagctcaatactaanatacaataaactaagttgggtggttcggacggagggacccaaacgtcggaccgtacgtacgtnaacgacccgaacggctcccgacccgtccggtactccc

SEQ ID NO: 309776 - DNA, 599 bp, Homo sapiens
  misc_feature: GZ8MTXP02JCQOJ.51.38.D05.1.454.CMB.2.raw
  modified_base (473)..(473): a, c, t, g, unknown or other
  misc_feature (473)..(473): n is a, c, g, or t
tcagcgatcgtatacacgaccggtgctcgatttagtatctgatagttgggtttgggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcacgtgggaccaggcggtgactagtttggttgtttataactatgtctcctggtaccagcaccacccaggacaaacgcccccaaactcatgatttatgatgtacagtgatccggccctcgtacggggtttacaactcgtcttctctcggccttccgacggtccggacaaaccgtacccgggccctcccgtacgacccatcccttcgtcggccctccgaggcccgaggacgaggctgatttatacgtgcagctanatactacaatactaaataactaagttggggtagttaccgggaggtaaacgggacctaaaacgtccgtaaccgtaccgtagtccgaacgacccgaacggccgtaccgcccccgtcggtacctacccg

SEQ ID NO: 309777 - DNA, 512 bp, Homo sapiens
  misc_feature: GZ8MTXP02HU3XS.51.38.D05.1.454.CMB.2.raw
  modified_base (242)..(242): a, c, t, g, unknown or other
  misc_feature (242)..(242): n is a, c, g, or t
  modified_base (248)..(248): a, c, t, g, unknown or other
  misc_feature (248)..(248): n is a, c, g, or t
  modified_base (253)..(253): a, c, t, g, unknown or other
  misc_feature (253)..(253): n is a, c, g, or t
  modified_base (305)..(305): a, c, t, g, unknown or other
  misc_feature (305)..(305): n is a, c, g, or t
  modified_base (375)..(375): a, c, t, g, unknown or other
  misc_feature (375)..(375): n is a, c, g, or t
  modified_base (424)..(424): a, c, t, g, unknown or other
  misc_feature (424)..(424): n is a, c, g, or t
  modified_base (496)..(496): a, c, t, g, unknown or other
  misc_feature (496)..(496): n is a, c, g, or t
tcagcgatcgtatacacgaccggtgctcgatttagtatctgatagttgggtttgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactgggaccagcggtgacattggtntttaanaactntgtctcctggtaccagcaccacccaggcaaacgcccccaaatcatgatttangatgtcagtgatcggccctgaggggtttcatcgcttctctgctcagtcgcacacgcctccctgaccatcnctggccctcgaggccgaggacgaggctagattatactgcagctacatanacatacaataacagttggtgttggcggtacggacaaagtcgaccgtctacgtcacgccgaagcacgtccccnggtaccacttctcccg

SEQ ID NO: 309778 - DNA, 534 bp, Homo sapiens
  misc_feature: GZ8MTXP02GI015.51.38.D05.1.454.CMB.2.raw
  modified_base (286)..(286): a, c, t, g, unknown or other
  misc_feature (286)..(286): n is a, c, g, or t
  modified_base (521)..(521): a, c, t, g, unknown or other
  misc_feature (521)..(521): n is a, c, g, or t
tcagcgatcgtatacacgaccggtgctcgatttagtatctgatagttgggtttgggggctttgcctgggctctgctattcctcaccctcctcactcagggcacagggtcctgggcccagtctgccctgactcagcctgcctccgtgtctgggtctcctggacagtcgatcaccatctcctgcactgggaccagcggtgacattggtgtttataactatgtctcctggtaccagcaccacccaggcaaagccccaaatcatgatttatgatgtcagtgatcggcctnaggggtttcaatcgcttctctggctccaagtccggcaacacggcctccctgaccccatctctgcctccaggccgagacgaggctgatttatactgcagctcatatacaatcaaataacaattgggtagttcggacggagggaccaaacgtcgaaccgtccgtaggtcacgaccccgaagggcctcgcccccgtcggtcacttctcgttccccacccttctctcgtaagctactcncgagcggcgtcgg

SEQ ID NO: 309779 - DNA, 514 bp, Homo sapiens
  misc_feature: GZ8MTXP02GF9GX.51.38.D05.1.454.CMB.2.raw
  modified_base (241)..(241): a, c, t, g, unknown or other
  misc_feature (241)..(241): n is a, c, g, or t
  modified_base (301)..(301): a, c, t, g, unknown or other
  misc_feature (301)..(301): n is a, c, g, or t
tcagcgatcgtatacacgaccggtgctcgatttagtatctgatagttgggtttggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactgggaccagcggtgacattggtntttataactatgtctcctggtaccagcacacccaggcaaagcccccaaatcatgatttangatgtcagtgatcggccctcaggggtttcaatcgcttctctggctcaagtccggcaacacggcctccctgaccatctctggccctcaggccgaggacgaggctgattatactgcagctcatatacaatcaaagtaacaattgggtagtcggcgtagggaccaaatcgaccgtctaggtcagcccaaggctcgcccctcggtcacgtctacccg

SEQ ID NO: 309780 - DNA, 591 bp, Homo sapiens
  misc_feature: GZ8MTXP02JYKHA.51.38.D05.1.454.CMB.2.raw
  modified_base (242)..(242): a, c, t, g, unknown or other
  misc_feature (242)..(242): n is a, c, g, or t
tcagcgatcgtatacacgaccggtgctcgatttagtatctgatagttgggtttgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactgggaccagcggtgacattggtntttataactatgtctcctggtaccagcaccacccaggacaaacgcccccaaactcatgatttatgatgtcagtgatccggcctcgtaggggtttcaatcgccttctctggctcaagtccggcaacacggccctccctgaccatctctcggccctcgacggccgaggacgaggctgattattactgcagctcatataacaatacaaataactaagttggggtagttacgggacgggtaacgggaaaccctaaacgtcggtaacccgttaccgtaacggtaccaacggaccccgaaagggtcccttaccggacccccccgttcggtaccctaaccgttcctttacccccgg

SEQ ID NO: 309781 - DNA, 550 bp, Homo sapiens
  misc_feature: GZ8MTXP02IXO84.51.38.D05.1.454.CMB.2.raw
  modified_base (255)..(255): a, c, t, g, unknown or other
  misc_feature (255)..(255): n is a, c, g, or t
  modified_base (274)..(274): a, c, t, g, unknown or other
  misc_feature (274)..(274): n is a, c, g, or t
  modified_base (310)..(310): a, c, t, g, unknown or other
  misc_feature (310)..(310): n is a, c, g, or t
  modified_base (349)..(349): a, c, t, g, unknown or other
  misc_feature (349)..(349): n is a, c, g, or t
  modified_base (368)..(368): a, c, t, g, unknown or other
  misc_feature (368)..(368): n is a, c, g, or t
  modified_base (428)..(428): a, c, t, g, unknown or other
  misc_feature (428)..(428): n is a, c, g, or t
tcagcgatcgtatacacgaccggtgctcgatttagtatctgatagttggggtttggggggggtctcaggaggcagcgctctcgggacgtctccaccatggcctgggctctgctattcctcaccctcctcactcagggcacagggtcctgggcccagtctgccctgactcagcctgccctccgtgtctggggtctcctggacagtcgatcaccatctcctgcacgtgggaccagcggtgactagttggtgtttaanaactatgtctctggtaccngcaccaccaggcaaacgcccccaaatcatgatttancgatgtcagtgatcggcctgagggtttcaatcgccttcncgtgctcaacgtcgcaacncggacctcctgacatctcgcgccctcgaggcgaggtcgagctgattagtactgacagctnatataacaatacgaaataacgaagttggtagtacggcggaaacgggaccaaacgtcgaaaccgttcgtacggacacgaccgaaacggtcctccgccccgtaggtcctacgttccgtttcccg

SEQ ID NO: 309782 - DNA, 520 bp, Homo sapiens
  misc_feature: GZ8MTXP02HNUMC.51.38.D05.1.454.CMB.2.raw
  modified_base (211)..(211): a, c, t, g, unknown or other
  misc_feature (211)..(211): n is a, c, g, or t
  modified_base (267)..(267): a, c, t, g, unknown or other
  misc_feature (267)..(267): n is a, c, g, or t
  modified_base (287)..(287): a, c, t, g, unknown or other
  misc_feature (287)..(287): n is a, c, g, or t
  modified_base (499)..(499): a, c, t, g, unknown or other
  misc_feature (499)..(499): n is a, c, g, or t
  modified_base (506)..(506): a, c, t, g, unknown or other
  misc_feature (506)..(506): n is a, c, g, or t
  modified_base (512)..(512): a, c, t, g, unknown or other
  misc_feature (512)..(512): n is a, c, g, or t
  modified_base (519)..(519): a, c, t, g, unknown or other
  misc_feature (519)..(519): n is a, c, g, or t
tcagcgatcgtatacacgaccggtgctcgatttagtatctgatagttgggtttggggctttgcctgggctctgctattcctcaccctcctcactcagggcacagggtcctgggcccagtctgccctgactcagcctgcctccgtgtctgggtctcctggacagtcgatcaccatctcctgcactgggaccagcggtgacattggtgtttanaactatgtctcctggtaccagcaccacccaggcaaagcccccaaatcatgatttangatgtcagtgatcggccctnaggggtttcaatcgcttctctggctccaagtccggcaaacacggcctccctgaccccatctctcggcctccagggccgaggacaggctgattatactgcagctcatatacaatcaaagtaacaattgggtagttcggacggagggaccaaactggaccgtcgtacggtcacgccaaggctcgcccctcggtcactctcgtccaccctctacncgtaacncactcngcgcgcng

SEQ ID NO: 309783 - DNA, 529 bp, Homo sapiens
  misc_feature: GZ8MTXP02HWV23.51.38.D05.1.454.CMB.2.raw
  modified_base (319)..(319): a, c, t, g, unknown or other
  misc_feature (319)..(319): n is a, c, g, or t
  modified_base (331)..(331): a, c, t, g, unknown or other
  misc_feature (331)..(331): n is a, c, g, or t
  modified_base (455)..(455): a, c, t, g, unknown or other
  misc_feature (455)..(455): n is a, c, g, or t
  modified_base (518)..(518): a, c, t, g, unknown or other
  misc_feature (518)..(518): n is a, c, g, or t
tcagcgatcgtatacacgaccggtgctcgatttagtatctgatagttgggtttgggggaggcgtggtccagcctgggaggtccctgagactcgcctgtaaaccgtccggattcaccttcagtaactatgcaatgcactgggtccgccaggctccaggcaaggggctggactgggtggcaggcatatcattttgatggaagcaagaagtactatgcagactccgtgaagggccattcaccatctccagagacagttccgatgacacagtctatctacacatgagcagtgtgagacctgacgacacggtcttctttttacngtgcgccaggancagtggctggccacatcatgtctttttgattatctggacgccaaagggacaaatggtcatcgtctcttcgcctccacaacggcctacgtcgttccttcccctggcccaccctcctaccaacgcnccacctcgtcggggcacgacgccgcccgtcggccgtcgccgtggtcgacggtactacgttccncgtacgctacg

SEQ ID NO: 309784 - DNA, 645 bp, Homo sapiens
  misc_feature: GZ8MTXP02IDLXA.51.38.D05.1.454.CMB.2.raw
  modified_base (319)..(319): a, c, t, g, unknown or other
  misc_feature (319)..(319): n is a, c, g, or t
tcagcgatcgtatacacgaccggtgctcgatttagtatctgatagttgggtttgggggaggcgtggtccagcctgggaggtccctgagactcgcctgtaaaccgtccggattcaccttcagtaactatgcaatgcactgggtccgccaggctccaggcaaggggctggactgggtggcaggcatatcattttgatggaagcaagaagtactatgcagactccgtgaagggcattcacatctccagagacagttccgatgacacagtctatctacacatgagcagtgtgacgacctgacgacacggtcttcttttttacngttgcgccaggaacgcgagtcggctcggccacgatcatgtctttttgattatctgggacgacccgaaaggggaacctaaagtcggttactaacgttccgttccttccgttcccgggcccttacccgaaccccgaaacggggtccccctaacgtcccgggtttcccttccccccgttcgggcccctacccccgttcccacccgaaacgccgccgaccgttccggtcgggggacccacggaccggcccggtccccggtgggtcccgtcggtccctcgggtaaccgaaccgggtacttacccgttccgtaccggtacgtcccttaaccg

SEQ ID NO: 309785 - DNA, 582 bp, Homo sapiens
  misc_feature: GZ8MTXP02HZGML.51.38.D05.1.454.CMB.2.raw
  modified_base (312)..(312): a, c, t, g, unknown or other
  misc_feature (312)..(312): n is a, c, g, or t
  modified_base (339)..(339): a, c, t, g, unknown or other
  misc_feature (339)..(339): n is a, c, g, or t
tcagcgatcgtatacacgaccggtgctcgatttagtatctgatagttgggtttgggggaggcgtggtccagcctgggaggtccctgagactcgcctgtaaaccgtccggattcaccttcagtaactatgcaatgcactgggtccgccaggctccaggcaaggggctggactgggtgcaggcatatcatttgatggaagcaagaagtactatgcagactcgtgaaggccatcacatctcagagacagttccgatgacacagtctatctacacatgagcagtgtgagacctgacgacacggcttcttttttacngttgcgccaggaagcagtgctggccanatcatgtctttgatatcgtaggagaccaagggacaagtggtcagttcgtctcttcggccctccaccgacgggccccagttccggtcccttcccccgtcggacccaccccgttccctacccaacgacgacccgtacctccgtacgggggccacgacgggcccggtccccggttggggccctcggacccgttcgggtaaccgaaacgggtaccttaccgttcccgtaccgttacggacctaaccg

SEQ ID NO: 309786 - DNA, 605 bp, Homo sapiens
  misc_feature: GZ8MTXP02JRJMO.51.38.D05.1.454.CMB.2.raw
  modified_base (266)..(266): a, c, t, g, unknown or other
  misc_feature (266)..(266): n is a, c, g, or t
  modified_base (375)..(375): a, c, t, g, unknown or other
  misc_feature (375)..(375): n is a, c, g, or t
tcagcgatcgtatacacgaccggtgctcgatttagtatctgatagttgggtttgggggctttgcctgggctctgctattcctcaccctcctcactcagggcacagggtcctgggcccagtctgccctgactcagcctgcctccgtgtctgggtctcctggacagtcgatcaccatctcctgcactgggaccagcggtgacattggtgtttataactatgtctcctggtaccagcaccaccaggcaaacgccccaaatcatgattangatgtcagtgactcggcctgtaggggtttcatcgcttctctggctccgaagtccggacaacgaccggcctccctgaccccatcctctcggcctccgaggccgaggacgnggctgtatttatactgcagctacatataacaatacaaataacgtaagttcgggttagtacgggacggtaacgggaacctaaacgtcggtaaccgtaccgtaggtaccgacgacccgaaacggtccctaccggtcccccgttcggtacctaccgtcccgttcccgttcccccgtacccttcccgttcctaccgtaacgaccgaccttcgacggacggtccggggctacggg

SEQ ID NO: 309787 - DNA, 562 bp, Homo sapiens
  misc_feature: GZ8MTXP02F5CS6.51.38.D05.1.454.CMB.2.raw
  modified_base (307)..(307): a, c, t, g, unknown or other
  misc_feature (307)..(307): n is a, c, g, or t
  modified_base (451)..(451): a, c, t, g, unknown or other
  misc_feature (451)..(451): n is a, c, g, or t
tcagcgatcgtatacacgaccggtgctcgatttagtatctgatagttgggtttggggtggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactgggaccagcggtgactattggtgtttataactatgtctcctggtaccagcaccacccaggcaaacgccccaaactcatgatttangatgtcagtgatccggccctcgaggggtttcgaatccgtcttctctggctccaagtcccggacaaacaccggccctcccgtcgacctatcctctcggccctccgaggcccgaggacgaggctgattattactgcagctacatanacaatcaaataactagttgggtgttcgggacggacgggtaaccaaacgtcgaccgtacctaacgggtccacgaacccgaaggcctaccgcccccgtcggtccactttcccg

SEQ ID NO: 309788 - DNA, 499 bp, Homo sapiens
  misc_feature: GZ8MTXP02GXNSL.51.38.D05.1.454.CMB.2.raw
  modified_base (443)..(443): a, c, t, g, unknown or other
  misc_feature (443)..(443): n is a, c, g, or t
  modified_base (451)..(451): a, c, t, g, unknown or other
  misc_feature (451)..(451): n is a, c, g, or t
tcagcgatcgtatacacgaccggtgctcgatttagtatctgatagttgggtttggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactgggaccagcggtgacattggtgtttataactatgtctcctggtaccagcaccaccaggcaaagcccccaaatcatgatttatgatgtcagtgatcggcctcgaggggtttcgaatcgcttctctggctcagtccggcaacacgcctccctgacccatctctggcctcaggccgaggcaggctgattatactgcagctcatatacatcaaatacaattggngttacggnggaggaccaaatcgaccgtcagtcaagccaaggctcgcccctggctac

SEQ ID NO: 309789 - DNA, 581 bp, Homo sapiens
  misc_feature: GZ8MTXP02I2SDX.51.38.D05.1.454.CMB.2.raw
  modified_base (241)..(241): a, c, t, g, unknown or other
  misc_feature (241)..(241): n is a, c, g, or t
  modified_base (439)..(439): a, c, t, g, unknown or other
  misc_feature (439)..(439): n is a, c, g, or t
  modified_base (443)..(443): a, c, t, g, unknown or other
  misc_feature (443)..(443): n is a, c, g, or t
tcagcgatcgtatacacgaccggtgctcgatttagtatctgatagttgggtttggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactgggaccagcggtgacattggtntttataactatgtctctggtaccagcaccaccaggacaaacgcccccaaatcatgtatttatgatgtcagtgatccggcctcgtaggggtttcaagtcgccttctctggctccaagtccggcaacaccggccctcctacgacccatctctcggccctccgacggccgagggacgacggctgtattatactgcagctanatanaacaatacaaattaacaagttgggtacgttcgggacggtaacgggaaccaaacgtacggtaaccgtaccgtacggtaccgacggacccgaaacggccgtaccggacccccgttcggtaccctacgtccgtttccccgg

SEQ ID NO: 309790 - DNA, 612 bp, Homo sapiens
  misc_feature: GZ8MTXP02IDK9H.51.38.D05.1.454.CMB.2.raw
  modified_base (207)..(207): a, c, t, g, unknown or other
  misc_feature (207)..(207): n is a, c, g, or t
  modified_base (269)..(269): a, c, t, g, unknown or other
  misc_feature (269)..(269): n is a, c, g, or t
  modified_base (401)..(401): a, c, t, g, unknown or other
  misc_feature (401)..(401): n is a, c, g, or t
  modified_base (608)..(608): a, c, t, g, unknown or other
  misc_feature (608)..(608): n is a, c, g, or t
tcagcgatcgtatacacgaccggtgctcgatttagtatctgatagttgggtttgggggctttgcctgggctctgctattcctcaccctcctcactcagggcacagggtcctgggcccagtctgccctgactcagcctgcctccgtgtctgggtctcctggacagtcgatcaccatctcctgcactgggaccagcggtgacattggtntttataactatgtctcctggtaccagcaccaccaggaccaaacgccccaaatcatgatttangatgtcagtgatccggcctgagggtttcaatcgcttctctggctccgaagtccggacaacaccggcctccctgacccccatcctctcggcctaccgacggccgagggacgacggtcctagtactttattacngtacagtctacataactaacaatacaaataactaagttcgggtacgttacgggacgggaacggtaaccaaacgtccggaaccgtcgtaacggtcgaacgtacccgaaaggtccctaccggcccccttcggtacctaccgttccttccgttcccctacccgtccttacccgtcgtaacgtcctaaccgtcgtacggacggcgggtacncggg

SEQ ID NO: 309791 - DNA, 546 bp, Homo sapiens
  misc_feature: GZ8MTXP02GIAJB.51.38.D05.1.454.CMB.2.raw
  modified_base (265)..(265): a, c, t, g, unknown or other
  misc_feature (265)..(265): n is a, c, g, or t
tcagcgatcgtatacacgaccggtgctcgatttagtatctgatagttgggtttggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactgggaccagcggtgacattggtgtttataactatgtctctggtaccngcaccacccaggcaaagcccccaaactcatgatttatgatgtcagtgatcggcctcgaggggtttcaatcgcttctctgctcaagtccgcaacacggcctccctgaccatctctcgccctcgacggccgaggacgaggctagattatactgcagctacatatacaatacaaataactaagttgggtagttcgggacggtaacgggacctaaaacgtcgtaacccgtcgtacggtccaacggcccaaggcctaccgcccccgtcggtcaccttcgtttcccg

SEQ ID NO: 309792 - DNA, 531 bp, Homo sapiens
  misc_feature: GZ8MTXP02GLM8D.51.38.D05.1.454.CMB.2.raw
  modified_base (233)..(233): a, c, t, g, unknown or other
  misc_feature (233)..(233): n is a, c, g, or t
  modified_base (242)..(242): a, c, t, g, unknown or other
  misc_feature (242)..(242): n is a, c, g, or t
  modified_base (247)..(247): a, c, t, g, unknown or other
  misc_feature (247)..(247): n is a, c, g, or t
  modified_base (302)..(302): a, c, t, g, unknown or other
  misc_feature (302)..(302): n is a, c, g, or t
  modified_base (340)..(340): a, c, t, g, unknown or other
  misc_feature (340)..(340): n is a, c, g, or t
  modified_base (355)..(355): a, c, t, g, unknown or other
  misc_feature (355)..(355): n is a, c, g, or t
  modified_base (359)..(359): a, c, t, g, unknown or other
  misc_feature (359)..(359): n is a, c, g, or t
  modified_base (422)..(422): a, c, t, g, unknown or other
  misc_feature (422)..(422): n is a, c, g, or t
  modified_base (427)..(427): a, c, t, g, unknown or other
  misc_feature (427)..(427): n is a, c, g, or t
tcagcgatcgtatacacgaccggtgctcgatttagtatctgatagttgggtttgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactgggaccagcggtnacattggtntttanaactatgtctctggtaccagcaccaccaggcaaacgcccccaaatcatgatttangatgtcagtgatcggcctgaggggtttcatcgccttcnctgctccaagtccgnaacncggcctcctgaccatctctgccctcgaggccgaggacgaggctgatttatactgctagcttanattanaacaatacaaataacgtaggttgggtcgtacgggacggtaacggaactaagtcgaccgtcgtacggtcacgaccgaagccctcgtccccgtgcctacctctccg

SEQ ID NO: 309793 - DNA, 574 bp, Homo sapiens
  misc_feature: GZ8MTXP02GH2UN.51.38.D05.1.454.CMB.2.raw
  modified_base (247)..(247): a, c, t, g, unknown or other
  misc_feature (247)..(247): n is a, c, g, or t
  modified_base (459)..(459): a, c, t, g, unknown or other
  misc_feature (459)..(459): n is a, c, g, or t
tcagcgatcgtatacacgaccggtgctcgatttagtatctgatagttgggtttgggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactgggaccagcggtgactattggtntttataactatgtctcctggtaccagcaccacccaggacaaacgcccccaaatcatgatttatgatgtcagtgatcggccctcgtaggggtttcaactcgcttctctggcttccaggtcccgacaaaccgaccggccctccctacgaccctattcctccgtcggaccctcccaggggacccgacggacggagggcctagtatttacttacgnggtcagctacaatactaacaatacaaattaacaagtttgggagttacgggacggtagggaaacccaaagtcgaccgtaccagtcaacgtccaagcctacgcccctcggtctaccg

SEQ ID NO: 309794 - DNA, 536 bp, Homo sapiens
  misc_feature: GZ8MTXP02JEQPO.51.38.D05.1.454.CMB.2.raw
tcagcgatcgtatacacgaccggtgctcgatttagtatctgatagttgggtttggggtggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactgggaccagcggtgactattggtgtttataactatgtctcctggtaccagcaccacccaggcaaacgcccccaaatcatgatttatgatgtcagtgatccggccctgaggggtttcaatccgcttctctggctccaagtccggcaaacgccggccctccctgacccatcctctcggccctcgaggcccgaggacgaggctgattatactgcagctcatatacaatcaaataacagttgggtgtacggacggaacgggtacaaaacgtgaccgtcctaaggccagcccgaaggcctcggccccctggtcacttccg

SEQ ID NO: 309795 - DNA, 559 bp, Homo sapiens
  misc_feature: GZ8MTXP02HZ4XM.51.38.D05.1.454.CMB.2.raw
  modified_base (320)..(320): a, c, t, g, unknown or other
  misc_feature (320)..(320): n is a, c, g, or t
  modified_base (350)..(350): a, c, t, g, unknown or other
  misc_feature (350)..(350): n is a, c, g, or t
tcagcgatcgtatacacgaccggtgctcgatttagtatctgatagttgggtttgggggaggcgtggtccagcctgggaggtccctgagactcgcctgtaaaccgtccggattcaccttcagtaactatgcaatgcactgggtccgccaggctccaggcaaggggctggactgggtggcaggcatatcattttgatggaagcaagaagtactatgcagactccgtgaagggccgattcaccatctccagagacagttccgatgacacagtctatctacacatgagcagtgtgagactgacgacacggtcttcttttttacngtgcgcaggaagcagtggctggccacatcntgtctttttgattatctaggacgccaaaggggacaagtggtcatcgtcttcttccggcctccaccgaacgggcccagtccggtccttcccccgtggcccacccgtcctaccacgacgccacctcgtcgggggcacgacggccgcccgtgggcctcggccgtggtccgaaacgggtaccttaccgttcccgtaccggttacgacctaccg

SEQ ID NO: 309796 - DNA, 620 bp, Homo sapiens
  misc_feature: GZ8MTXP02IPH5Y.51.38.D05.1.454.CMB.2.raw
  modified_base (234)..(234): a, c, t, g, unknown or other
  misc_feature (234)..(234): n is a, c, g, or t
  modified_base (244)..(244): a, c, t, g, unknown or other
  misc_feature (244)..(244): n is a, c, g, or t
  modified_base (255)..(255): a, c, t, g, unknown or other
  misc_feature (255)..(255): n is a, c, g, or t
tcagcgatcgtatacacgaccggtgctcgatttagtatctgatagttgggtttgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactgggaccagccggtnactattggtntttaataactntgtctctggtaccagcaccacccaggccaaacgcccccaaactcatgatttatgatgtcagtgatcggcctcgtaggggtttcgaatcgccttctctggcctccaagtcccgcaaccgaccggccctccctgaccatcctcgtcgccctccgacggccgaggacgaggtctagtattatacgtgactacgcttacattaactaacaaattacaaaagttaactaaaggtttggggttacgttaccggggacgggtaacgggaccgtaaaacgtcggtaaacccgttaccggtacgggttaccacggaaccccgaaaagtcccgttaccgaccccccgttcggtaccctaccgttccgtttccccg

SEQ ID NO: 309797 - DNA, 563 bp, Homo sapiens
  misc_feature: GZ8MTXP02IDDYB.51.38.D05.1.454.CMB.2.raw
  modified_base (245)..(245): a, c, t, g, unknown or other
  misc_feature (245)..(245): n is a, c, g, or t
  modified_base (251)..(251): a, c, t, g, unknown or other
  misc_feature (251)..(251): n is a, c, g, or t
  modified_base (308)..(308): a, c, t, g, unknown or other
  misc_feature (308)..(308): n is a, c, g, or t
  modified_base (452)..(452): a, c, t, g, unknown or other
  misc_feature (452)..(452): n is a, c, g, or t
tcagcgatcgtatacacgaccggtgctcgatttagtatctgatagttgggtttggggtggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactgggaccagcggtgacatttggtntttaanaactatgtctctggtaccagcaccacccaggacaaacgcccccaaatcatgatttangatgtcagtgatcggccctgaggggtttcaatccgcttctctggctaccgaagtcccgggacaacaccgggccctccctgaccctatcctcgtcggccctccgacggcccgaaggaccgaggctagattatactgcacgtctanatatacaatacaaataaactaagttgggtgttacgggacggaagggacccaaaacgtcgaaccgtcgtaacgtcacgccgaacggcgtacgcccccgtcggtacacttccg

SEQ ID NO: 309798 - DNA, 554 bp, Homo sapiens
  misc_feature: GZ8MTXP02G4JFA.51.38.D05.1.454.CMB.2.raw
  modified_base (241)..(241): a, c, t, g, unknown or other
  misc_feature (241)..(241): n is a, c, g, or t
  modified_base (246)..(246): a, c, t, g, unknown or other
  misc_feature (246)..(246): n is a, c, g, or t
  modified_base (302)..(302): a, c, t, g, unknown or other
  misc_feature (302)..(302): n is a, c, g, or t
  modified_base (341)..(341): a, c, t, g, unknown or other
  misc_feature (341)..(341): n is a, c, g, or t
tcagcgatcgtatacacgaccggtgctcgatttagtatctgatagttgggtttggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactgggaccagcggtgacattggtntttanaactatgtctcctggtaccagcaccacccaggcaaagcccccaaatcatgatttangatgtcagtgatcggccctgaggggtttcaatcgcttcnctggctcaagtccgcaacacgcctcctgacatctctgccctcgaggccgaggacgaggctagtatttactactgacagctacatactaacaatacaaataaacgtaagttggggtagttcgggacggaacgggaacccaaaacgtcggaacccgttccgttaacggtaccacggacccaaggcctccgccccctggtcccactcgtttacccg

SEQ ID NO: 309799 - DNA, 646 bp, Homo sapiens
  misc_feature: GZ8MTXP02HZBM5.51.38.D05.1.454.CMB.2.raw
  modified_base (244)..(244): a, c, t, g, unknown or other
  misc_feature (244)..(244): n is a, c, g, or t
  modified_base (250)..(250): a, c, t, g, unknown or other
  misc_feature (250)..(250): n is a, c, g, or t
  modified_base (307)..(307): a, c, t, g, unknown or other
  misc_feature (307)..(307): n is a, c, g, or t
tcagcgatcgtatacacgaccggtgctcgatttagtatctgatagttgggtttgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactgggaccaggcggtgacagttggtntttaanaactatgtctcctgtaccagcaccaccaggacaaacgcccccaaatcatgattttangtatgtctagtgatccggcccttggaggggtttccaagttcgtcctttctcgtcggcctaccgaacggtcccgcaaaccgaccggtcccttccccgtacgaaccctattcccttccgtcggcccctcgacgggacccgaagggacgacggcttagtaatttattacgtgtaccagtccttacaattaactaacctaaatacaaaatttaacgtaagtttacggggtagttacgggacgggtaacgggaaacctaaaacgtcgtaacccggttacgtacggtaccaacggaccccaaaggtccctacccggtccccctacggtccacctttccgtacccg

SEQ ID NO: 309800 - DNA, 570 bp, Homo sapiens
  misc_feature: GZ8MTXP02H0ONQ.51.38.D05.1.454.CMB.2.raw
  modified_base (310)..(310): a, c, t, g, unknown or other
  misc_feature (310)..(310): n is a, c, g, or t
  modified_base (391)..(391): a, c, t, g, unknown or other
  misc_feature (391)..(391): n is a, c, g, or t
  modified_base (434)..(434): a, c, t, g, unknown or other
  misc_feature (434)..(434): n is a, c, g, or t
tcagcgatcgtatacacgaccggtgctcgatttagtatctgatagttgggtttgggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcacgtgggaccaggcggtgactagtttggtgtttaataactatgtctctggtaccagcaccaccagacaaagcccccaaatcatgattangatgtcagtgatcggccctgaggggttcaactcgcttctctggctcagtccggacaaccgaccgcctccctgacccatccnctcggccctcgacgccgaggacgaggctgtattattactgacngctacaactataaacaatacaaataaacgtagtttggggtacgttacgggacggaacggggaaacctaaacgtcggtacccgtacgtacggtaccaacgacccgaacggtcctccgcccccgtacggtacctcccg

SEQ ID NO: 309801 - DNA, 575 bp, Homo sapiens
  misc_feature: GZ8MTXP02GOEGW.51.38.D05.1.454.CMB.2.raw
  modified_base (318)..(318): a, c, t, g, unknown or other
  misc_feature (318)..(318): n is a, c, g, or t
  modified_base (344)..(344): a, c, t, g, unknown or other
  misc_feature (344)..(344): n is a, c, g, or t
  modified_base (347)..(347): a, c, t, g, unknown or other
  misc_feature (347)..(347): n is a, c, g, or t
tcagcgatcgtatacacgaccggtgctcgatttagtatctgatagttgggtttgggggaggcgtggtccagcctgggaggtccctgagactcgcctgtaaaccgtccggattcaccttcagtaactatgcaatgcactgggtccgccaggctccaggcaaggggctggactgggtggcaggcatatcatttgatggaagcaagaagtactatgcagactccgtgaagggccattcaccatctccagagacagttccgatgacacagtctatctacacatgagcagtgtgagacctgacgacacggtcttctttttacngtgcgccaggaagcagtgctggccantcntcgtctttttagatatcgtgggacaccgaaagggacaagtggtcaattcgtcttcgttccggccctaccgaccaacgggcccagttcccggtccttcccccgtggcccaccccctcctaccaacgacgccaaccgtcgcgggggaccacgacggcccggcccgtcgggccctcgcccgttggtaaccgtaacgggtaccttaccgttcccgtacggttaccgctaccg

SEQ ID NO: 309802 - DNA, 566 bp, Homo sapiens
  misc_feature: GZ8MTXP02IG8K1.51.38.D05.1.454.CMB.2.raw
  modified_base (309)..(309): a, c, t, g, unknown or other
  misc_feature (309)..(309): n is a, c, g, or t
  modified_base (398)..(398): a, c, t, g, unknown or other
  misc_feature (398)..(398): n is a, c, g, or t
  modified_base (451)..(451): a, c, t, g, unknown or other
  misc_feature (451)..(451): n is a, c, g, or t
  modified_base (464)..(464): a, c, t, g, unknown or other
  misc_feature (464)..(464): n is a, c, g, or t
tcagcgatcgtatacacgaccggtgctcgatttagtatctgatagttgggtttgggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactgggaccagcggtgactattggtagtttataactatgtctcctggtaccagcaccacccaggcaaagcccccaaatcatgatttangatgtcagtgatcggccctgaggggtttcaatcgcttctctggcctccagtcccggacaaaccgaccgcccctcccgtgacccagttcncctcggccctccgaggcccgaggacgaggctgattattactgcagctcattanacaatcaaagtanaagttggggtgttacgggacggagggaaccctaaaacgtcggaacccgtacgtacggtacaacgaccccgaaaggtcctacggcccccttggaccctacccg

SEQ ID NO: 309803 - DNA, 631 bp, Homo sapiens
  misc_feature: GZ8MTXP02IJUEE.51.38.D05.1.454.CMB.2.raw
  modified_base (320)..(320): a, c, t, g, unknown or other
  misc_feature (320)..(320): n is a, c, g, or t
  modified_base (347)..(347): a, c, t, g, unknown or other
  misc_feature (347)..(347): n is a, c, g, or t
tcagcgatcgtatacacgaccggtgctcgatttagtatctgatagttgggtttgggggaggcgtggtccagcctgggaggtccctgagactcgcctgtaaaccgtccggattcaccttcagtaactatgcaatgcactgggtccgccaggctccaggcaaggggctggactgggtggcaggcatatcatttgatggaagcaagaagtactatgcagactccgtgaagggccgattcaccatctccagagacagttccgatgacacagtctatctacacatgagcagtgtgagacctgacgacacggtcttctttttacgngtgcgaccaggaagcagtgctggccanatcatgtcttttgatatcgtaggtagaccgaagggacaagtgtctagttcgtcttcgttcggccctaccgaaccgaaacgggtcccctagttcccgggtttcccttcccccgttggaccccctacccctcctaccgaacgtcgaccgtacccgtcggtcgggggaccaaacggccgggaccgggtaccccggtcggggtcccgtacgggtcccgttacggggtaacccgtaaacggggtaccctttaaccgtttaccccggtaccggttaacggccttaacccg

SEQ ID NO: 309804 - DNA, 552 bp, Homo sapiens
  misc_feature: GZ8MTXP02FQJ6Y.51.38.D05.1.454.CMB.2.raw
tcagcgatcgtatacacgaccggtgctcgatttagtatctgatagttgggtttgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcacgtgggaccagcggtgactagtttggtgtttaataactatgtctcctggtaccagcaccacccaggcaaacgcccccaaactcatgatttatgatgtcagtgatcggccctcgtaggggttcaatcgcttctctggctccaagtccggcaacacggcctccctgaccatctctggccctcgacggccgaggacgagctgtattatactgcagctacatatacaatcaaataactaattgggtagttcgggacggtaacgggaccaaacgtcgtaccgtactacggtacacgacccgaagccgtacgcccccgttcggtccactcctttaccccg

SEQ ID NO: 309805 - DNA, 678 bp, Homo sapiens
  misc_feature: GZ8MTXP02GZ3IR.51.38.D05.1.454.CMB.2.raw
  modified_base (247)..(247): a, c, t, g, unknown or other
  misc_feature (247)..(247): n is a, c, g, or t
  modified_base (306)..(306): a, c, t, g, unknown or other
  misc_feature (306)..(306): n is a, c, g, or t
tcagcgatcgtatacacgaccggtgctcgatttagtatctgatagttgggtttgggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactgggaccagcggtgactattggtntttataactatgtctctggtaccagcaccaccaggcaaacgccccaaatcatgatttanagtatgtcagtgactccggcctcgaggggtttcaacgtcgtcttctctcggtcctacgacggtcccggacaaaccgccggtccctacccgtcgaaccctatccgtccgtcggcccttcccggaacgggcccggaacgggacgacgggtcttacgtaatttaacgttaccgtggaccgtacgtaccttaccgtaaattaactaaaccgtaaacttaacaaaacgttaaacgttaaagtttgggggttaacggtttaccggggaccggggtaaaccggtaaacccgtaaaaccgtcggtaacccgtaccgtaacggtaccgaaccggacccgaaacggttcccacccggtcccccttacggtacccttaacccg

SEQ ID NO: 309806 - DNA, 601 bp, Homo sapiens
  misc_feature: GZ8MTXP02JR60D.51.38.D05.1.454.CMB.2.raw
  modified_base (270)..(270): a, c, t, g, unknown or other
  misc_feature (270)..(270): n is a, c, g, or t
  modified_base (415)..(415): a, c, t, g, unknown or other
  misc_feature (415)..(415): n is a, c, g, or t
tcagcgatcgtatacacgaccggtgctcgatttagtatctgatagttgggtttgggggctttgcctgggctctgctattcctcaccctcctcactcagggcacagggtcctgggcccagtctgccctgactcagcctgcctccgtgtctgggtctcctggacagtcgatcaccatctcctgcactgggaccagcggtgacattggtgtttaataactatgtctcctggtaccagccaccacccaggcaaacgccccaaatcatgatttangatgtcagtgatcggcctcgaggggtttcaatcgcttctctggccttccgaagtccggacaaacgaccggtcctcccctgacccctatcctcgtcggccctccgacgggcccgagggacgaggtctgtattactactgcagctanataatacaatacaaataactaagttgggtagttcggacgggtaacgggaccaaaacgtcggaaccgtcctaaggtacacgacccgacgtacgtcgaccccgtccggtcgtaccgtcttcccgttacccgtacccctccgttccttccgtaacggtacctccgtacgtcgacggtccgggcgtacgg

SEQ ID NO: 309807 - DNA, 689 bp, Homo sapiens
  misc_feature: GZ8MTXP02G0DL2.51.38.D05.1.454.CMB.2.raw
  modified_base (237)..(237): a, c, t, g, unknown or other
  misc_feature (237)..(237): n is a, c, g, or t
  modified_base (247)..(247): a, c, t, g, unknown or other
  misc_feature (247)..(247): n is a, c, g, or t
  modified_base (307)..(307): a, c, t, g, unknown or other
  misc_feature (307)..(307): n is a, c, g, or t
tcagcgatcgtatacacgaccggtgctcgatttagtatctgatagttgggtttgggggctggggtctcaggaggcagcgctctcgggacgtctccaccatggcctgggctctgctattcctcaccctcctcactcagggcacagggtcctgggcccagtctgccctgactcagcctgcctccgtgtctgggtctctggacagtcgatcaccatctcctgcacgtgggaccagcggtnactattggtntttataactatgtctctggtaccagcaccaccaggcaaacgcccccaaatcatgatttangatgtcagtgatccggccctcgtaggggtttcaacgttcgtcttcgtctggcctaccgacggtcccggacaaccgaccggccctcccctagaccctatcctccgtcgccctccgacgggccgacgggacgacggtctaggtaactttaagtactaggcctagtacctacctaattaactaaactaacgttaacctaaaattaaaccgtaaaggttttcgggggttacggtttaccgggggaacccggggtaaacggggtaaaccccgtaaaaacgttccggtaaacccggttaacccggttaacgggtaccgaacccggaccccgtaaaacggggtaccccgtcccggtacccccccgttcggggttaccctttaaccccgg

SEQ ID NO: 309808 - DNA, 609 bp, Homo sapiens
  misc_feature: GZ8MTXP02GLRTA.51.38.D05.1.454.CMB.2.raw
  modified_base (243)..(243): a, c, t, g, unknown or other
  misc_feature (243)..(243): n is a, c, g, or t
  modified_base (247)..(247): a, c, t, g, unknown or other
  misc_feature (247)..(247): n is a, c, g, or t
  modified_base (304)..(304): a, c, t, g, unknown or other
  misc_feature (304)..(304): n is a, c, g, or t
  modified_base (415)..(415): a, c, t, g, unknown or other
  misc_feature (415)..(415): n is a, c, g, or t
  modified_base (478)..(478): a, c, t, g, unknown or other
  misc_feature (478)..(478): n is a, c, g, or t
tcagcgatcgtatacacgaccggtgctcgatttagtatctgatagttgggtttgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactgggaccaggcggtgacattggtnttanaactatgtctcctggtaccagcaccaccaggacaaacgcccccaaatcatgatttangtatgtacagtgactccggcccttcgtaggggtttacaagttcgtccctttctcgtcggcctaccgaacgttcccgggcctaaacgcccgggtccctcccgtacgaacctntcctcgtcggccctccgacggccgaggacgaggctagattactactgcagtctacataactanaaactacaaataactaaggttgggtaggtcgggacggtaacgggaacctaaacgtcggtaaacccgtacgtacgtaccacggacccgtaaggccgtaccgcccccgtcggtaccacccgttcgtaccccgg

SEQ ID NO: 309809 - DNA, 608 bp, Homo sapiens
  misc_feature: GZ8MTXP02F7SMV.51.38.D05.1.454.CMB.2.raw
  modified_base (305)..(305): a, c, t, g, unknown or other
  misc_feature (305)..(305): n is a, c, g, or t
tcagcgatcgtatacacgaccggtgctcgatttagtatctgatagttgggtttggggtggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactgggaccagcggtgactattggtgtttataactatgtctcctggtaccagcaccaccaggcaaacgccccaaatcatgatttangatgtcagtgatcggcctgaggggtttcaatccgcttctctggctccaagtcccggacaaaccgaccggtccctccctagaccctattcctctcggccctccgacgggacccgagggaccgagggtcctagaactttattactggacagtctacaataataaccaatacaaataaactaagttggggtgttacgggacgggaagggaacctaaaacgtcggaacccgttcgtaaacgggttccaacggaaccccgaaaaggtcccgttaccgccccccgttacggtacctacccgttccccgg

SEQ ID NO: 309810 - DNA, 558 bp, Homo sapiens
  misc_feature: GZ8MTXP02J0NC8.51.38.D05.1.454.CMB.2.raw
  modified_base (308)..(308): a, c, t, g, unknown or other
  misc_feature (308)..(308): n is a, c, g, or t
  modified_base (368)..(368): a, c, t, g, unknown or other
  misc_feature (368)..(368): n is a, c, g, or t
  modified_base (427)..(427): a, c, t, g, unknown or other
  misc_feature (427)..(427): n is a, c, g, or t
tcagcgatcgtatacacgaccggtgctcgatttagtatctgatagttgggtttgggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactgggaccagcggtgacattggtgtttataactatgtctcctggtaccagcaccacccaggcaaagcccccaaactcatgatttangatgtcagtgatcggccctgaggggtttcaatcgcttctctggctccagtccggacaacncggccctccctgacccatctctcggccctccgaggccgaggacggagctgattattacngcagctacatatacaatacaaattaacaagttggggtgttcgggacgggagggaaccctaaacgtcgacccgtccgtaggtccaacggaccccaacgggccttaccggccccccgttacggtaccctaccg

SEQ ID NO: 309811 - DNA, 603 bp, Homo sapiens
  misc_feature: GZ8MTXP02GVT23.51.38.D05.1.454.CMB.2.raw
  modified_base (246)..(246): a, c, t, g, unknown or other
  misc_feature (246)..(246): n is a, c, g, or t
  modified_base (308)..(308): a, c, t, g, unknown or other
  misc_feature (308)..(308): n is a, c, g, or t
tcagcgatcgtatacacgaccggtgctcgatttagtatctgatagttgggtttgggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctctgcactgggaccagcggtgactattggtntttataactatgtctcctggtaccagcaccaccaggcaaacgcccccaaactcatgatttangatgtcagtgatcggcctcgaggggtttcaatcgcttctctggcctcgacgtccggacaaccgaccggtccctcccgtacgacccaactccttccgtcggccctcccgacgggcccgaacgggacgacgggctaggtaacttaattacctggcaagtctacataactaacaaactactaaaactaaactaaagtttggggtagtttacggggcgggtaaacgggacctaaaacgtcgtaccgtaccgtaggtaccaacgcccgaaacggccgtaccgccccgttcggacctaccg

SEQ ID NO: 309812 - DNA, 559 bp, Homo sapiens
  misc_feature: GZ8MTXP02GYGQA.51.38.D05.1.454.CMB.2.raw
  modified_base (286)..(286): a, c, t, g, unknown or other
  misc_feature (286)..(286): n is a, c, g, or t
  modified_base (322)..(322): a, c, t, g, unknown or other
  misc_feature (322)..(322): n is a, c, g, or t
tcagcgatcgtatacacgaccggtgctcgatttagtatctgatagttgggtttggggctttgcctgggctctgctattcctcaccctcctcactcagggcacagggtcctgggcccagtctgccctgactcagcctgcctccgtgtctgggtctcctggacagtcgatcaccatctcctgcactgggaccagcggtgacattggtgtttataactatgtctcctggtaccagcaccacccaggcaaagcccccaaatcatgatttatgatgtcagtgatcggcctnaggggtttcaatcgcttctctggctccaagtccggnaacacggcctcctgaccccatctctggcctcaggccgaggcgagctgattatactgcagctcatatacaatcaaatacaattgggtagttcggacggtagggaccaaaacttcggaccgtactaggtcaagcccaaaggcctcggcccccttcgggtaccacgttcctcggtttccccccgtcccttaccgtcgttacgtaacgtcctaccgtcgtcggacggccgggtacgtacgg

SEQ ID NO: 309813 - DNA, 573 bp, Homo sapiens
  misc_feature: GZ8MTXP02IS6T9.51.38.D05.1.454.CMB.2.raw
  modified_base (319)..(319): a, c, t, g, unknown or other
  misc_feature (319)..(319): n is a, c, g, or t
  modified_base (457)..(457): a, c, t, g, unknown or other
  misc_feature (457)..(457): n is a, c, g, or t
  modified_base (566)..(566): a, c, t, g, unknown or other
  misc_feature (566)..(566): n is a, c, g, or t
tcagcgatcgtatacacgaccggtgctcgatttagtatctgatagttgggtttgggggaggcgtggtccagcctgggaggtccctgagactcgcctgtaaaccgtccggattcaccttcagtaactatgcaatgcactgggtccgccaggctccaggcaaggggctggactgggtggcaggcatatcatttgatggaagcaagaagtactatgcagactccgtgaagggccgattcaccatctccagagacagttccgatgacacagtctatctacacatgagcagtgtgagacctgacgacacggtcttctttttacngttgcgccaggaagcagtcggctggccacgatcagtgtcttttgatagtctagggacaccgaagggacaaagtggtactagtcgtctcgttcggccctaccgaccgaacgggcccacgttccggttcccttcccccgngggaccccacccctcctaccagacgctaaccgtcgtcgggggcacgacggccggtcccgtggcctcggcccgttggaaccgaaacggtcttaccgttccgtacggtacncgtaccg

SEQ ID NO: 309814 - DNA, 742 bp, Homo sapiens
  misc_feature: GZ8MTXP02IHB7H.51.38.D05.1.454.CMB.2.raw
  modified_base (271)..(271): a, c, t, g, unknown or other
  misc_feature (271)..(271): n is a, c, g, or t
tcagcgatcgtatacacgaccggtgctcgatttagtatctgatagttgggtttgggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactgggaccagcggtgactattggtgtttataactatgtctctggtaccngcaccaccaggcaaacgcccccaaatcatgatttatgatgtcagtgatcggccctgaggggtttcaactccgtctttcgtctcggccttccgaggttcccggacaaaccgcccgggccccttcccgtcggaaccctacttcctccgttcgggacccccttacccgaaacggggccccggaaaggggaaccgggtaaacggggtcccttagggtaaacttttaaacgtttaacccgttcgggtaccaaacggtccctttaaccgaaactttaaactaaaaccctaaattaaccctaaaaattaaaccgtaaaagttttcgggggtacggttttaccggggaacggggtaaacgggggtaaaccctaaaaacgttcggtacccggttaacccgttaaggggttacccaaacggtacccccgaaaagggtcccgttacccggtcccccccgtttaacggggtcccttaaccccg

SEQ ID NO: 309815 - DNA, 517 bp, Homo sapiens
  misc_feature: GZ8MTXP02I1F9Q.51.38.D05.1.454.CMB.2.raw
  modified_base (308)..(308): a, c, t, g, unknown or other
  misc_feature (308)..(308): n is a, c, g, or t
tcagcgatcgtatacacgaccggtgctcgatttagtatctgatagttgggtttgggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactgggaccagcggtgacatttgggtgtttataactatgtctcctggtaccagcaccaccaggcaaagcccccaaatcatgatttangatgtcagtgatcggccctcaggggtttcaatcgcttctctggctcagtccgcaacgacgcctccctgacccatctctcggcctccaggcccgaggacgaggctgattatactgcagctcatactacaatcaaataaactaagttgggtagttcggcggaagggaccaaacgtgaccgtcaggtcaagccaaggcctgccccctgctac

SEQ ID NO: 309816 - DNA, 606 bp, Homo sapiens
  misc_feature: GZ8MTXP02JFEO0.51.38.D05.1.454.CMB.2.raw
  modified_base (244)..(244): a, c, t, g, unknown or other
  misc_feature (244)..(244): n is a, c, g, or t
tcagcgatcgtatacacgaccggtgctcgatttagtatctgatagttgggtttgggggaggcgtggtccagcctgggaggtccctgagactcgcctgtaaaccgtccggattcaccttcagtaactatgcaatgcactgggtccgccaggctccaggcaaggggctggactgggtggcaggcatatcatttgatggaagcaagaagtactatgcagactccgtgaaggcattcacatctcaganacagttccgatgacacagtctatctacacatgagcagtgtgagtaccctggacgacgacggtctttactttttacgtgtcgccgtccgagggaagccaggtcggctcggccctacatcctatcgtctttttagatactcgtggacgaccgaaagggactaagtggtacagttcgtctcgttccggcctccgaaccgacgggccctagtcccggtaccttcccccgtgacccctaccccgtcctaccgaagaccgcctaacccgttccggacgggggaccacggccggcccggccgttcggggccttccggccgtttacggaacgaacggtaccttaccggttacctacggtaacgctaaccg

SEQ ID NO: 309817 - DNA, 533 bp, Homo sapiens
  misc_feature: GZ8MTXP02H2QXE.51.38.D05.1.454.CMB.2.raw
  modified_base (245)..(245): a, c, t, g, unknown or other
  misc_feature (245)..(245): n is a, c, g, or t
  modified_base (306)..(306): a, c, t, g, unknown or other
  misc_feature (306)..(306): n is a, c, g, or t
  modified_base (342)..(342): a, c, t, g, unknown or other
  misc_feature (342)..(342): n is a, c, g, or t
  modified_base (359)..(359): a, c, t, g, unknown or other
  misc_feature (359)..(359): n is a, c, g, or t
  modified_base (368)..(368): a, c, t, g, unknown or other
  misc_feature (368)..(368): n is a, c, g, or t
  modified_base (372)..(372): a, c, t, g, unknown or other
  misc_feature (372)..(372): n is a, c, g, or t
  modified_base (410)..(410): a, c, t, g, unknown or other
  misc_feature (410)..(410): n is a, c, g, or t
tcagcgatcgtatacacgaccggtgctcgatttagtatctgatagttgggtttgggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcacatctcctgcactgggaccagcggtgacattggtntttataactatgtctcctggtaccagccaccaccaggcaaacgcccccaatcatgatttangatgtcagtgatcgcctgaggggtttcatcgcttcnctgctcagtccgacacncgcctcctnaccntctctcgcctcgaggccgaggacgagctgtattatacngacagctactaatacacaatacaaataacgtagttgggtgttacggacggaacggaaccaaacgtcgaccgtacgtaggtaccaacgacccgaacggcctaccgcccccttcggtacctaccg

SEQ ID NO: 309818 - DNA, 544 bp, Homo sapiens
  misc_feature: GZ8MTXP02FWZBB.51.38.D05.1.454.CMB.2.raw
  modified_base (246)..(246): a, c, t, g, unknown or other
  misc_feature (246)..(246): n is a, c, g, or t
  modified_base (308)..(308): a, c, t, g, unknown or other
  misc_feature (308)..(308): n is a, c, g, or t
  modified_base (366)..(366): a, c, t, g, unknown or other
  misc_feature (366)..(366): n is a, c, g, or t
tcagcgatcgtatacacgaccggtgctcgatttagtatctgatagttgggtttgggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactgggaccagcggtgacattggtntttataactatgtctcctggtaccagcaccacccaggcaaacgcccccaaatcatgatttangatgtcagtgatcggccctgaggggtttcaatcgcttctctggctcagtccgacaacncgcctcctgaccatctctcggccctccaggcccgaggacgaggctgactttatactgcagctacatatacaaatcaaaataactaagttgggtcgttacggcgggtacgggaaccaaaacgtcgaacccgtcgtacggtacaacgcccaaagggcctccgcccccgttcggcctaccg

SEQ ID NO: 309819 - DNA, 540 bp, Homo sapiens
  misc_feature: GZ8MTXP02GLR9W.51.38.D05.1.454.CMB.2.raw
  modified_base (247)..(247): a, c, t, g, unknown or other
  misc_feature (247)..(247): n is a, c, g, or t
  modified_base (308)..(308): a, c, t, g, unknown or other
  misc_feature (308)..(308): n is a, c, g, or t
tcagcgatcgtatacacgaccggtgctcgatttagtatctgatagttgggtttgggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactgggaccagcggtgactattggtntttataactatgtctcctggtaccagcaccaccaggcaaacgcccccaaatcatgatttangatgtcagtgatcgcctcgtaggggtttcaactcgcttctcgtgcctacacgtccggacaacgaccgccctcctgacccatcctctcggcctaccgacggccgaggacgaggctagattatactgctagctacatactacatacaaataaacagttcggggtgtcggacggaggaactaaacgtgacccgtactaggtacaacgcccgaaggcctacgcccctggcctaccg

SEQ ID NO: 309820 - DNA, 561 bp, Homo sapiens
  misc_feature: GZ8MTXP02GU95U.51.38.D05.1.454.CMB.2.raw
  modified_base (313)..(313): a, c, t, g, unknown or other
  misc_feature (313)..(313): n is a, c, g, or t
  modified_base (384)..(384): a, c, t, g, unknown or other
  misc_feature (384)..(384): n is a, c, g, or t
tcagcgatcgtatacacgaccggtgctcgatttagtatctgatagttgggtttgggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactgggaccaggcggtgactatttggtgtttaataactatgtctcctggtaccagccaccaccaggacaaacgcccccaaatcatgatttangatgtcagtgatcggcctgaggggtttcaactcgtcttctctggcttccagtccgacaaccgccgcctccngacccatctctcggcctccgacggccgaggcgacggctgattatactgctagctacatactaacaatacaaataactaagttggggtacgttacgggacggaacgggaaacctaaacgtacgaccgtacgtacggtacaacgaccgaacggcctaccggccccgtcggtactacccg

SEQ ID NO: 309821 - DNA, 632 bp, Homo sapiens
  misc_feature: GZ8MTXP02HVSYM.51.38.D05.1.454.CMB.2.raw
  modified_base (309)..(309): a, c, t, g, unknown or other
  misc_feature (309)..(309): n is a, c, g, or t
  modified_base (451)..(451): a, c, t, g, unknown or other
  misc_feature (451)..(451): n is a, c, g, or t
tcagcgatcgtatacacgaccggtgctcgatttagtatctgatagttgggtttggggtggggtctcaggaggcagcgctctcgggacgtctccaccatggcctgggatctgctattcctcaccctcctcactcagggcacagggtcctgggcccagtctgccctgactcagcctgcctccgtgtctgggtctcctggacagtcgatcaccatctcctgcacgtgggaccaggcggtgactattggtagttttataactatgtctcctggtaccagcaccaccaggcaaacgccccaaatcatgatttangatgtcagtgatcggcctgtaggggtttcaatccgcttctctcggctccgaagtccggacaaccaccggccctccctgacctatcctctcggcctcgacggcccgaggacgaggctagattattactgcagctcatactaanaactacaaaataacgtaaagtttcggggtaggtttacggggacgggtaaacggggaaacccaaacggttaccggtaaccccgttaccggttaacgggtaccgaaaccggaacccccggtaaacgggtaccccgttacccggtacccccccggtttcgggttaccctacccgttttccccgg

SEQ ID NO: 309822 - DNA, 533 bp, Homo sapiens
  misc_feature: GZ8MTXP02FROCB.51.38.D05.1.454.CMB.2.raw
  modified_base (251)..(251): a, c, t, g, unknown or other
  misc_feature (251)..(251): n is a, c, g, or t
  modified_base (359)..(359): a, c, t, g, unknown or other
  misc_feature (359)..(359): n is a, c, g, or t
  modified_base (373)..(373): a, c, t, g, unknown or other
  misc_feature (373)..(373): n is a, c, g, or t
  modified_base (418)..(418): a, c, t, g, unknown or other
  misc_feature (418)..(418): n is a, c, g, or t
  modified_base (421)..(421): a, c, t, g, unknown or other
  misc_feature (421)..(421): n is a, c, g, or t
  modified_base (426)..(426): a, c, t, g, unknown or other
  misc_feature (426)..(426): n is a, c, g, or t
  modified_base (442)..(442): a, c, t, g, unknown or other
  misc_feature (442)..(442): n is a, c, g, or t
tcagcgatcgtatacacgaccggtgctcgatttagtatctgatagttgggtttgggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactgggaccagcggtgacattggtgtttanaactatgtctcctggtaccagcaccacccaggcaaagcccccaaatcatgatttatgatgtcagtgatcggcctgaggggtttcaatcgcttctctggctcagtccgnaaacgccgcctccngaccatctcctggcctcaggcccaggacaggctgatttaattcgngcngctanatacacatacaaatanagttgggtacgtacggacggtaacggaacctaaacgtcgaccgtacgtaggacaacgacccgaacggtcctccggccccgtcggtactacg

SEQ ID NO: 309823 - DNA, 744 bp, Homo sapiens
  misc_feature: GZ8MTXP02I138D.51.38.D05.1.454.CMB.2.raw
  modified_base (348)..(348): a, c, t, g, unknown or other
  misc_feature (348)..(348): n is a, c, g, or t
tcagcgatcgtatacacgaccggtgctcgatttagtatctgatagttgggtttgggggaggcgtggtccagcctgggaggtccctgagactcgcctgtaaaccgtccggattcaccttcagtaactatgcaatgcactgggtccgccaggctccaggcaaggggctggactggggtggcaggcatatcatttgatggaagcaagagtactatgcagactccgtgaaggcgattcacatctccagagacagttccgatgacacagtctatctacacatgagcagtgtgagactgacgacacggtcttctttttactgtcgcgccaggaagcacggtgctggccacatcntgtcttttagattatcgtagggacgacccgaaaggggaccaaagttcgggtactaagttccgttccgttccgtttcccgggaccccttacccgaacccggtaaaacccgggggtccccctaaacggtttcccccggggtttcccctttaccccccccggttggggtacccccctaaccccccgttacccgttaaccccgtaaacgggtaccgcccccgttaacccggtacccgggttccggggggaacccaacccggtacccgggggcccccggggtccccgggttccgggggttcccgtccgggtcccccgggtttacgggaacccggtaaaccggggttaaaccctttacccggtttccccggttaccgtttaaccgggtcccctttaacccgg

SEQ ID NO: 309824 - DNA, 553 bp, Homo sapiens
  misc_feature: GZ8MTXP02JL3FZ.51.38.D05.1.454.CMB.2.raw
  modified_base (436)..(436): a, c, t, g, unknown or other
  misc_feature (436)..(436): n is a, c, g, or t
tcagcgatcgtatacacgaccggtgctcgatttagtatctgatagttgggtttgggggaggcgtggtccagcctgggaggtccctgagactcgcctgtaaaccgtccggattcaccttcagtaactatgcaatgcactgggtccgccaggctccaggcaaggggctggactgggtggcaggcatatcatttgatggaagcaagaagtactatgcagactccgtgaagggccgattcaccatctccagagacagttccgatgacacagtctatctacacatgagcagtgtgagacctgacgacacggtcttctttttactgtgcgccgaggaagcaggtgctcggccacatcatgtcttttagattatcgtggagaccgaaagggacaagtgtcatcgtctcgttcgcctccacgacggccagtccgtcctccccgngcccaccctcctaccaacgcgccacccgtcggtcggggaccacgcgcccggtcccggcgggtccctcggcccgtaggtaacccgaaggtacctaccgttaccgtcgtacgctacccg

SEQ ID NO: 309825 - DNA, 610 bp, Homo sapiens
  misc_feature: GZ8MTXP02IA853.51.38.D05.1.454.CMB.2.raw
  modified_base (256)..(256): a, c, t, g, unknown or other
  misc_feature (256)..(256): n is a, c, g, or t
  modified_base (304)..(304): a, c, t, g, unknown or other
  misc_feature (304)..(304): n is a, c, g, or t
  modified_base (315)..(315): a, c, t, g, unknown or other
  misc_feature (315)..(315): n is a, c, g, or t
  modified_base (466)..(466): a, c, t, g, unknown or other
  misc_feature (466)..(466): n is a, c, g, or t
tcagcgatcgtatacacgaccggtgctcgatttagtatctgatagttgggtttggggtggggtctcaggaggcagcgctctcgggacgtctccaccatggcctgggctctgctattcctcaccctcctcactcagggcacagggtcctgggcccagtctgcctgactcagcctgcctccgtgtctgggtctcctggacagtcgatcaccatctcctgcactggggaccaggcggtgactagtttggtagttttaanaacttatgtctctggtaccagccaccaccaggcaaacgccccaaactnactgtatttangatgtacagtgagtccgcctagaggggtttacacgtccgtcttctctaggcttaccgaacgtccgacaacgccggtccctccgacgacctactcccgtcgtccggccctccggacggccggaacggacgacggtctaggtattacgttacncgtacatctactaatattaacaaatacgtaaataacgttaaggttgggtacgttacgggacggaaacgggacctaaacgtccgaccgttacgacggtaccacggaacccgacggtcctacgtccccgtcggtactaccgttccg

SEQ ID NO: 309826 - DNA, 566 bp, Homo sapiens
  misc_feature: GZ8MTXP02JN8GJ.51.38.D05.1.454.CMB.2.raw
  modified_base (250)..(250): a, c, t, g, unknown or other
  misc_feature (250)..(250): n is a, c, g, or t
  modified_base (311)..(311): a, c, t, g, unknown or other
  misc_feature (311)..(311): n is a, c, g, or t
tcagcgatcgtatacacgaccggtgctcgatttagtatctgatagttgggtttgggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcacgtgggaccaggcggtgactagttggtntttataactatgtctctggtaccagcaccaccaggcaaacgcccccaaatcatgtatttangatgtcagtgatccggcctgtaggggtttcaactcgcttctctggctccaggtccgacaaccgaccgcctcccgtgaccctatcctcgtcggccctacgaggccgaggacgaggctagtattagtctgcagtctacaattactaacaatacaaataacgtaagttgggtgtcgggaggacgggaaccaaacgtcgaccgtaccgtaggtaccaacggtcccgaacggtccctccggccccctaggtacctacccg

SEQ ID NO: 309827 - DNA, 563 bp, Homo sapiens
  misc_feature: GZ8MTXP02I5BR2.51.38.D05.1.454.CMB.2.raw
  modified_base (255)..(255): a, c, t, g, unknown or other
  misc_feature (255)..(255): n is a, c, g, or t
  modified_base (383)..(383): a, c, t, g, unknown or other
  misc_feature (383)..(383): n is a, c, g, or t
tcagcgatcgtatacacgaccggtgctcgatttagtatctgatagttgggtttgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactgggaccagcggtgactagttggtgtttaataactntgtctcctggtaccagcaccacccaggcaaacgcccccaaactccatgatttatgatgtcagtgatcggcctcgtaggggtttcaaatcgccttctctcggctcaacgtccggcaacacggcctcccngaccatcctctcggccctccgacggccgaggacgagctgattatactgcagctcatataacaatacaaataactagttgggttacgtacggacgggaacgggaaccaaacgtacgacccgtaccgtacgtaccacgacccgaaggccctccgcccccgtcggacctaccgtcgttccccg

SEQ ID NO: 309828 - DNA, 561 bp, Homo sapiens
  misc_feature: GZ8MTXP02GTVOX.51.38.D05.1.454.CMB.2.raw
  modified_base (328)..(328): a, c, t, g, unknown or other
  misc_feature (328)..(328): n is a, c, g, or t
tcagcgatcgtatacacgaccggtgctcgatttagtatctgatagttgggtttgggggctttgcctgggctctgctattcctcaccctcctcactcagggcacagggtcctgggcccagtctgccctgactcagcctgcctccgtgtctgggtctcctggacagtcgatcaccatctcctgcactgggaccagcggtgacattggtgtttataactatgtctcctggtaccagcaccacccaggcaaacgcccccaaatcatgatttatgatgtcagtgatcggccctgagggtttcaatcgcttctctggctccagtccggacaacncgcctccctgaccccatctctcggcctccgaggccgaggacgaggctgatttatactgcagctacatatacaatacaaataacagttgggtgttcgggacggacgggaaccaaacgtcggacccgtccgtaggtcacgacccgaaggtcctccgcccccgtcggtccacttccgttccgttcccctacccttcctccgtaccgtaacgcctactcgtcggacggcgggctcgg

SEQ ID NO: 309829 - DNA, 583 bp, Homo sapiens
  misc_feature: GZ8MTXP02F8DRC.51.38.D05.1.454.CMB.2.raw
  modified_base (308)..(308): a, c, t, g, unknown or other
  misc_feature (308)..(308): n is a, c, g, or t
  modified_base (434)..(434): a, c, t, g, unknown or other
  misc_feature (434)..(434): n is a, c, g, or t
tcagcgatcgtatacacgaccggtgctcgatttagtatctgatagttgggtttgggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactgggaccagcggtgacattggtgtttaataactatgtctcctggtaccagccaccaccaggcaaacgcccccaaatcatgattangatgtcagtgatccggccctgtaggggtttcaactcgtcttctctggccttaccgagtccggacaacaccggccctccgtgaccatctctcgcctcgaggccgaggacgagtctgtattattacgnacagctacaagtaactaactaactactaaaactaacgtaagttgggtacgtacgggacggaacggtaaaccgaaacgtaccgtaccgtaccgtacggtaccgaaccggacccgaacggtccgtacccgtccccgttacggtacctaccg

SEQ ID NO: 309830 - DNA, 600 bp, Homo sapiens
  misc_feature: GZ8MTXP02HJPPN.51.38.D05.1.454.CMB.2.raw
  modified_base (248)..(248): a, c, t, g, unknown or other
  misc_feature (248)..(248): n is a, c, g, or t
  modified_base (312)..(312): a, c, t, g, unknown or other
  misc_feature (312)..(312): n is a, c, g, or t
tcagcgatcgtatacacgaccggtgctcgatttagtatctgatagttgggtttgggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactgggaccagcggtgactagttggtntttaataactatgtctcctggtaccagccaccaccaggacaaacgcccccaaatcatgatttangatgtcagtgatccggcctgtaggggtttcaacgtcgctttctcgtggcctaccgacggtcccgacaaccgaccggtccctcccgtagaccctatcctccgtcgccctcgacggccgaggacgacggctagtatttatacgtgctacgtctactaatacaactaatacaaattaacgtaaggtttgggtacggttaccggggacggtacggtaacctaaacgtcggaacccgtcgtacgtacgaaccgtaccgaacggtcctacccgtcccccgtaggtaccctaccg

SEQ ID NO: 309831 - DNA, 565 bp, Homo sapiens
  misc_feature: GZ8MTXP02FFUL5.51.38.D05.1.454.CMB.2.raw
  modified_base (240)..(240): a, c, t, g, unknown or other
  misc_feature (240)..(240): n is a, c, g, or t
  modified_base (244)..(244): a, c, t, g, unknown or other
  misc_feature (244)..(244): n is a, c, g, or t
  modified_base (319)..(319): a, c, t, g, unknown or other
  misc_feature (319)..(319): n is a, c, g, or t
  modified_base (356)..(356): a, c, t, g, unknown or other
  misc_feature (356)..(356): n is a, c, g, or t
  modified_base (362)..(362): a, c, t, g, unknown or other
  misc_feature (362)..(362): n is a, c, g, or t
  modified_base (379)..(379): a, c, t, g, unknown or other
  misc_feature (379)..(379): n is a, c, g, or t
  modified_base (457)..(457): a, c, t, g, unknown or other
  misc_feature (457)..(457): n is a, c, g, or t
  modified_base (478)..(478): a, c, t, g, unknown or other
  misc_feature (478)..(478): n is a, c, g, or t
  modified_base (483)..(483): a, c, t, g, unknown or other
  misc_feature (483)..(483): n is a, c, g, or t
  modified_base (502)..(502): a, c, t, g, unknown or other
  misc_feature (502)..(502): n is a, c, g, or t
  modified_base (517)..(517): a, c, t, g, unknown or other
  misc_feature (517)..(517): n is a, c, g, or t
  modified_base (556)..(556): a, c, t, g, unknown or other
  misc_feature (556)..(556): n is a, c, g, or t
  modified_base (561)..(561): a, c, t, g, unknown or other
  misc_feature (561)..(561): n is a, c, g, or t
  modified_base (563)..(563): a, c, t, g, unknown or other
  misc_feature (563)..(563): n is a, c, g, or t
tcagcgatcgtatacacgaccggtgctcgatttagtatctgatagttgggtttgggggaggcgtggtccagcctgggaggtccctgagactcgcctgtaaaccgtccggattcaccttcagtaactatgcaatgcactgggtccgccaggctccaggcaaggggctggactgggtggcaggcatatcatttgatggaagcaaagaagtactatgcagactccgtgaaggccatcacatcncagngacagttccgatgacacagtctatcacacatgagcagtgtgacgacctggaccgacacggtctttactttttacngtggccgccgaggtaacgcgaggtcggcacggcccanactctntcgtctttttagaattnttcgagggacgacccgaaaggggacaaagttcggtacactcggtcttccttcccggcctacccaccgaacgggtcccncgttccggtccttacccccgnggccnccccgttccaccaggaccnccacgtcggcgggcncgcgccgccgtcggctcgcgtagaacgtacgtactctcncgacncncg

SEQ ID NO: 309832 - DNA, 558 bp, Homo sapiens
  misc_feature: GZ8MTXP02HTWRW.51.38.D05.1.454.CMB.2.raw
  modified_base (246)..(246): a, c, t, g, unknown or other
  misc_feature (246)..(246): n is a, c, g, or t
  modified_base (251)..(251): a, c, t, g, unknown or other
  misc_feature (251)..(251): n is a, c, g, or t
  modified_base (307)..(307): a, c, t, g, unknown or other
  misc_feature (307)..(307): n is a, c, g, or t
  modified_base (369)..(369): a, c, t, g, unknown or other
  misc_feature (369)..(369): n is a, c, g, or t
tcagcgatcgtatacacgaccggtgctcgatttagtatctgatagttgggtttgggggctggggtctcaggaggcagcgctctcgggacgtctccaccatggcctgggctctgctattcctcaccctcctcactcggggcacagggtcctgggcccagtctgccctgactcagcctgcctccgtgtctgggtctcctggacagtcgatcaccatctcctgcactgggaccagcggtgacattggtntttanaactatgtctcctggtaccagcaccacccaggcaaacgccccaaatcatgatttangatgtcagtgatcggcctcgaggggtttcaatccgcttctctggctccaagtccggcaaacncggccctcctgacctatctctggccctccgaggcccgaggacgagctgattatactgcagctcatatacaatcaaagtaactaaagttgggtacgttcgggacggaacgggaacccaaaactcggaaccgttccctaagggtccacggaaccccgtaaggcctcgcccccgtacggtccacgtttcccg

SEQ ID NO: 309833 - DNA, 551 bp, Homo sapiens
  misc_feature: GZ8MTXP02F9I1P.51.38.D05.1.454.CMB.2.raw
  modified_base (242)..(242): a, c, t, g, unknown or other
  misc_feature (242)..(242): n is a, c, g, or t
  modified_base (247)..(247): a, c, t, g, unknown or other
  misc_feature (247)..(247): n is a, c, g, or t
  modified_base (313)..(313): a, c, t, g, unknown or other
  misc_feature (313)..(313): n is a, c, g, or t
  modified_base (429)..(429): a, c, t, g, unknown or other
  misc_feature (429)..(429): n is a, c, g, or t
tcagcgatcgtatacacgaccggtgctcgatttagtatctgatagttgggtttgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactgggaccagcggtgacattggtntttanaactatgtctctggtaccagcaccacccaggcaaacgcccccaaatcatgatttatgatgtcagtnatccggccctcgaggggtttcaatcgccttctctgctcaacgtcgcaacacggcctccctgaccatctcgtgccctccgaggccgaggacgagctagtattactactgcagtctanatatacaatacaataaactagttgggtgttacgggcggtacgggaaccaaacgtcgtaccgtaccgtagtccgacggacccaaggccttaccgcccccgtcggtccaccgttccttccccgg

SEQ ID NO: 309834 - DNA, 597 bp, Homo sapiens
  misc_feature: GZ8MTXP02HPBOB.51.38.D05.1.454.CMB.2.raw
  modified_base (315)..(315): a, c, t, g, unknown or other
  misc_feature (315)..(315): n is a, c, g, or t
  modified_base (395)..(395): a, c, t, g, unknown or other
  misc_feature (395)..(395): n is a, c, g, or t
  modified_base (463)..(463): a, c, t, g, unknown or other
  misc_feature (463)..(463): n is a, c, g, or t
  modified_base (470)..(470): a, c, t, g, unknown or other
  misc_feature (470)..(470): n is a, c, g, or t
tcagcgatcgtatacacgaccggtgctcgatttagtatctgatagttgggtttgggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcacgtgggaccaggcggtgactagttggtgtttaataactatgtctcctggtaccagcaccaccaggaccaaacgcccccaaatcatgtatttangatgcagtgatcggccctgtaggggtttcaactcgtcttctcgtggcctcacgtcccggcaaaccgccggtccctcccgngacccattcctccgtcgaccctcgacggccgaggacgacggctagtacttagttactgactagcctanatactanaactactaaataactaagttgggtacggttcgggacgggtaacgggtaacccaaaacggttccgaaccgtccgtaacgggtcaacggacccgaagggcctcccggcccccgttcggtaccctacccg

SEQ ID NO: 309835 - DNA, 617 bp, Homo sapiens
  misc_feature: GZ8MTXP02H96B3.51.38.D05.1.454.CMB.2.raw
  modified_base (245)..(245): a, c, t, g, unknown or other
  misc_feature (245)..(245): n is a, c, g, or t
  modified_base (299)..(299): a, c, t, g, unknown or other
  misc_feature (299)..(299): n is a, c, g, or t
  modified_base (448)..(448): a, c, t, g, unknown or other
  misc_feature (448)..(448): n is a, c, g, or t
  modified_base (462)..(462): a, c, t, g, unknown or other
  misc_feature (462)..(462): n is a, c, g, or t
tcagcgatcgtatacacgaccggtgctcgatttagtatctgatagttgggtttgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcatcaccatctcctgcactggaccagcggtgacattggtatttanaactatgtctctgtaccagcaccaccagacaaagcccccaaatcatgtatttangatgtcagtgatcggcctgaggggtttcatcgcttctcgtgctacaaggttcccggcaaaccgcggtccccctcccgtagaccctattcccgtccctggccctccgaacgggccggaaggacggaggtcttagtaactttagttaaccnggctaagccttaanaatttaataaccgtaaataccgtaaaataacgtaaaggtttcggggtagttcgggaacgggtacggaaaaccttaacgtacgtaccgtcgtacggtccgaacgtacccaagggtcctaccggtcccccgtaggtccctacgtttcccgttacccg

SEQ ID NO: 309836 - DNA, 603 bp, Homo sapiens
  misc_feature: GZ8MTXP02FQSPG.51.38.D05.1.454.CMB.2.raw
  modified_base (318)..(318): a, c, t, g, unknown or other
  misc_feature (318)..(318): n is a, c, g, or t
  modified_base (352)..(352): a, c, t, g, unknown or other
  misc_feature (352)..(352): n is a, c, g, or t
tcagcgatcgtatacacgaccggtgctcgatttagtatctgatagttgggtttgggggaggcgtggtccagcctgggaggtccctgagactcgcctgtaaaccgtccggattcaccttcagtaactatgcaatgcactgggtccgccaggctccaggcaaggggctggactgggtggcaggcatatcatttgatggaagcaagaagtactatgcagactcgtgaaggcatcacatctcagagacagttccgatgacacgagtctatctaacacatagagcagtgtagacgacctgacacgtacgtctttctttttacngtcgcgacgaggacgcagtcgctcgccagactcnttgttcttttagattactcgtagggacgtaccgaaaggactaagtcgtactacgttccgtccttccgtcccggaccctacccgaaccgtaaccgggccctacggtcccggttcccttccccgtcggccctacccctccgtaaccgagtaccgtccaccgtcgggccgggaccacggtcggcccggttccgcgggtcctcggccgtaggtaaccgaacggtaccttaccgttccgtacgtaccgtctaccgg

SEQ ID NO: 309837 - DNA, 576 bp, Homo sapiens
  misc_feature: GZ8MTXP02G54Y6.51.38.D05.1.454.CMB.2.raw
  modified_base (451)..(451): a, c, t, g, unknown or other
  misc_feature (451)..(451): n is a, c, g, or t
tcagcgatcgtatacacgaccggtgctcgatttagtatctgatagttgggtttgggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactgggaccagcggtgacattggtgtttataactatgtctcctggtaccagcacccaccaggacaaacgacccccaaatcatgatttatgatgtcagtgatccggccctgtaggggtttcaacgtcgtcttctcgtggtcctcaggtcccggcaaaccgaccgccctccctacgaccctactcctcgtcggccctccgaggccgaggacgaggctagattagttactgcngctcatactacaatacaaattaactaagtgggtcgttacggacgggtacgggaacctaaagtccgtaccgtccgtaaggtccgaacgacccgtaacggccgtccgtcccccgtggtacctacccg

SEQ ID NO: 309838 - DNA, 637 bp, Homo sapiens
  misc_feature: GZ8MTXP02FW9PI.51.38.D05.1.454.CMB.2.raw
  modified_base (382)..(382): a, c, t, g, unknown or other
  misc_feature (382)..(382): n is a, c, g, or t
tcagcgatcgtatacacgaccggtgctcgatttagtatctgatagttgggtttgggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactgggaccagcggtgacattggtgtttaataactatgtctcctggtaccagcaccaccaggcaaacgcccccaaatcatgatttatgatgtcagtgatcggccctgaggggtttcaatcgcttctctggcctccacgtccgacaaacgaccggccctccncgaccctatctcctggccctcgacgggccgacgggacgaacggctagatttacttactgacagccttacaattaactaactaaactaactaaaacttaaactaaaggtttcgggggtagtttaccggggacggggaaacggggtaaaccctaaaacggttcggtaaccccggtaaccgttacgggtaccgaaccggtacccccgaaaacggggtccccgttacccggccccccgtttacgggtacccttaacccg

SEQ ID NO: 309839 - DNA, 604 bp, Homo sapiens
  misc_feature: GZ8MTXP02GVUQD.51.38.D05.1.454.CMB.2.raw
  modified_base (310)..(310): a, c, t, g, unknown or other
  misc_feature (310)..(310): n is a, c, g, or t
tcagcgatcgtatacacgaccggtgctcgatttagtatctgatagttgggtttgggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcacatctcctgcactgggaccaggcggtgactagttgggtgtttaataactatgtctcctggtaccagcaccaccaggcaaacgccccaaatcatgatttangatgtcagtgactcggcctgtaggggtttcaactcgtcttctcgtggccttccacgtcccggacaaaccgaccggtccctcccgtgaaccctatcctcgtcggcctccgacggcccgaggaccgagctagattatactgctagctacataataacaattaacaaataacgaagtttgggagttacgggacggaaacgggaaacctaaaacgtcggaacccgttaccgttaagggtaccaaacggcccccgaaaagggtcccttaccggccccccgttcgggtacccttaacccg

SEQ ID NO: 309840 - DNA, 630 bp, Homo sapiens
  misc_feature: GZ8MTXP02F6670.51.38.D05.1.454.CMB.2.raw
  modified_base (462)..(462): a, c, t, g, unknown or other
  misc_feature (462)..(462): n is a, c, g, or t
tcagcgatcgtatacacgaccggtgctcgatttagtatctgatagttgggtttgggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcacgtgggaccaggcggtgactagttggtatttaataactatgtctcctggtaccagcaccaccaggaccaaacgcccccaaatcatgtatttatgatgtacagtgacgtccgcctggtaggggttcaactcgtcttctctggcctcgacgtccgacaaccgaccgtccctcccgtacgaccctactcctccgtcggccctaccgacgggccgacggacggacggtctagtattacgttacngtacgacgtctactaataacctaataataacaaaataacgtaagtttggggtacggttacgggacggggaacgggaaacctaaaacgtcggaacccgttaccgtagggtaccaacggtaccccgaaacggtcccgtacccggtcccccttacgggtaccctttacccg

SEQ ID NO: 309841 - DNA, 637 bp, Homo sapiens
  misc_feature: GZ8MTXP02IK77K.51.38.D05.1.454.CMB.2.raw
  modified_base (236)..(236): a, c, t, g, unknown or other
  misc_feature (236)..(236): n is a, c, g, or t
  modified_base (247)..(247): a, c, t, g, unknown or other
  misc_feature (247)..(247): n is a, c, g, or t
tcagcgatcgtatacacgaccggtgctcgatttagtatctgatagttgggtttggggtggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctctgcacgtgggaccaggcggtnactagttggtntttataactatgtctcctggtaccagcaccacccaggacaaacgacccccaaactccatgtatttatgatgtcagtgatcgcctcgtagggttcatccgtcttctcgtacgtctaccgaacgtccggacaaaccgccggtaccctcccgtacgacctactcctccgtcggtccctccgacgggcccgagggaccggtaacggctagtacgtttacttaccgtgcaacgtctactaactaactaactaaatacgtaaaacttaaacgtaaagtttggggtacgttacggggacgggtaacgggaaacctaaacgtccggtaaaccgttccgtacggtacgaaccgcccgaaacggtccttcccggccccgttcggaccttaccgtttcccg

SEQ ID NO: 309842 - DNA, 576 bp, Homo sapiens
  misc_feature: GZ8MTXP02FPU47.51.38.D05.1.454.CMB.2.raw
  modified_base (247)..(247): a, c, t, g, unknown or other
  misc_feature (247)..(247): n is a, c, g, or t
  modified_base (252)..(252): a, c, t, g, unknown or other
  misc_feature (252)..(252): n is a, c, g, or t
  modified_base (301)..(301): a, c, t, g, unknown or other
  misc_feature (301)..(301): n is a, c, g, or t
  modified_base (380)..(380): a, c, t, g, unknown or other
  misc_feature (380)..(380): n is a, c, g, or t
tcagcgatcgtatacacgaccggtgctcgatttagtatctgataggttgggtttggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactgggaccagcggtgacattggtgtttanaactntgtctctggtaccagcaccaccaggcaaacgccccaaatcatgatttangtatgtcagtgactcggcctgaggggttcaatcgcttctctggctccaacgtccgggcaacgccggcctccctgaaccntctctcggccctcgacggcccgaggaccgaggtctagtatttactacgtgctagctcatatacaatacaaattaaacgtaagtttggggtgttacggggacggtaacgggtaacccaaacgttcggacccgtacgtacgggaccacgaccccgaaaggccttaccggcccccgtcggttaccaccggttcttcccg

SEQ ID NO: 309843 - DNA, 753 bp, Homo sapiens
  misc_feature: GZ8MTXP02GOKXE.51.38.D05.1.454.CMB.2.raw
  modified_base (207)..(207): a, c, t, g, unknown or other
  misc_feature (207)..(207): n is a, c, g, or t
  modified_base (266)..(266): a, c, t, g, unknown or other
  misc_feature (266)..(266): n is a, c, g, or t
tcagcgatcgtatacacgaccggtgctcgatttagtatctgatagttgggtttgggggctttgcctgggctctgctattcctcaccctcctcactcagggcacagggtcctgggcccagtctgccctgactcagcctgcctccgtgtctgggtctcctggacagtcgatcaccatctcctgcactgggaccagcggtgacattggtntttataactatgtctctggtaccagcaccaccaggacaaacgccccaaatcatgattangatgtcagtgactcggccctaggtaggggtttacaagttccgtctttctccgtcggtacctaccgaaacgggtccggacaaaccgaccggtccctcccgtacgaacccctacttcctcgtcggccctaccggaaggggccggaaaggggacggacggggtaccttagtaaactttaacgttaccgtagacgtacgtcctacaaattaaactaacaaacttaactaaaacttaaaacgtaaagtttacgggggttacggttaccggggaacgggtaaacggggtaaaccctaaaacggtaccggtaacccgtaccgttagggtaccgaacggtaaccccgaaacgggtcccgtaccggtccccccgttacgggttaccctacccgttacccgttacccgtttaccccctaccccgttaccctttacccgtaccggttaaccgacccgtaacgtttcccggaacgggacggtaccgggcgtaaccgggg

SEQ ID NO: 309844 - DNA, 645 bp, Homo sapiens
  misc_feature: GZ8MTXP02FGR1G.51.38.D05.1.454.CMB.2.raw
  modified_base (170)..(170): a, c, t, g, unknown or other
  misc_feature (170)..(170): n is a, c, g, or t
  modified_base (247)..(247): a, c, t, g, unknown or other
  misc_feature (247)..(247): n is a, c, g, or t
  modified_base (253)..(253): a, c, t, g, unknown or other
  misc_feature (253)..(253): n is a, c, g, or t
  modified_base (258)..(258): a, c, t, g, unknown or other
  misc_feature (258)..(258): n is a, c, g, or t
  modified_base (309)..(309): a, c, t, g, unknown or other
  misc_feature (309)..(309): n is a, c, g, or t
  modified_base (445)..(445): a, c, t, g, unknown or other
  misc_feature (445)..(445): n is a, c, g, or t
tcagcgatcgtatacacgaccggtgctcgatttagtatctgataggttggggtttggggggggtctcaggaggcagcgctctcgggacgtctccaccatggcctgggctctgctattcctcaccctcctcactcagggcacagggtcctgggcccagtctgccctgactnagcctgcctccgtgtctgggtctcctggacagtcgatcaccatctcctgcactgggaccaggcggtgacagttggtntttaanaactntgtctctggtaccagcaccacccaggcaaacgcccccaaatcatgatttangatgcagtgatcggccctgtaggggttcaatcgccttctctggctcgaagtccggcaacgaccggcctcccgtgaccatcctcgtcggccctccgacggccgaagggacgagggctgtattagtactgcagtctanatactaacaatacgaaataaacgtaagtttggggtgttacggggacgggaacgggaaaccctaaaacgtaccggtaacccggttacccgttaaacggggtcccgaaacggtacccccgtaaaacgggccccgttaaccccggtccccccccggtttacggggttaacccctacccggtttacccgttttcccccccgggg

SEQ ID NO: 309845 - DNA, 588 bp, Homo sapiens
  misc_feature: GZ8MTXP02IMNAM.51.38.D05.1.454.CMB.2.raw
  modified_base (233)..(233): a, c, t, g, unknown or other
  misc_feature (233)..(233): n is a, c, g, or t
  modified_base (243)..(243): a, c, t, g, unknown or other
  misc_feature (243)..(243): n is a, c, g, or t
  modified_base (254)..(254): a, c, t, g, unknown or other
  misc_feature (254)..(254): n is a, c, g, or t
  modified_base (304)..(304): a, c, t, g, unknown or other
  misc_feature (304)..(304): n is a, c, g, or t
  modified_base (425)..(425): a, c, t, g, unknown or other
  misc_feature (425)..(425): n is a, c, g, or t
tcagcgatcgtatacacgaccggtgctcgatttagtatctgatagttgggtttgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactgggaccagcggtnactattggtntttaataactntgtctctggtaccagcaccaccagcaaacgcccccaaatcatgtatttangatgtcagtgatcggcctgtaggggttcaagtcgtcttctctgctacacgtccgcacacggtcctccctgaccatctctcgcctcgacgccgaggacgagctagattattactgcagctanattactaacaaggtacaaataacgtaacgttagggtcggttacggaacgggtacgggaaaccgtaaacgtacgtaaccggttaccgtacggtaccgtaaccgacccgaacggtaccgtacccggtcccccgtacggtcccgtaacccgttcccgtttaccccg

SEQ ID NO: 309846 - DNA, 582 bp, Homo sapiens
  misc_feature: GZ8MTXP02IBQMQ.51.38.D05.1.454.CMB.2.raw
  modified_base (248)..(248): a, c, t, g, unknown or other
  misc_feature (248)..(248): n is a, c, g, or t
tcagcgatcgtatacacgaccggtgctcgatttagtatctgatagttgggtttgggggaggcgtggtccagcctgggaggtccctgagactcgcctgtaaaccgtccggattcaccttcagtaactatgcaatgcactgggtccgccaggctccaggcaaggggctggactgggtggcaggcatatcatttgatggaagcaagaagtactatgcagactccgtgaagggccgattcacatctccaganacagttccgatgacacagtctatctacacatgagcagtgtgagacctgacgacacggtcttcttttttactgtcgcgaccgaaggaagcgagtcggcgtcggccacatcattgtcttttagattatcgtggacgaccgaaagggaacaagttggtacagtcgtctcttccggcccttacccaaccgaaacgggcccctacgttccggttcccttcccccgtcggccctacccctcctaccaaacgcgacctaccgtcgcgggggacacgacggccgtcccggtcggccgtcgcctcggtaacgaacggtactacctccgtacgtacgactaccg

SEQ ID NO: 309847 - DNA, 577 bp, Homo sapiens
  misc_feature: GZ8MTXP02FS78D.51.38.D05.1.454.CMB.2.raw
  modified_base (242)..(242): a, c, t, g, unknown or other
  misc_feature (242)..(242): n is a, c, g, or t
  modified_base (252)..(252): a, c, t, g, unknown or other
  misc_feature (252)..(252): n is a, c, g, or t
  modified_base (293)..(293): a, c, t, g, unknown or other
  misc_feature (293)..(293): n is a, c, g, or t
tcagcgatcgtatacacgaccggtgctcgatttagtatctgatagttgggtttgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactgggaccagcgtgactattggtntttataactntgtctcctgtaccagcaccaccaggcaaacgcccccaaacncatgatttatgatgtcagtgagtccgccctcgaggggtttcaaatcgccgttctctggcctccgaagtccgcgaacaccggccctccctgacccatctcgtcgccctccgacggccgacggacgagctgtattactactgcaagctacatataacaataccaaataactaaagtttggtagttacgggacggaacggtaaccaaaagtcggtaccgtaccgtacggtaccgaacgcccgaaagggcctcccggtcccctacggtccaacgttcgtttaccccgg

SEQ ID NO: 309848 - DNA, 574 bp, Homo sapiens
  misc_feature: GZ8MTXP02INJ6S.51.38.D05.1.454.CMB.2.raw
  modified_base (406)..(406): a, c, t, g, unknown or other
  misc_feature (406)..(406): n is a, c, g, or t
  modified_base (450)..(450): a, c, t, g, unknown or other
  misc_feature (450)..(450): n is a, c, g, or t
  modified_base (454)..(454): a, c, t, g, unknown or other
  misc_feature (454)..(454): n is a, c, g, or t
tcagcgatcgtatacacgaccggtgctcgatttagtatctgatagttgggtttgggggctggggtctcaggaggcagcgctctcgggacgtctccaccatggcctgggctctgctattcctcaccctctcactcagggcacagggtcctgggcccagtctgccctgactcagcctgcctccgtgtctgggtctcctggacagtcgatcaccatctcctgccactgggaccagcggtgactattggtgtttataactatgtctctggtaccagcaacaccaggcaaacgcccccaaatcatgtatttatgattgtcagtgactccggtcctcgtaaggggtttcaactcgtcttctcgtgcctaccaggtccggactaaaccgccggccctccgacgaccacgttcnccgtcggccctcgacggccgaaggacgaggctagatttattacngacngctacaatactacaatacaaacgttataagtttgggtgttacggacgggtaggaaccctaaaagtccgaccgttccgtagtcgaacgcctaacggcctacgcccccgttacggctacccg

SEQ ID NO: 309849 - DNA, 679 bp, Homo sapiens
  misc_feature: GZ8MTXP02FXVQL.51.38.D05.1.454.CMB.2.raw
  modified_base (319)..(319): a, c, t, g, unknown or other
  misc_feature (319)..(319): n is a, c, g, or t
tcagcgatcgtatacacgaccggtgctcgatttagtatctgatagttgggtttgggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcacgtgggaccagcggtgactagttggttatttaataacttatcgtctccgtggtaccagccaccaccgaggacaaacgccccaaatcatgtatttagngatgtcagtgacgtccggtcctgtaggggtttacaacgtccgtcttcgtcgtcggaccttaccgacgggtcccgaacctaaccgtacccgggtcccctaccctacgaccctactcccgttccgtcgggccctccgacggacccggaggacgacggtctagtaatttaacgttacgtgactacgtccttaataacttaaacctacgtaaacttaactaaaagttaaaccgttaaagggtttcgggtacggtttacgggacggggtaaacggtaaacctaaaacggtccgtaacccgttacgtacggtaccgaaccggtacccgaacggtccctcccgtcccccggtacggtcctaacccgg

SEQ ID NO: 309850 - DNA, 622 bp, Homo sapiens
  misc_feature: GZ8MTXP02JCFWP.51.38.D05.1.454.CMB.2.raw
  modified_base (262)..(262): a, c, t, g, unknown or other
  misc_feature (262)..(262): n is a, c, g, or t
  modified_base (279)..(279): a, c, t, g, unknown or other
  misc_feature (279)..(279): n is a, c, g, or t
  modified_base (320)..(320): a, c, t, g, unknown or other
  misc_feature (320)..(320): n is a, c, g, or t
  modified_base (470)..(470): a, c, t, g, unknown or other
  misc_feature (470)..(470): n is a, c, g, or t
  modified_base (474)..(474): a, c, t, g, unknown or other
  misc_feature (474)..(474): n is a, c, g, or t
tcagcgatcgtatacacgaccggtgctcgatttagtatctgatagttggggtttggggggggtctcaggaggcagcgctctcgggacgtctccaccatggcctgggctctgctattcctcaccctcctcactcagggcacagggtcctgggcccagtctgccctgactcagcctgccctccgtgtctgggtctccgtggacagtcgatccacatctcctgcacgtgggaccaggcggtgactagttggttatttaataactntcgtctccgtggtaccngaccaccaccgaggaccaaacgcccccaaatcatgatttangatgtcgagtgactcggcctaggtaggggttcaatcgtaccttctcgtcggactacgaacggttccgacaaccgccggtcctccgagtacctctcctcgcgccctacgacgggaccgaggacagtctagtacttactctagcagtcctanatanaactaaatacaaataacgtaagttcgggtaggttacgggacgggtaaacggaaccgtaaacgtacggtaacccgttacgtacgtaccgacgaacccggaacgtccgtcccggtacccccgtggtaaccttaccgttccgtttcccccg

SEQ ID NO: 309851 - DNA, 642 bp, Homo sapiens
  misc_feature: GZ8MTXP02HZ0VH.51.38.D05.1.454.CMB.2.raw
  modified_base (320)..(320): a, c, t, g, unknown or other
  misc_feature (320)..(320): n is a, c, g, or t
  modified_base (423)..(423): a, c, t, g, unknown or other
  misc_feature (423)..(423): n is a, c, g, or t
  modified_base (429)..(429): a, c, t, g, unknown or other
  misc_feature (429)..(429): n is a, c, g, or t
  modified_base (460)..(460): a, c, t, g, unknown or other
  misc_feature (460)..(460): n is a, c, g, or t
tcagcgatcgtatacacgaccggtgctcgatttagtatctgatagttgggtttgggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcacgtgggaccaggcggtgactagttggttgtttaataactatgtctcgtggtaccagcacccaccaggaccaaaccgaccccaaatcaatgtaatttangattgtacgagtgacgtccggccttacggtaggggtttacaacgtcgtcctttcgtcgttcggaccttaccgacggtccgacaaaccgccggtccctccgtanaccctntcctcgtcggtcctccgacggccgaggacgnggctagtactttacgtatcggactagtcctacaatactaaacaacgttacaaaacgtaagttaaggtcgggttacggtacgggacgggttaaaccggaaaccaaacggtacgtacccggttacgtaacgtccgaaacggtaccgtaacggtcctccccggtaccccgtcggttacctacccg

SEQ ID NO: 309852 - DNA, 583 bp, Homo sapiens
  misc_feature: GZ8MTXP02GSQAS.51.38.D05.1.454.CMB.2.raw
  modified_base (248)..(248): a, c, t, g, unknown or other
  misc_feature (248)..(248): n is a, c, g, or t
  modified_base (311)..(311): a, c, t, g, unknown or other
  misc_feature (311)..(311): n is a, c, g, or t
  modified_base (445)..(445): a, c, t, g, unknown or other
  misc_feature (445)..(445): n is a, c, g, or t
  modified_base (449)..(449): a, c, t, g, unknown or other
  misc_feature (449)..(449): n is a, c, g, or t
tcagcgatcgtatacacgaccggtgctcgatttagtatctgatagttgggtttgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcacgtgggaccaggcggtgactagtttggttntttaataactatgtctcctggtaccagcaccacccaggcaaacgcccccaaatcatgatttangatgtcagtgatccggcctgaggggtttcaatcgccttctctggctacgaacgtccggcaacgaccggcctcccgtagacctatcctctcgccctccgacggccgaggacgaggctagtattatactgcagctnatanacaatacaaataacgtaagttgggtacgttacgggacgggtaacggaacctaaacgtcggaacccgttcgaacggtccaacggacccgaaggtccgtaccggcccccttacggacctaccgttccgtttacccg

SEQ ID NO: 309853 - DNA, 529 bp, Homo sapiens
  misc_feature: GZ8MTXP02J5H6V.51.38.D05.1.454.CMB.2.raw
  modified_base (211)..(211): a, c, t, g, unknown or other
  misc_feature (211)..(211): n is a, c, g, or t
  modified_base (214)..(214): a, c, t, g, unknown or other
  misc_feature (214)..(214): n is a, c, g, or t
  modified_base (235)..(235): a, c, t, g, unknown or other
  misc_feature (235)..(235): n is a, c, g, or t
  modified_base (245)..(245): a, c, t, g, unknown or other
  misc_feature (245)..(245): n is a, c, g, or t
  modified_base (249)..(249): a, c, t, g, unknown or other
  misc_feature (249)..(249): n is a, c, g, or t
  modified_base (254)..(254): a, c, t, g, unknown or other
  misc_feature (254)..(254): n is a, c, g, or t
  modified_base (268)..(268): a, c, t, g, unknown or other
  misc_feature (268)..(268): n is a, c, g, or t
  modified_base (319)..(319): a, c, t, g, unknown or other
  misc_feature (319)..(319): n is a, c, g, or t
  modified_base (402)..(402): a, c, t, g, unknown or other
  misc_feature (402)..(402): n is a, c, g, or t
  modified_base (410)..(410): a, c, t, g, unknown or other
  misc_feature (410)..(410): n is a, c, g, or t
  modified_base (421)..(421): a, c, t, g, unknown or other
  misc_feature (421)..(421): n is a, c, g, or t
  modified_base (427)..(427): a, c, t, g, unknown or other
  misc_feature (427)..(427): n is a, c, g, or t
  modified_base (430)..(430): a, c, t, g, unknown or other
  misc_feature (430)..(430): n is a, c, g, or t
  modified_base (432)..(432): a, c, t, g, unknown or other
  misc_feature (432)..(432): n is a, c, g, or t
  modified_base (436)..(436): a, c, t, g, unknown or other
  misc_feature (436)..(436): n is a, c, g, or t
  modified_base (439)..(439): a, c, t, g, unknown or other
  misc_feature (439)..(439): n is a, c, g, or t
  modified_base (442)..(444): a, c, t, g, unknown or other
  misc_feature (442)..(444): n is a, c, g, or t
  modified_base (448)..(448): a, c, t, g, unknown or other
  misc_feature (448)..(448): n is a, c, g, or t
  modified_base (450)..(450): a, c, t, g, unknown or other
  misc_feature (450)..(450): n is a, c, g, or t
  modified_base (452)..(452): a, c, t, g, unknown or other
  misc_feature (452)..(452): n is a, c, g, or t
  modified_base (513)..(513): a, c, t, g, unknown or other
  misc_feature (513)..(513): n is a, c, g, or t
tcagcgatcgtatacacgaccggtgctcgatttagtatctgataggttgggtttggggtggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcacntcncctgcactgggaccagcggtnactattggtnttanaactntgtctctggtaccngccaccacccaggacaaacgcccccctaaatcatgtatttctgactgtacngtgatccggtccctcgtaggggttcgtaactccgtcttctcgtaggtctaccgaacgtccggacaaccgtcgcctacctcacncgtctcgnggctacgcgcnggacgngtntntatntgntgnnnatanananatataatagtagtagtaggtcggtggacgtacgacgtacgacgtacgacgcgcgcgacgcnccgccgtccgtcctcg

SEQ ID NO: 309854 - DNA, 560 bp, Homo sapiens
  misc_feature: GZ8MTXP02GU3ID.51.38.D05.1.454.CMB.2.raw
  modified_base (246)..(246): a, c, t, g, unknown or other
  misc_feature (246)..(246): n is a, c, g, or t
  modified_base (362)..(362): a, c, t, g, unknown or other
  misc_feature (362)..(362): n is a, c, g, or t
  modified_base (381)..(381): a, c, t, g, unknown or other
  misc_feature (381)..(381): n is a, c, g, or t
tcagcgatcgtatacacgaccggtgctcgatttagtatctgatagttgggtttgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactgggaccagcgtgacattggtgtttanaactatgtctcctggtaccagcaccacccaggcaaacgcccccaaatcatgatttatgatgtcagtgatcggcctcgagggtttcgaatcgccttctctgctcaagtccggcaacncggcctcctgaccatctcnggccctcgaggccgagacgacggctgattatactgcagctcatatacaatacaaataactaagttgggtacgttacgggacggaacgggaaccaaacgtcgaaccgtccgtaacggtccaacgtacccgaaagggtccctaccggtcccccgtcggtaccctaccgttccgtttccccg

SEQ ID NO: 309855 - DNA, 559 bp, Homo sapiens
  misc_feature: GZ8MTXP02IPDNH.51.38.D05.1.454.CMB.2.raw
  modified_base (315)..(315): a, c, t, g, unknown or other
  misc_feature (315)..(315): n is a, c, g, or t
  modified_base (394)..(394): a, c, t, g, unknown or other
  misc_feature (394)..(394): n is a, c, g, or t
  modified_base (399)..(399): a, c, t, g, unknown or other
  misc_feature (399)..(399): n is a, c, g, or t
  modified_base (402)..(402): a, c, t, g, unknown or other
  misc_feature (402)..(402): n is a, c, g, or t
  modified_base (451)..(451): a, c, t, g, unknown or other
  misc_feature (451)..(451): n is a, c, g, or t
  modified_base (456)..(456): a, c, t, g, unknown or other
  misc_feature (456)..(456): n is a, c, g, or t
  modified_base (541)..(541): a, c, t, g, unknown or other
  misc_feature (541)..(541): n is a, c, g, or t
tcagcgatcgtatacacgaccggtgctcgatttagtatctgatagttgggtttgggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcacgtgggaccagcggtgactattggtagtttataactatgtctcctggtaccagccaccacccaggacaaaccgcccccaaatcattgatttangatgctagtgacgtcggcctagtaggggtttcaacgtccgtcttctcgtggccttcgacgtcgacaaccgccgcctccngaccntcnctgacctcgacggcgtacggcgacggtctagacttattacctggactancttanactataactaatacgaaattaacaggttggtacgttacgggagtaacggaacaaacgtcggacctacgtggacaacgcgacgtcnccgtcccgtcgtctaccg

SEQ ID NO: 309856 - DNA, 600 bp, Homo sapiens
  misc_feature: GZ8MTXP02GNV8Q.51.38.D05.1.454.CMB.2.raw
  modified_base (318)..(318): a, c, t, g, unknown or other
  misc_feature (318)..(318): n is a, c, g, or t
  modified_base (343)..(343): a, c, t, g, unknown or other
  misc_feature (343)..(343): n is a, c, g, or t
  modified_base (360)..(360): a, c, t, g, unknown or other
  misc_feature (360)..(360): n is a, c, g, or t
tcagcgatcgtatacacgaccggtgctcgatttagtatctgatagttgggtttgggggaggcgtggtccagcctgggaggtccctgagactcgcctgtaaaccgtccggattcaccttcagtaactatgcaatgcactgggtccgccaggctccaggcaaggggctggactgggtggcaggcatatcatttgatggaagcaagaagtactatgcagactccgtgaaggccattcaccatctccagagacagttccgatgacacagtctatctacacatgagcagtgtgagacctgacgacacggtcttactttttacngtgcgcaggagcacgtgctgaccanactcatcgtctttgatntcgtggtacgaccgaaagggactagtcggtctaatcgtaccttcgttcccggcctacccgaccgaaacggcccctagtcccggttacccttcccccgtcggccctacccccgtccctacccgaagacgaccctaccgtcggacgggggcctaccggacggccggtcccggtcgggcccgtcggcccgttacggtaaccgaaacggtaccttacccgttccgtacggtacggtacctaccg

SEQ ID NO: 309857 - DNA, 593 bp, Homo sapiens
  misc_feature: GZ8MTXP02HG710.51.38.D05.1.454.CMB.2.raw
  modified_base (235)..(235): a, c, t, g, unknown or other
  misc_feature (235)..(235): n is a, c, g, or t
  modified_base (245)..(245): a, c, t, g, unknown or other
  misc_feature (245)..(245): n is a, c, g, or t
  modified_base (250)..(250): a, c, t, g, unknown or other
  misc_feature (250)..(250): n is a, c, g, or t
  modified_base (310)..(310): a, c, t, g, unknown or other
  misc_feature (310)..(310): n is a, c, g, or t
  modified_base (446)..(446): a, c, t, g, unknown or other
  misc_feature (446)..(446): n is a, c, g, or t
tcagcgatcgtatacacgaccggtgctcgatttagtatctgatagttgggtttggggtggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctctgcacgtgggaccagcggtnactattggtntttanaactatgtctctggtaccagcacccaccaggaccaaacgcccccaaactcatgtatttangatgtcagtgactcggccctgtaggggtttcatccgtacttctcgtcggctaccgaacgtccggacaacacccggccctcccgtagacctatcctcgcggccctccgaggccgaggacgaggctggacttattacngaccagtctacataactaacaatacaaattaacgtaagttggggtacgttacggacgggaacggaacctaaaacgtcggacccgtacgttacgggccaacggcccgaaaggtccgtacccgtcccgtaccggtcctacgtttccccg

SEQ ID NO: 309858 - DNA, 675 bp, Homo sapiens
  misc_feature: GZ8MTXP02JI2YS.51.38.D05.1.454.CMB.2.raw
tcagcgatcgtatacacgaccggtgctcgatttagtatctgatagttgggtttgggggctgggggtctcaggaggcagcgctctcgggacgtctccaccatggcctgggctctgctattcctcaccctcctcactcagggcacagggtcctgggcccagtctgccctgactcagcctgcctccgtgtctgggtctctggacagtcgatcaccatctcctgcactgggaccaggcggtgactagtttggtgtttataactatcgtcctccgtggtaccagccacccacccaggaccaaacgcccccaaactcatgtatttatgatgtacagtgagtccggtccctacgtaggggtttacaactcgtcctttctcgtcggtcctaccgacggtcccggaacaaaccgcccggtcctcccctagaccctatccttccgtcggtccctacccggacgggccgacgggacgtacggtcctagtatttacttacgtagccgtaagtctactaataactaacaaacttacctaaaataaccgttaaggttgggtacgggttacgggaccgggtaaacgggaaaccctaaacggtccgtaacccgttaccgttacggccgaaccggtaccccgtaaacggtcccgttaccccgtacccccggttcggtacccctttaccccgg

SEQ ID NO: 309859 - DNA, 578 bp, Homo sapiens
  misc_feature: GZ8MTXP02I4RZ4.51.38.D05.1.454.CMB.2.raw
  modified_base (243)..(243): a, c, t, g, unknown or other
  misc_feature (243)..(243): n is a, c, g, or t
  modified_base (253)..(253): a, c, t, g, unknown or other
  misc_feature (253)..(253): n is a, c, g, or t
  modified_base (302)..(302): a, c, t, g, unknown or other
  misc_feature (302)..(302): n is a, c, g, or t
tcagcgatcgtatacacgaccggtgctcgatttagtatctgatagttgggtttggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcacgtgggaccagcggtgactattggtntttataactntgtctctggtaccagcaccaccagcaaacgcccccaaatcatgatttangatgtcagtgactcggccctcgaggggtttcaatcgccttctctggctccgaagtccggcaaccgaccggtccctccctgaccatcctcgtggccctcgaggcccgaggacgacggctgaattactactgacagctcatataaccaattacaaataacaaagtttcggggtagttacgggacgggtaaacgggaccctaaaacgtcggaaacccgttcgtacgggtaccacgaccccgaaggcctcggtcccccctggtcccacgttcgttcccgg

SEQ ID NO: 309860 - DNA, 704 bp, Homo sapiens
  misc_feature: GZ8MTXP02G4Z8L.51.38.D05.1.454.CMB.2.raw
  modified_base (296)..(296): a, c, t, g, unknown or other
  misc_feature (296)..(296): n is a, c, g, or t
tcagcgatcgtatacacgaccggtgctcgatttagtatctgatagttgggtttgggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactgggaccagcggtgactagttggtgttataactatgtctctgtacagcaccaccaggacaacgacccccaaancatgtatttatgatgtcagtgagtccggcctcgacggggtttcaacgtcgacttctcgtcggtctaccacggtccgacaaaccgaccggccctcccgtacgaccctatccttccgtcggccctacccgacgggaccgacggggaaccgacgggtaccgtagtaacgtttaaattaccgttaggaccgtagtaccttaccaaacttaaacttaaaacctaaacttaaccggtaaaaattaaacccttaaagggtttacggggtacgggtttaccggggaccggggtaaaacggggtaaaccctaaaaccggttacggtaccccgttaccggtaacgggttacccaacggacccccgtaaaacgggtcccgtaccccggtaccccccgttccgggtaccctttaaccccg

SEQ ID NO: 309861 - DNA, 621 bp, Homo sapiens
  misc_feature: GZ8MTXP02FYMJA.51.38.D05.1.454.CMB.2.raw
  modified_base (315)..(315): a, c, t, g, unknown or other
  misc_feature (315)..(315): n is a, c, g, or t
tcagcgatcgtatacacgaccggtgctcgatttagtatctgatagttgggtttgggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactgggaccagcggtgacattggtgtttataactatgtctctggtaccagcaccaccaggcaaacgcccccaaatcatgattatgatgtcagtnatcggcctgtaggggttcaacgtcgtcttctcgtggcctccacggtccgacaaccgaccggccctcctacgacccacttcctcgtcggccctccgacgggaccgacggacgacgggctagtaactttattacgtgactacgtacctacaattactaacctaattactaaaacttaacgtaaaggtttcggggttacgttaccggggacgggaacgggaacctaaaacgtcggtacccgttaccgtacggtacgaaccggtacccgaaacggtccctacccggtcccccgttacggtaccttacccg

SEQ ID NO: 309862 - DNA, 620 bp, Homo sapiens
  misc_feature: GZ8MTXP02I0Q7V.51.38.D05.1.454.CMB.2.raw
  modified_base (311)..(311): a, c, t, g, unknown or other
  misc_feature (311)..(311): n is a, c, g, or t
  modified_base (394)..(394): a, c, t, g, unknown or other
  misc_feature (394)..(394): n is a, c, g, or t
tcagcgatcgtatacacgaccggtgctcgatttagtatctgatagttgggtttgggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcacatctcctgcacgtgggaccaggcggtgactagtttggtgtttaataactatgtctcctggtaccagcaccaccaggacaaacgccccaaatcatgattangatgtcagtgacgtcggcctgtaggggtttcaactcgcttctcgtggccttccgacgtccgactaaccgaccggcctacccgngacccacttcctcgtcggcctccgaggaccgacggacgacggctagtatttactactgactagctacataactaacgtaactaacaaaattaacgtaagtttcggggtacggttacgggacgggaaacggaaaccgtaaacgtcggtaacccgtaccggtaacggtaccgaacggaaccccgtaacggtcccgtacccggtcccccgttacggtacccttacccgg

SEQ ID NO: 309863 - DNA, 625 bp, Homo sapiens
  misc_feature: GZ8MTXP02F8S9K.51.38.D05.1.454.CMB.2.raw
  modified_base (216)..(216): a, c, t, g, unknown or other
  misc_feature (216)..(216): n is a, c, g, or t
  modified_base (246)..(246): a, c, t, g, unknown or other
  misc_feature (246)..(246): n is a, c, g, or t
  modified_base (252)..(252): a, c, t, g, unknown or other
  misc_feature (252)..(252): n is a, c, g, or t
  modified_base (257)..(257): a, c, t, g, unknown or other
  misc_feature (257)..(257): n is a, c, g, or t
  modified_base (271)..(271): a, c, t, g, unknown or other
  misc_feature (271)..(271): n is a, c, g, or t
  modified_base (306)..(306): a, c, t, g, unknown or other
  misc_feature (306)..(306): n is a, c, g, or t
tcagcgatcgtatacacgaccggtgctcgatttagtatctgatagttgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctccngcacgtgggaccagcggtgactagttggtntttaanaactntgtctctggtaccngcaccaccagacaaacgccccaaatcatgatttangatgtcagtgatcggccctgtaggggttcaattcgtcctttcgtctcggcctaccgaacggtcccgaccgtaaccgacccggtccccttccccgtacaccctacttccctccgtccgggaccccttccggaacggggcccggaagggaccggcggtacgttacggtatttaaacttcgtcgactacgctacaattaacaactaatactaaataacgtagttcgggtgtacgggacgggaacgtacgaaacgtcggacgtacgtcggtacaccgtaccgaacggcctacccgccccgtcggtacctaccgtccgttcccg

SEQ ID NO: 309864 - DNA, 652 bp, Homo sapiens
  misc_feature: GZ8MTXP02F8MD2.51.38.D05.1.454.CMB.2.raw
  modified_base (237)..(237): a, c, t, g, unknown or other
  misc_feature (237)..(237): n is a, c, g, or t
  modified_base (247)..(247): a, c, t, g, unknown or other
  misc_feature (247)..(247): n is a, c, g, or t
  modified_base (253)..(253): a, c, t, g, unknown or other
  misc_feature (253)..(253): n is a, c, g, or t
  modified_base (313)..(313): a, c, t, g, unknown or other
  misc_feature (313)..(313): n is a, c, g, or t
  modified_base (323)..(323): a, c, t, g, unknown or other
  misc_feature (323)..(323): n is a, c, g, or t
tcagcgatcgtatacacgaccggtgctcgatttagtatctgatagttgggtttgggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactgggaccagcggtnactattggtntttaanaacttatgtctcctggtaccagccaccacccaggccaaacgcccccaaatcatgatttangatgtcagtnatcggcctgagggttcactcgcttctctcggtcctaccgtagtcccggactaaaccgcccgggtccctacccgttacgaacctcttccgtccgtccggtccctaccgacgggcccgaacgggacgacggtcgtagtatttacttacgcgtacagtcctagaacttaacgtaacctaataacgtaaaacttaaacgtagtttacgggggtacgtttacggggaccggggtaaacggaaaccctaaaacgtccggtacccggttaccgtacggttaccgaacggacccgaaacggtcccgtaccccgtcccgttcggtaccctttacccgg

SEQ ID NO: 309865 - DNA, 575 bp, Homo sapiens
  misc_feature: GZ8MTXP02F1WWZ.51.38.D05.1.454.CMB.2.raw
  modified_base (317)..(317): a, c, t, g, unknown or other
  misc_feature (317)..(317): n is a, c, g, or t
  modified_base (329)..(329): a, c, t, g, unknown or other
  misc_feature (329)..(329): n is a, c, g, or t
  modified_base (342)..(342): a, c, t, g, unknown or other
  misc_feature (342)..(342): n is a, c, g, or t
tcagcgatcgtatacacgaccggtgctcgatttagtatctgatagttgggtttgggggaggcgtggtccagcctgggaggtccctgagactcgcctgtaaaccgtccggattcaccttcagtaactatgcaatgcactgggtccgccaggctccaggcaaggggctggactgggtggcaggcatatcatttgatggaagcaagaagtactatgcagactccgtgaagggccattcaccatctccagagacagttccgatgacacagtctatctacacatgagcagtgtgagacctgacgacacggcttctttttacngtgcgcaggaancagtgctggccanatcatgtcttttgatatcgtggacgcgaaagggacaagtggtacagttcgtccttcttcggccctacccaccgtaacgggcccctagtcccggtcccttcccccgtgggccctaccccctcctacccaaacgcgcctacccgtcgtcgggggaccacggacggcccgcccgtcggccgtcgcccgttcggaaccgaaacggtaccttaccgttccgtacggttacgcctaccg

SEQ ID NO: 309866 - DNA, 647 bp, Homo sapiens
  misc_feature: GZ8MTXP02HL8XY.51.38.D05.1.454.CMB.2.raw
  modified_base (309)..(309): a, c, t, g, unknown or other
  misc_feature (309)..(309): n is a, c, g, or t
  modified_base (330)..(330): a, c, t, g, unknown or other
  misc_feature (330)..(330): n is a, c, g, or t
tcagcgatcgtatacacgaccggtgctcgatttagtatctgatagttgggtttgggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactgggaccagcggtgacagttggtgtttataactatgtctcgtgtaccagcaccaccaggaccaaacgcccccaaatcatgatttangatgcagtgatcggcctacgnggggtttacactcgtcttctcgtgactcacgtccgactaaccgaccggcctacccgtagaccctatccgtccgtcgccctaccgacgggtaccgaggaccgggtacggtcctagtatttaacgttacctagacccgtagtcttacaattactaaacctaataacctaaaagttaaccgtaagtttacggggtacggttaccgggtacgggaacggtaaacccgtaaaacgtacggtacccggtaccgtttaacggaccgttaacggaccccggaaaggtaccccgtaccggtccccccgttacggttaacctccccg

SEQ ID NO: 309867 - DNA, 616 bp, Homo sapiens
  misc_feature: GZ8MTXP02FTE0I.51.38.D05.1.454.CMB.2.raw
tcagcgatcgtatacacgaccggtgctcgatttagtatctgatagttgggtttgggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactgggaccagcggtgactattggtgtttaataactatgtctcctggtaccagcaccaccaggaccaaacgcccccaaactcatgtatttatgatgtcagtgacgtccggccctggtaggggtttcaacgttccgtcttcgtctcggccttaccgacggtcccggacaaaccgacccgccctcccgtacgaccctatccgtcctcggccctccgacggcccgaggacgacggctagtattacttacgtgactagtcctacaattaactaacaataactaaataaacgtaagtttcgggtaggttacgggacggaacgggaaccctaaaacgttcgaacccgttacgtacggtacaacggcccgaaaggtcctaccgtccccgtacggtctacccg

SEQ ID NO: 309868 - DNA, 599 bp, Homo sapiens
  misc_feature: GZ8MTXP02IK42J.51.38.D05.1.454.CMB.2.raw
  modified_base (318)..(318): a, c, t, g, unknown or other
  misc_feature (318)..(318): n is a, c, g, or t
tcagcgatcgtatacacgaccggtgctcgatttagtatctgatagttgggtttgggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcacgtgggaccaggcggtagactagtttggtgtttaataactatgtctcctggtaccagccacccacccaggaccaaacgcccccaaatcatgattangatgcagtgatccggcctgtaggggtttcaactcgtcttctctggcctacacgtccgacaaaccgccggccctcccagaccctatcctcgtcgccctcgacggcccgaggaccgagactgtattacttactgcagtctacaatactaacaaactagaaactaaacgtagttgggtacggttacgggacgggtaacggaaacccaaacggttcggtaacccgtacgtaacggacgaaccgaccgaacggtcccgtcccgtacccccgtcggtaccctacccg

SEQ ID NO: 309869 - DNA, 614 bp, Homo sapiens
  misc_feature: GZ8MTXP02H6GA7.51.38.D05.1.454.CMB.2.raw
  modified_base (251)..(251): a, c, t, g, unknown or other
  misc_feature (251)..(251): n is a, c, g, or t
tcagcgatcgtatacacgaccggtgctcgatttagtatctgatagttgggtttgggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcacgtgggaccaggcggtgactagtttggtntttaataactatgtctctggtacagcaccaccaggcaaacgcccccaaatcatgatttatgatgtcagtgatcggcctacgagggtttcaatcgtcttctctggcctaccaggtccggacaaccgaccgccctcctgaccctactctctacgccctaccgaggaccgaggacgacggcctagtatttaacttacgtcgactagtctactaactaactaacaaacttactaaaacttaaacgtagtttaggggttacggttacgggacggtaaacggggaaacctaaacggtcgtacccgtaccgttaaggaccaacggacccgtaaacggtcccttccggcccccgttaggttaccctacccg

SEQ ID NO: 309870 - DNA, 598 bp, Homo sapiens
  misc_feature: GZ8MTXP02JASVY.51.38.D05.1.454.CMB.2.raw
  modified_base (223)..(223): a, c, t, g, unknown or other
  misc_feature (223)..(223): n is a, c, g, or t
  modified_base (287)..(287): a, c, t, g, unknown or other
  misc_feature (287)..(287): n is a, c, g, or t
  modified_base (318)..(318): a, c, t, g, unknown or other
  misc_feature (318)..(318): n is a, c, g, or t
  modified_base (333)..(333): a, c, t, g, unknown or other
  misc_feature (333)..(333): n is a, c, g, or t
  modified_base (358)..(358): a, c, t, g, unknown or other
  misc_feature (358)..(358): n is a, c, g, or t
tcagcgatcgtatacacgaccggtgctcgatttagtatctgatagttgggtttgggggaggcgtggtccagcctgggaggtccctgagactcgcctgtaaaccgtccggattcaccttcagtaactatgcaatgcactgggtccgccaggctccaggcaaggggctggactgggtggcaggcatatcatttgatggaagcaagaagtactatgacagactcgngaagggccattcacatctcagagacagttccgatgacacagtctatctacacatgagcagtgtnagacctgacgacacggtcttcttttttacgngtcgcgacgagacgngacgtcggctacgaccaatactacngttgttactttagtatatacgtacggacggaacgaaacggaaacgtaagtagtactacgtacgttcttcgttaccgtaccgtaccgtaaccgaaccggaccgtaccgtccgttcccgttaccccgtccgtaccctaccctacctacaacgacgaccgaccgtcggtcggacgacgacgaccggtccggtcggtcgtcgtcgtacgtaacgaacgtacgtacttactacgtacgtactacg

SEQ ID NO: 309871 - DNA, 628 bp, Homo sapiens
  misc_feature: GZ8MTXP02I03X9.51.38.D05.1.454.CMB.2.raw
  modified_base (270)..(270): a, c, t, g, unknown or other
  misc_feature (270)..(270): n is a, c, g, or t
  modified_base (431)..(431): a, c, t, g, unknown or other
  misc_feature (431)..(431): n is a, c, g, or t
tcagcgatcgtatacacgaccggtgctcgatttagtatctgatagttgggtttgggggctttgcctgggctctgctattcctcaccctcctcactcagggcacagggtcctgggcccagtctgccctgactcagcctgcctcgtgtctgggtctcctggacagtcgatcaccatctcctgcactgggaccaggcggtgactattggtatttaataactatgtctcctggtaccagccaccaccaggacaaacgccccaaatcatgattangatgtcagtgactccggcctcggtagggtttcaatcgtcttctcgtggtcctaccaacggtcccggactaaaccgaccggtccctaccgtagaccccctattccgtcgtccggccctcgacgggcccgagggacggacggtacctagtaactttattaacncgacacgcttacaataataacaatacaaagtaaactaggtgggttagtcgggacggtaacggaccaaatcggaccgtacgtaggtacaacgacccgaaggtcccgtccgccccttacgggtaccaccggttcccttccggttcccccgtccctccgtccgtacggtaaccgctacgtcgacggtcggcggacgtcgg

SEQ ID NO: 309872 - DNA, 676 bp, Homo sapiens
  misc_feature: GZ8MTXP02JP4VC.51.38.D05.1.454.CMB.2.raw
  modified_base (258)..(258): a, c, t, g, unknown or other
  misc_feature (258)..(258): n is a, c, g, or t
  modified_base (315)..(315): a, c, t, g, unknown or other
  misc_feature (315)..(315): n is a, c, g, or t
  modified_base (365)..(365): a, c, t, g, unknown or other
  misc_feature (365)..(365): n is a, c, g, or t
tcagcgatcgtatacacgaccggtgctcgatttagtatctgatagttgggtttgggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctctgcacgtgggaccagcggtgactagttggtatttataactntgtctcctggtaccagcaccaccgaggaccaaacgacccccaaatcatagtatttangatgtcagtgacgtccggcccctggtacggggtttcacgtccgtctttcncgtggacctccgacggtcccgacaaccgccgtccctacccgtagacctacgttcctcgtccgccctaccgacgggaccgtagggaccgtaggtaccttaggtactttaactcgtacgcgtaacgtctactaacttaactaacctaaacttaacctaaaagttaaaccgttaggtttacgggtacggttaccgggaaccgggtaaacgggaaacccttaaacggtccggtaacccgttaccgtaacggtacccgaaccggtaacccgtaacggtccccggtcccgtcccccggttacggtccctttaacccg

SEQ ID NO: 309873 - DNA, 734 bp, Homo sapiens
  misc_feature: GZ8MTXP02J1OE4.51.38.D05.1.454.CMB.2.raw
  modified_base (257)..(257): a, c, t, g, unknown or other
  misc_feature (257)..(257): n is a, c, g, or t
  modified_base (318)..(318): a, c, t, g, unknown or other
  misc_feature (318)..(318): n is a, c, g, or t
tcagcgatcgtatacacgaccggtgctcgatttagtatctgatagttgggtttgggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatcctcctgcacgtgggaccagcggtgactagtttggtgtttaanaacttatgtctcctggtaccagccaccacccaggaccaaacgcccccaaatcatgtattangtatgtcagtgactccggccctaggtaggggtttacaactccgtcttcgtcgtcggccttaccgacggtcccggacaaaccgaccggcccttcccgtagaccctattccgtcgtccgggtaccctacccgaggcccggaagggaccggaggtccttaggtactttaacgttaccgtcggactagtaccttacacttaaataacccttaaataacccgtaaaagttaaaccgtaaagggttttacgggggtacgtttacccgggggtaacgggaaaccggggaaaccccgttaaaaacggtccccggttaaaacccggttcccggtaaacgggtacccgaaccggggtacccccgaaacggggtacccccttacccccggggtcccccccgtttacggggtaccctttaacccccgg

SEQ ID NO: 309874 - DNA, 556 bp, Homo sapiens
  misc_feature: GZ8MTXP02JS82E.51.38.D05.1.454.CMB.2.raw
  modified_base (303)..(303): a, c, t, g, unknown or other
  misc_feature (303)..(303): n is a, c, g, or t
  modified_base (427)..(427): a, c, t, g, unknown or other
  misc_feature (427)..(427): n is a, c, g, or t
tcagcgatcgtatacacgaccggtgctcgatttagtatctgatagttgggtttgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactgggaccagcggtgacattggtgtttataactatgtctcctggtaccagcaccacccaggcaaagcccccaaatcatgatttangatgtcagtgatcggcctgaggggtttcaatcgccttctctggctcaagtccgggcaacacggcctccctgaccatctctcggccctccgaggccgaggacgaggctgattagtactgcagctnatatacaatacaaagtaacaagtttggggtgtttgggacggtacgggaccaaacgtcggaccgtaccttagggaccacgtaccccgaaggtacttcccggcccccgttcggtacctaccgtctttcccg

SEQ ID NO: 309875 - DNA, 640 bp, Homo sapiens
  misc_feature: GZ8MTXP02I8IOT.51.38.D05.1.454.CMB.2.raw
  modified_base (237)..(237): a, c, t, g, unknown or other
  misc_feature (237)..(237): n is a, c, g, or t
  modified_base (271)..(271): a, c, t, g, unknown or other
  misc_feature (271)..(271): n is a, c, g, or t
  modified_base (308)..(308): a, c, t, g, unknown or other
  misc_feature (308)..(308): n is a, c, g, or t
tcagcgatcgtatacacgaccggtgctcgatttagtatctgatagttgggtttgggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcacatctcctgcacgtgggaccagcggtnactattggtatttataactatgtctcgtgtaccngcaccaccaggacaaacgcccccaaatcatgtattangatgtctagtgacgtccggccctggtacgggtttacacgtccgtcttctcgtcgacctcgacggtccgacaaccgcccggtccctaccgtcgaccctctccgtccgtacggccctaccggacgggaccggaacggacggtacgtctagttactttacgtaactcggactacgtacctactaaacttaactaaaccaattaaacctaaaacgttaacgttaaaggtttcggggtacggttaccggggaacggacgggtaaacctaacggtacgtacccgtacggtacgaccgaacgtccgaacgtcccgtaccgtccctccggtacttacccg

SEQ ID NO: 309876 - DNA, 639 bp, Homo sapiens
  misc_feature: GZ8MTXP02GCMMX.51.38.D05.1.454.CMB.2.raw
  modified_base (272)..(272): a, c, t, g, unknown or other
  misc_feature (272)..(272): n is a, c, g, or t
  modified_base (494)..(494): a, c, t, g, unknown or other
  misc_feature (494)..(494): n is a, c, g, or t
tcagcgatcgtatacacgaccggtgctcgatttagtatctgatagttgggtttgggggctggggtctcaggaggcagcgctctcgggacgtctccaccatggcctgggctctgctattcctcaccctcctcactcagggcacagggtcctgggcccagtctgccctgactcagcctgcctccgtgtctgggtctcgtggacagtcgatcactatctcctgcactgggaccagcggtgactattggttatttataactatgtctctggtaccngcaccaccgaggaccaaacgcccccaaatcatcgtaatttagtagattgtacagtgtacgtcccggtcccgtggtacggggtttcaacgtccgtcttcgtcgtacggacctacctacgggtcccgaacaaaccgccccggtcccttaccccgagtaaccctattccgtccgtcggccctacggacgaccgaacgggacgacggtctaggtactttaagttcncgacagtctacaataacctataaactacgaaattaacgaaggtttcggggtagtacgggaccggaaggaaccctaaacgtcgtacccgtactacggacaaccgtacccgaacggtccctacccggcccgttccggacttaacccg

SEQ ID NO: 309877 - DNA, 680 bp, Homo sapiens
  misc_feature: GZ8MTXP02HFJXS.51.38.D05.1.454.CMB.2.raw
  modified_base (419)..(419): a, c, t, g, unknown or other
  misc_feature (419)..(419): n is a, c, g, or t
tcagcgatcgtatacacgaccggtgctcgatttagtatctgatagttgggtttgggggctttgcctgggctctgctattcctcaccctcctcactcagggcacagggtcctgggcccagtctgccctgactcagcctgcctccgtgtctgggtctcctggacagtcgatcaccatctcctgcactgggaccagcggtgacattggtgtttaataactatgtctcctggtaccagcaccaccaggacaaacgccccaaatcatgatttatgatgtcagtgactccggcctcgtaggggtttcaagtcgtcttctcgtcggcctaccgaacgtcccgacaaccgaccgtcctcctacgacccctactcctctcgggcctccgagggccggaggacggaggtcctagtaatttacgttacgngcgtactctactaataacgtaaactaactacgtaaaataaacgtaagttcgggggtttacggttacggggaaacggggtacggtaaaaccgtaaacgttaccgggtaaccgttacccgttaaggggtacccgaaccggaaccccgtaaacgggcccgtaccccgtcccccgttacgggtacctacccgtttccgtacccggttccccctccctaccggttccttcgaacgtctaccggttcgaggaccggtcggtacgacg

SEQ ID NO: 309878 - DNA, 500 bp, Homo sapiens
  misc_feature: GZ8MTXP02IUQQR.51.38.D05.1.454.CMB.2.raw
  modified_base (246)..(246): a, c, t, g, unknown or other
  misc_feature (246)..(246): n is a, c, g, or t
  modified_base (304)..(304): a, c, t, g, unknown or other
  misc_feature (304)..(304): n is a, c, g, or t
  modified_base (342)..(342): a, c, t, g, unknown or other
  misc_feature (342)..(342): n is a, c, g, or t
  modified_base (367)..(367): a, c, t, g, unknown or other
  misc_feature (367)..(367): n is a, c, g, or t
  modified_base (374)..(374): a, c, t, g, unknown or other
  misc_feature (374)..(374): n is a, c, g, or t
  modified_base (395)..(395): a, c, t, g, unknown or other
  misc_feature (395)..(395): n is a, c, g, or t
  modified_base (399)..(399): a, c, t, g, unknown or other
  misc_feature (399)..(399): n is a, c, g, or t
  modified_base (401)..(402): a, c, t, g, unknown or other
  misc_feature (401)..(402): n is a, c, g, or t
  modified_base (410)..(410): a, c, t, g, unknown or other
  misc_feature (410)..(410): n is a, c, g, or t
  modified_base (414)..(414): a, c, t, g, unknown or other
  misc_feature (414)..(414): n is a, c, g, or t
tcagcgatcgtatacacgaccggtgctcgatttagtatctgatagttgggtttggggggtctcaggaggcagcgctctcgggacgtctccgccatggcctgggctctgctattcctcacccctcctcactcagggcacagggtcctgggcccagtctgccctgactcagcctgcctccgtgtctgggtctcctggacagtcgatcaccatctcctgcactgggaccagcggtgacattggtgttanaactatgtctctggtaccagcaccaccaggaccaaacgcccccaaactcatgatttangatgtcagtcgatcggcctgagggtttcaatcgccttnctgctcaagtccgcacacgcctccngacatcnctgcctcagcgagcgagctgnttantnngctcatanacancaatacattgggtatcggacggacgacaaacgtcgaccgtctaggaccaggcccaaaggctaccgcccctgtaccacgttctcccg

SEQ ID NO: 309879 - DNA, 634 bp, Homo sapiens
  misc_feature: GZ8MTXP02F2L7G.51.38.D05.1.454.CMB.2.raw
  modified_base (237)..(237): a, c, t, g, unknown or other
  misc_feature (237)..(237): n is a, c, g, or t
  modified_base (444)..(444): a, c, t, g, unknown or other
  misc_feature (444)..(444): n is a, c, g, or t
tcagcgatcgtatacacgaccggtgctcgatttagtatctgatagttgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgccacgtgggaccaggcggtnactagtttgggtatttaataactatgtctcctggtaccagccaccacccaggacaaacgacccccaaactcatgatttatgattgtcagtgactccggccctgtagggttcgaatcgtccttctcgtggacctaccgaacgtccgggcaaaccgaccggtccctccctacgaccactctccgtcgccctacgacggacgaggaacgngctagtattatacgtgacagtactacaattaactaacaaactaactaaacgttaaacttaaaggttggggttaggttacgggacggtaacggaaacctaaacgtcgtacccgttaccgtaacgggtaccaaccggacccgtaaacggcctacccggcccccgtacggtaccctacgttccgtttcccccg

SEQ ID NO: 309880 - DNA, 612 bp, Homo sapiens
  misc_feature: GZ8MTXP02HJEKX.51.38.D05.1.454.CMB.2.raw
  modified_base (312)..(312): a, c, t, g, unknown or other
  misc_feature (312)..(312): n is a, c, g, or t
  modified_base (386)..(386): a, c, t, g, unknown or other
  misc_feature (386)..(386): n is a, c, g, or t
  modified_base (395)..(395): a, c, t, g, unknown or other
  misc_feature (395)..(395): n is a, c, g, or t
tcagcgatcgtatacacgaccggtgctcgatttagtatctgatagttgggtttgggggctgggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactgggaccaggcggtgactagttggtatttaataactatgtctctggtacagcaccaccaggacaaacgcccccaaatcatgaatttangatgtcagtgatccgcctacgtaggggttcaactcgtctctcgtgcctacacgtccgacaacgaccgccctccngacccatcnctcgcctcgacgcgaaggtacgaggtctagtattactactgacacgtcctataataagtaaacctaataaccgtaaaattaacgtaaaggtttcggggtacggtttacgggacggggtaaaccgggaacctaaaacggttccgtaacccggttaccgacgggtacaaccgaacccgtaacggacccgtcccgtacccccgtcggttaaccctcccgg

SEQ ID NO: 309881 - DNA, 607 bp, Homo sapiens
  misc_feature: GZ8MTXP02FLPCL.51.38.D05.1.454.CMB.2.raw
  modified_base (410)..(410): a, c, t, g, unknown or other
  misc_feature (410)..(410): n is a, c, g, or t
tcagcgatcgtatacacgaccggtgctcgatttagtatctgatagttgggtttgggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcacgtgggaccagcggtgactagttggtgtttaataactatgtctccgtggtaccagccaccaccaggaccaaacgacccccaaatcatgtatttatgatgtcagtgacgtccggtccctggtaggggtttacaacgtccgtccttctcgtcgcctaccgacgtcccggacaaaccgaccggccctcccncgaccctatcctcgtcgccctcgacggccgaggacgaggctagtatttatctgcagctacatactaacaataactaaataacgtaaggttggggtacgttaccgggacgggtaacggaaacctaaacgtccggtaccgtaccgtaggtaccaacggacccgaacggtcctacccggtccccgtacggtccttacccg

SEQ ID NO: 309882 - DNA, 736 bp, Homo sapiens
  misc_feature: GZ8MTXP02GK242.51.38.D05.1.454.CMB.2.raw
  modified_base (236)..(236): a, c, t, g, unknown or other
  misc_feature (236)..(236): n is a, c, g, or t
  modified_base (246)..(246): a, c, t, g, unknown or other
  misc_feature (246)..(246): n is a, c, g, or t
  modified_base (309)..(309): a, c, t, g, unknown or other
  misc_feature (309)..(309): n is a, c, g, or t
tcagcgatcgtatacacgaccggtgctcgatttagtatctgatagttgggtttgggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcatcaccatctcctgcagtgggaccagcggtnactattggtnttataactatgtctctggtaccagccaccaccgaggaccaaacgcccccaaatcatgatttangtatgtcagtgacgtccggcctaggtaacggggtttacaaccgttccgctttcgtcgtcggaccttaccgacggtcccgggacctaaaccgtacccgggcccccttaccccgtacgaacccctacgttcccgttaccggtacccgggtccccctaccggaaaccgggggtacccggaacggggtaaccggtaacggttccgtagttaaactttacgtttaccaggtacctacgtcttaactaataaactaaacggaaacttaactaaaacgtaaacgttaaggggtttgggttaaccgggtacggggaccggggtaaacgggtaaaccccttaaaaggtcccggtaaaaccgtttcccgaaggtacccgaacggacccccgtaaaggggtcccctacccggtacccccgtttcggtaccttaccccg

SEQ ID NO: 309883 - DNA, 601 bp, Homo sapiens
  misc_feature: GZ8MTXP02GV3HX.51.38.D05.1.454.CMB.2.raw
  modified_base (247)..(247): a, c, t, g, unknown or other
  misc_feature (247)..(247): n is a, c, g, or t
  modified_base (258)..(258): a, c, t, g, unknown or other
  misc_feature (258)..(258): n is a, c, g, or t
  modified_base (309)..(309): a, c, t, g, unknown or other
  misc_feature (309)..(309): n is a, c, g, or t
  modified_base (449)..(449): a, c, t, g, unknown or other
  misc_feature (449)..(449): n is a, c, g, or t
tcagcgatcgtatacacgaccggtgctcgatttagtatctgatagttgggtttgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcacgtgggaccaggcggtgactagttggttntttaataactntgtctcctggtaccagcaccaccaggcaaacgcccccaaatcatgatttangatgtcagtgatcggcctcgtaggggtttcaatcgccttcgtctcggctaccgaagtccgccaacacggccctccctgaccatctcgtcggccctcgacggccgaggacgaggctagtaactttataccgtgcagtctanaattacaaacaatacaaattaacgtaagtttggggtacggttacgggacgggtaacgggaaccctaaacgtccggtaacccgtaccgttaggacccacggtaccccgaagggtcctcccggaccccctcggtaccaccgttcgtttcccccg

SEQ ID NO: 309884 - DNA, 609 bp, Homo sapiens
  misc_feature: GZ8MTXP02HTD00.51.38.D05.1.454.CMB.2.raw
  modified_base (323)..(323): a, c, t, g, unknown or other
  misc_feature (323)..(323): n is a, c, g, or t
tcagcgatcgtatacacgaccggtgctcgatttagtatctgatagttgggtttgggggaggcgtggtccagcctgggaggtccctgagactcgcctgtaaaccgtccggattcaccttcagtaactatgcaatgcactgggtccgccaggctccaggcaaggggctgggactggggtggcaggcatatcattttgatggaagcaaagaagtactatgcagactccgtgaagggccattcaccatctcagagacagttccgatgacacagtctatctacacatgagcagtgtgacgacctgaacgacacggtcttctttttacngtcgcgacgaggaagcgaggtcgacgtcggaccacatcagtcgtacttttgattatcgtaggacgaccgaaaggactaagtcggtacagttcgttcctcgttccggaccctccaaccgtaacggcccctagtcccggttcccttccccgcggcccctacccgtcctacccgaaacggcgccctaccgtcgggacggggacccaacggtccggcccggtcccgtcgggccttccggccgttacgggaacgaaacggacctttaccgtaccgtacgtacgtacctacg

SEQ ID NO: 309885 - DNA, 677 bp, Homo sapiens
  misc_feature: GZ8MTXP02I482M.51.38.D05.1.454.CMB.2.raw
  modified_base (245)..(245): a, c, t, g, unknown or other
  misc_feature (245)..(245): n is a, c, g, or t
  modified_base (256)..(256): a, c, t, g, unknown or other
  misc_feature (256)..(256): n is a, c, g, or t
  modified_base (308)..(308): a, c, t, g, unknown or other
  misc_feature (308)..(308): n is a, c, g, or t
  modified_base (488)..(488): a, c, t, g, unknown or other
  misc_feature (488)..(488): n is a, c, g, or t
tcagcgatcgtatacacgaccggtgctcgatttagtatctgatagttgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcacatctctgcacgtgggaccaggcggtgactatttggtntttaataactntgtctctggtaccagcaccaccaggacaaacgcccccaaatcatgtatttangatgtctagtgacgtccggcccttggtacggggtttcaatccgtcctttctcgtcggccttccgaacggttccgacaaccgtaccggccctcccgtcgacctactcctcgtcggccctaccgacgggacccgaagggacgaggcttaggtaactttagttactcggactacgtaccttanaacttactaaacaaacttaacgtaaaacttaaaacgttaaggtttggggttacggttacggggaccgggtaaacgggtaaaccctaaaacgttccgggaaaaccgttccgtaacgggtaccaaccggacccaaacggggttccctcccggtacccccggtacgtaccctacctttaccggtttcccccg

SEQ ID NO: 309886 - DNA, 717 bp, Homo sapiens
  misc_feature: GZ8MTXP02HC8XA.51.38.D05.1.454.CMB.2.raw
  modified_base (249)..(249): a, c, t, g, unknown or other
  misc_feature (249)..(249): n is a, c, g, or t
  modified_base (270)..(270): a, c, t, g, unknown or other
  misc_feature (270)..(270): n is a, c, g, or t
  modified_base (336)..(336): a, c, t, g, unknown or other
  misc_feature (336)..(336): n is a, c, g, or t
  modified_base (348)..(348): a, c, t, g, unknown or other
  misc_feature (348)..(348): n is a, c, g, or t
tcagcgatcgtatacacgaccggtgctcgatttagtatctgatagttggggtttggggggggtctcaggaggcagcgctctcgggacgtctccaccatggcctgggctctgctattcctcaccctcctcactcagggcacagggtcctggggccccagtctcgccctgactcacgcctgcctccgtgtcgtgggtcctccgtggacagtcgatccactatcctctgccacggtcggaccaggtcggtanatagttggttattaataactntcgtcctcgtacggaccacgtccaaccaccgaggaccaaacccgtacccccaaatcatatatttangatgtagagtcncgtccgtaccgtaggtacggttacacgtcgtccttcgtcgtcgtaccgtacgaccgtaccgacctaaccgtcccgtacccctccgtactacctacgttccgtaccgtccgacccgtacggacgggaccggaaggtacgagtcgttaagttaacttacgcgtacgactacgtctactaactaaactaaactaaactaaactaaaacgttaaacgttaacggttacgggttacgggtacgggtaacgggtaaacgggtaaaccgtaaaccgtaaccggtaaccggtaaccggtaaccgtaaccgtaaccgaaccgtaaccggtacccgtacccgtaccccgtacccgtacccgtaccgttacccgttcccg

SEQ ID NO: 309887 - DNA, 745 bp, Homo sapiens
  misc_feature: GZ8MTXP02HWCHW.51.38.D05.1.454.CMB.2.raw
  modified_base (253)..(253): a, c, t, g, unknown or other
  misc_feature (253)..(253): n is a, c, g, or t
  modified_base (259)..(259): a, c, t, g, unknown or other
  misc_feature (259)..(259): n is a, c, g, or t
  modified_base (324)..(324): a, c, t, g, unknown or other
  misc_feature (324)..(324): n is a, c, g, or t
  modified_base (561)..(561): a, c, t, g, unknown or other
  misc_feature (561)..(561): n is a, c, g, or t
tcagcgatcgtatacacgaccggtgctcgatttagtatctgatagttgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcacatctcctgcacgtgggaccaggcggtgactagtttggttatttanaacttntgtcctcgtggtaccagccaacccacccgaggaccaaaccgaccccctaaatctatgtaatttanagtatgtactaggtacgacgtccggtcccgttaggtacggggttttaccaacgttccgtcccttttccgtcgtcggtaccttaccgaaccggtcccggaccgaaccgaccccggtccctcccccgttacgaacccttcgtccctccgtaccgccccgttaccggacggggacccggagggaaccggtacggtaccttaggttaactttacgttacgtacggtactacgtccttaaanaattaacctaaacctaaagtaacctaaaagttaaacgttaaaggttcgggggttacgttaccgggggaacggaaccggggtaaaaccctaaccggttacggtacccgttaacgtacggtaccgacccgacccgtaacggtcccctaccggtccccctacggtaccctccgtttcccgttccccg

SEQ ID NO: 309888 - DNA, 580 bp, Homo sapiens
  misc_feature: GZ8MTXP02FVI9A.51.38.D05.1.454.CMB.2.raw
tcagcgatcgtatacacgaccggtgctcgatttagtatctgatagttgggtttggggtggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactgggaccagcggtgactattggtgtttataactatgtctcctggtaccagcaccaccaggaccaaacgcccccaaatcatgtatttatgatgtcagtgactccggtcctcgaggggtttcagtccgtcttctctcggctccgaagtccgcaaacgaccggccctcccgtgacctattccttcggccctcgacggcgaggacgcggctagtattattactgactagtctcaattactaaacaatacgaaataacgtaagttgggtagtcgggtaggacgggaacctaacgtcggtaaccgtcgtacgtacgacgtcccgaaacgccgtaccgtcccccgtaggtacctactcgttacccg

SEQ ID NO: 309889 - DNA, 632 bp, Homo sapiens
  misc_feature: GZ8MTXP02JSSQ4.51.38.D05.1.454.CMB.2.raw
  modified_base (208)..(208): a, c, t, g, unknown or other
  misc_feature (208)..(208): n is a, c, g, or t
  modified_base (213)..(213): a, c, t, g, unknown or other
  misc_feature (213)..(213): n is a, c, g, or t
  modified_base (266)..(266): a, c, t, g, unknown or other
  misc_feature (266)..(266): n is a, c, g, or t
  modified_base (428)..(428): a, c, t, g, unknown or other
  misc_feature (428)..(428): n is a, c, g, or t
  modified_base (433)..(433): a, c, t, g, unknown or other
  misc_feature (433)..(433): n is a, c, g, or t
tcagcgatcgtatacacgaccggtgctcgatttagtatctgatagttgggtttgggggctttgcctgggctctgctattcctcaccctcctcactcagggcacagggtcctgggcccagtctgccctgactcagcctgcctccgtgtctgggtctcctggacagtcgatcaccatctcctgcactgggaccagcggtgacatttggtntttanaactatgtctctggtacagcaccaccaggacaaacgccccaaatcatgattangatgtcagtgacgtcggcctcgtaggggtttcaactcgtcttctcgtggtcctaccgaagtcccggacaaccgtaccggtcccctccctgacccctatcctcgtcggccctcgacgggcccggaggacggacgcgtagtatttaactcgtagacacgtctanataanaacaattacaaataacgtagttgggtacgtacggacgggtaacgaacaacgtcgtaaccgtacgtacggtacacggcctaaaggccgtccgcccccgtacggtacctaaccgttcccgttccggttacccccgcccttacccgttaccgtacgtaaccgccgtaccgtttacgcggtaccggcccgggttcgacccggg

SEQ ID NO: 309890 - DNA, 715 bp, Homo sapiens
  misc_feature: GZ8MTXP02I462V.51.38.D05.1.454.CMB.2.raw
  modified_base (319)..(319): a, c, t, g, unknown or other
  misc_feature (319)..(319): n is a, c, g, or t
  modified_base (359)..(359): a, c, t, g, unknown or other
  misc_feature (359)..(359): n is a, c, g, or t
tcagcgatcgtatacacgaccggtgctcgatttagtatctgatagttgggtttgggggaggcgtggtccagcctgggaggtccctgagactcgcctgtaaaccgtccggattcaccttcagtaactatgcaatgcactgggtccgccaggctccaggcaaggggctggactgggtgcaggcatatcatttgatggaagcaagagtactatgcagactccgtgaagggccattcaccatctccagacgacagttccgatgacacagtctatctacacatgagcagtgtgagacctgaccgacgacgtcttctttttacgngtcgcgtaccgaggaagctacggtcggcgtcggaccctanacttcagttgttcctttttaggactttacgttcgtagggtaacgacccggaaaagggggtacctaagttacggggtactagtttccgttcccgtttccgtttacccgggccccttacccgaacccggtaaacccgggggtcccccttacggttccccgggtttcccctttccccccgttcgggtaccccctacccccgttacccttacccgaaacggtaccgtcccgtaacccgtccgggtccgggggaccaccggtacgggccccgggtcccggtcggggtccgtaccggtcccgttacggggtaaccgaaacgggtacctttaccgttcccggtacgttaccgccgtttaaccg

SEQ ID NO: 309891 - DNA, 591 bp, Homo sapiens
  misc_feature: GZ8MTXP02IXBZV.51.38.D05.1.454.CMB.2.raw
  modified_base (238)..(238): a, c, t, g, unknown or other
  misc_feature (238)..(238): n is a, c, g, or t
  modified_base (315)..(315): a, c, t, g, unknown or other
  misc_feature (315)..(315): n is a, c, g, or t
  modified_base (453)..(453): a, c, t, g, unknown or other
  misc_feature (453)..(453): n is a, c, g, or t
  modified_base (464)..(464): a, c, t, g, unknown or other
  misc_feature (464)..(464): n is a, c, g, or t
tcagcgatcgtatacacgaccggtgctcgatttagtatctgatagttgggtttgggggctggggtctcaggaggcagcgctctcgggacgtctccaccatggcctgggctctgctattcctcaccctcctcactcagggcacagggtcctgggcccagtctgccctgactcagcctgcctcgtgtctgggtctcctggacagtcgatcaccatctcctgcacgtgggaccaggcggtnactagtttgggtatttaataactatgtctcctggtaccagccaccacccaggacaaacgccccaaatcatgatttangatgtcagtgatccggccctgtaggggtttcaactcgtcttctctggcctcagtccggacaaaccgtaccggcccttcccgagacctatcctctcggccctcgacgcggagacgaggctagtatttactacgtgacanctacaaattanaactaaactactaaaataaacgtaagttcgggtacgttcggacgggacgggtaaaccaaacgtcggtaccgttactacgggacaacgaccccgtaaggccctaccgtcccccgtacggtcctaaccg

SEQ ID NO: 309892 - DNA, 703 bp, Homo sapiens
  misc_feature: GZ8MTXP02F3JNK.51.38.D05.1.454.CMB.2.raw
  modified_base (209)..(209): a, c, t, g, unknown or other
  misc_feature (209)..(209): n is a, c, g, or t
  modified_base (272)..(272): a, c, t, g, unknown or other
  misc_feature (272)..(272): n is a, c, g, or t
  modified_base (311)..(311): a, c, t, g, unknown or other
  misc_feature (311)..(311): n is a, c, g, or t
tcagcgatcgtatacacgaccggtgctcgatttagtatctgatagttggggtttgggggctttgcctgggctctgctattcctcaccctcctcactcagggcacagggtcctgggcccagtctgccctgactcagcctgcctcgtgtctgggtctcctggacagtcgatcacatctctgcacgtgggaccaggcggtgactagttggtntttaataactatgtctccgtggtaccagccaccaccgaggccaaacgccccaatcatgattangatgcagtgactccggcctgtagggtttcatcgtctctntggtctaccgaagtccggactaaccgaccggtcctacccgtagacccctatccgtcgtccggcctacccggagggccgggaagggccgaagggtcccttaggaacttttacgtaacgtagaccgtacgtacctacgaaacttaaagtaaactaacggttaccaaaagttaaccggaagtttcgggggtacgttaccggggaacgggtaacgggtaaaccctaacgtcgggtaacccgttacgtacgggacccaggaacccgtagggtccctaaccggtcccccgtaggtccctaaccgttccccgttacgggttcccccaccctttcccgtacggtttacccgaaccggttaccctccggttacgccgggacggtccgggttaccgtaacgg

SEQ ID NO: 309893 - DNA, 653 bp, Homo sapiens
  misc_feature: GZ8MTXP02GS0HA.51.38.D05.1.454.CMB.2.raw
  modified_base (314)..(314): a, c, t, g, unknown or other
  misc_feature (314)..(314): n is a, c, g, or t
  modified_base (320)..(320): a, c, t, g, unknown or other
  misc_feature (320)..(320): n is a, c, g, or t
tcagcgatcgtatacacgaccggtgctcgatttagtatctgatagttgggtttgggggctggggtctcaggaggcagcgctctcgggacgtctccaccatggcctgggctctgctattcctcacccctcctcactcagggcacagggtcctgggcccagtctgccctgactcagcctgcctcgtgtctgggtctcctggacagtcgatcaccatctcctgcacgtgggaccaggcggtgactagttggttatttataactatcgtctctggtacagccaccaccaggacaaacgcccccaaatcatgtatttangatgtnagtgacgtccggacctgtaggggtttacactcgtcttcgcgttggcctaccacggtcccgaacaaccgaccggtccctcccgtagaccctactcctccgtcgacccgtccgacgggaccggaagggacgtacggacttacgtaatttaagttacctagcgtaactctactaactaaactaaacgtaataacctaaaagttaaaccgtaaggtttcgggggttacgggttacgggacggggtaaacggtaaaccctaaacggttacggaacccgttacggtacgtaccgaacgacccgtaacgtccgtaccccgtcccgtaccgtttacacccg

SEQ ID NO: 309894 - DNA, 656 bp, Homo sapiens
  misc_feature: GZ8MTXP02JHR3I.51.38.D05.1.454.CMB.2.raw
  modified_base (128)..(128): a, c, t, g, unknown or other
  misc_feature (128)..(128): n is a, c, g, or t
  modified_base (218)..(218): a, c, t, g, unknown or other
  misc_feature (218)..(218): n is a, c, g, or t
  modified_base (237)..(237): a, c, t, g, unknown or other
  misc_feature (237)..(237): n is a, c, g, or t
  modified_base (250)..(250): a, c, t, g, unknown or other
  misc_feature (250)..(250): n is a, c, g, or t
  modified_base (326)..(326): a, c, t, g, unknown or other
  misc_feature (326)..(326): n is a, c, g, or t
  modified_base (372)..(372): a, c, t, g, unknown or other
  misc_feature (372)..(372): n is a, c, g, or t
  modified_base (419)..(419): a, c, t, g, unknown or other
  misc_feature (419)..(419): n is a, c, g, or t
tcagcgatcgtatacacgaccggtgctcgatttagtatctgatagttgggtttggggtggggtctcaggaggcagcgctctcgggacgtctccaccatggcctgggctctgctattcctcaccctccncactcagggccctagggtcctgggcccagtctgccctgactcagcctgcctccgtgtctgggtctcctggacagtcgatcaccatctccngcacgtgggaccagcggtnactagtttggttnttttaataactatgccttccgtggtaccagccaacccacccgaggaccaaaccgacccccaaactcatgtatttangatgtcagtgactccggccctggtaggggtttcaatcccgtcttcncgtcggctccgaacgtcccggacaaaccgccgccctccctcgacctntcctcgtcggccctggggaccggacccgaggacgtacggcgttagtaactttaacgttacgcgtactacgtactactaactaactaactaaactaactaaactaactaaaggtttacggggttacgggttacggggtacggggtaaacgggcctaaaccgtacggtaaccggtaccgtacggtaccgaacggaacccgaacggaccgtccggtcccccgtccggtaccgtaccctcg

SEQ ID NO: 309895 - DNA, 728 bp, Homo sapiens
  misc_feature: GZ8MTXP02H9Y1U.51.38.D05.1.454.CMB.2.raw
  modified_base (244)..(244): a, c, t, g, unknown or other
  misc_feature (244)..(244): n is a, c, g, or t
  modified_base (266)..(266): a, c, t, g, unknown or other
  misc_feature (266)..(266): n is a, c, g, or t
  modified_base (305)..(305): a, c, t, g, unknown or other
  misc_feature (305)..(305): n is a, c, g, or t
tcagcgatcgtatacacgaccggtgctcgatttagtatctgatagttgggtttgggggctggggtctcaggaggcagcgctctcgggacgtctccaccatggcctgggctctgctattcctcaccctcctcactcagggcacagggtcctgggcccagtctgccctgactcagcctgcctcgtgtctgggtctcctggacagtcgatcaccatctcctgcactgggaccagcgtgacattggtnttataactatgtctctgtaccngcacaccaggccaaagccccccaaatcatacgtatttangatgtcacgtgactccggtccttcgtacggggtttacaaccttccggtctttcctcggtcggtacctacccgtacgggtcccggaccaaacccggaaccggtcccccttaccgtccgtaaccctacgttcccttcggtccggtacccgtaccgaacggggacccggacggggtaacggacgggtacgtaggtactttaacttaccgtgacgtacgtacctcgtaaacttactaacaaaactttaccaaaagttaaccgtaaacgtttgggggttacggttttccgggggaaccgggggtacgggtaaacccgtaaaacggttaccggtaccccggttaccgtttaacgggttacgaacccggaccccggttaaacggtaccccgtacccggtcccccgtttaaccgggacccctttaccccgg

SEQ ID NO: 309896 - DNA, 228 bp, Homo sapiens
  misc_feature: GZ8MTXP02IDN97.51.38.D05.1.454.CMB.2.raw
tcagcgatcgtatacacgaccggtgctcgatttagtatctgatagttgggtttgggggggtctcaggaggcagcgctctcgggacgtctccaccatggcctgggctctgctattcctcaccctcctcactcagggcacagggtcctgggcccagtctgccctgactcagcctgcctccgtgtctggggtctcctggacagtcgatccacatctcctgcacgtgggacc

SEQ ID NO: 309897 - DNA, 587 bp, Homo sapiens
  misc_feature: GZ8MTXP02H9C0Q.51.38.D05.1.454.CMB.2.raw
  modified_base (413)..(413): a, c, t, g, unknown or other
  misc_feature (413)..(413): n is a, c, g, or t
tcagcgatcgtatacacgaccggtgctcgatttagtatctgatagttgggtttgggggctttgcctgggctctgctattcctcaccctcctcactcagggcacagggtcctgggcccagtctgccctgactcagcctgcctccgtgtctgggtctcctggacagtcgatcaccatctcctgcactgggaccagcggtgacattggtgtttataactatgtctcctggtaccagccaccacccaggaccaaacgcccccaaatcatgtatttatgatgtcagtgatccggccctcgaggggtttcaatcgtcttctctgcctccgaacgtcccgacaaccgacggccctccctgacccctatcctcgtcggccctccgaggccgagggacgagggtctagtatttatactgacngtctcatatacaatacaaataacgtaagttgggtacgttacgggcggaacggacctaacgtcgacccgttccgtaggtccacgacccgaaggcctacgccccctacggtccactccgttaccgtcccctaccctccgtctacgtaacgcctacgtcgtggacggcggcgtacgg

SEQ ID NO: 309898 - DNA, 666 bp, Homo sapiens
  misc_feature: GZ8MTXP02I5S71.51.38.D05.1.454.CMB.2.raw
tcagcgatcgtatacacgaccggtgctcgatttagtatctgatagttgggtttgggggctggggtctcaggaggcagcgctctcgggacgtctccaccatggcctgggctctgctattcctcaccctcctcactcagggcacagggtcctgggcccagtctgccctgactcagcctgcctcgtgtctgggtctcctggacagtcgatcaccatctcctgcacgtgggaccaggcggtagactagtttgggttagtttaataaactatggttctccgtggtaccagccacccacccaggacaaacgcccccaaatcatagatttatgatgtcagtgactccgcctcgtaggggtttcaacgtcgtcttcgtcgtgtcctaccgacgtcccgacaaccgaccggccctccctagacactccttcgtcgccctccgacgggccgacggacggtacgctagtactttaactacgttcgacgtacgcctacgtaaataactaacctaaattaactaaaacttaaaccgtaggtttacgggggttacggtttacggggacggggtaaacgggtaaccctaaaacgttacgggtacccgttacggtaacggttaccaacggaccccggtaaacggtcccgtacccggtcccccgtacggtacctttaacccgg

SEQ ID NO: 309899 - DNA, 643 bp, Homo sapiens
  misc_feature: GZ8MTXP02JAZR1.51.38.D05.1.454.CMB.2.raw
  modified_base (238)..(238): a, c, t, g, unknown or other
  misc_feature (238)..(238): n is a, c, g, or t
  modified_base (313)..(313): a, c, t, g, unknown or other
  misc_feature (313)..(313): n is a, c, g, or t
tcagcgatcgtatacacgaccggtgctcgatttagtatctgatagttgggtttggggtggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatcctcctgccacgtgggaccagcggtnactagttggtgtttaataactatgtctcctggtaccagcaccaccaggaccaaacgccccaaatcatgtatttangtatgtcagtgactcggccctagtacggggttcaatcccgtcttcgtacgtggtacctaccgtaacgtcccgggacaaaccgccggtcccctcccgtagaaccctattcctacgtcggccctacggacggtcccggaggaccgaggtctagtaacttacgtacgtgacacgtctacgtaattaactaactaatacaaaattaacaagggtttgggtacggttaccgggacgggaacggaaacctaaacgtccggtaaccgttccgtaacggtacgacggaaccccgaaagggtccctacccgggcccccttacggtacctactttcccgg

SEQ ID NO: 309900 - DNA, 666 bp, Homo sapiens
  misc_feature: GZ8MTXP02G54WA.51.38.D05.1.454.CMB.2.raw
  modified_base (236)..(236): a, c, t, g, unknown or other
  misc_feature (236)..(236): n is a, c, g, or t
  modified_base (247)..(247): a, c, t, g, unknown or other
  misc_feature (247)..(247): n is a, c, g, or t
  modified_base (313)..(313): a, c, t, g, unknown or other
  misc_feature (313)..(313): n is a, c, g, or t
  modified_base (488)..(488): a, c, t, g, unknown or other
  misc_feature (488)..(488): n is a, c, g, or t
tcagcgatcgtatacacgaccggtgctcgatttagtatctgatagttgggtttgggggctggggtctcaggaggcagcgctctcgggacgtctccaccatggcctgggctctgctattcctcaccctcctcactcagggcacagggtcctgggcccagtctgccctgactcagcctgcctcgtgtctgggtctcctggacagtcatcaccatctcctgcacgtgggaccagcggtnactatttggtntttataactatcgtctctggtaccagcaccaccaggacaaaccgacccccaaatcatagtatttangtatgtacagtgacgtccggtccccttggtacggggtttcaactcgtcttcgtcgtcgccttacacgtcccggactaaaccgccgtccctccctacgaccctacgttcctcgtccggtaccctaccgacgggaccggacgggaacggtacgccggttataactttaagttaccgngacgtagtccttacgtaaattacctaaaataaactaaactaaaacgttaacggtaagggtttcgggttacgggtacggggaaaccgggtaaccggtaaaaccgtaaccggtacgtacccgtacgtaccggaccgaaccggaccgaccggtccctcccgtacccccgtcgtacctaccg

SEQ ID NO: 309901 - DNA, 761 bp, Homo sapiens
  misc_feature: GZ8MTXP02GNDI7.51.38.D05.1.454.CMB.2.raw
  modified_base (235)..(235): a, c, t, g, unknown or other
  misc_feature (235)..(235): n is a, c, g, or t
  modified_base (255)..(255): a, c, t, g, unknown or other
  misc_feature (255)..(255): n is a, c, g, or t
tcagcgatcgtatacacgaccggtgctcgatttagtatctgatagttgggtttgggggggtctcaggaggcagcgctctcgggacgtctccaccatggcctgggctctgctattcctcaccctcctcactcagggcacgagggtcctgggcccagtcctgccctgactcagcctgcctccgtgtcgtgggtctccgtggacagtcgatcacatctcctgcacgtggacagcggtnactgttggttattataactntcgtctctgaccagcaccaccagaccaaaccgcccccaaatcagtacgtatttagtgaatcgtactaggtacgacccggttcccggacccgttagggttaacggggtttaccaacgttccgttccctttccgtcgtcggtaccttaaccggaaccggttccggacccgtaaccggtacccgggtcccccttacccgtacggaacccttacgttcccgttccgtacccggttaccccgacgggaaccggggacccggaaacgggtaacggtccggtacttacggttactttaaccgttcgtgaccgtacgtacttaactaacttaactaaacaaccttaacggtaaacgttaaaggttaacgggtttggggtaccggggtaaccggggacggtaaaacccggaaacctaaaccggttccggaaaccgttacggtaacggtaccgaacccgtaccggaacgtccccgtacccgtacccggttacgaccttcccgtttcccgtcccccg

SEQ ID NO: 309902 - DNA, 763 bp, Homo sapiens
  misc_feature: GZ8MTXP02IDB77.51.38.D05.1.454.CMB.2.raw
  modified_base (274)..(274): a, c, t, g, unknown or other
  misc_feature (274)..(274): n is a, c, g, or t
tcagcgatcgtatacacgaccggtgctcgatttagtatctgatagttgggtttgggggctttgcctgggctctgctattcctcaccctcctcactcagggcacagggtcctgggcccagtctgcccctgactcagcctgcctccgtgtctgggtctcctggacagtcgatcaccatctcctgcacgtgggaccaggcggtgactagttggtagtttaataactatgtctctggtaccagcaccaccaggacaaacgccccaaatcatgtattangatgtacagtgactccggcctcgtaggggtttcaagttcgctttcgcgtggtcctaccgaagtcccggacaaaccgcccggtcccctccccgtgaaccccctacttcctccgtcggcccttacccggacgggccccggaagggacggacgggtaccttaggtaactttacgtttaacccggtcgtaccgtaacgtacctaacgtaaacttaaacttaaacctaaacttaacgtaaaaacgttaaacggttagggtttacggggttaccgggttaccggggaaccggggtaaaccggtaaaccgtaaaccggtacccggtacccgttaccggtaacggtacccgaaccggacccggtaaccggtccccgtaccccggtacccccgttacgtaccgttacccttacccgtttaccccgtccccctaccccgtttccgtacctaccggtaaccgtacctacgtcggtacgggtaccggcgggttacgacggg

SEQ ID NO: 309903 - DNA, 717 bp, Homo sapiens
  misc_feature: GZ8MTXP02HAMWJ.51.38.D05.1.454.CMB.2.raw
  modified_base (236)..(236): a, c, t, g, unknown or other
  misc_feature (236)..(236): n is a, c, g, or t
  modified_base (247)..(247): a, c, t, g, unknown or other
  misc_feature (247)..(247): n is a, c, g, or t
  modified_base (257)..(257): a, c, t, g, unknown or other
  misc_feature (257)..(257): n is a, c, g, or t
  modified_base (271)..(271): a, c, t, g, unknown or other
  misc_feature (271)..(271): n is a, c, g, or t
  modified_base (306)..(306): a, c, t, g, unknown or other
  misc_feature (306)..(306): n is a, c, g, or t
tcagcgatcgtatacacgaccggtgctcgatttagtatctgatagttgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcacgtgggaccaggcggtnactagttggtntttataactntgtctctggtaccngcaccaccagcaaacgcccccaaatcatgatttangatgtcagtgagtccggccgtcgtaggggtttcaagttcgtccttctcgtcggtcctacgaacggttcccgccaaccgaccgggtccccttcccgtacgaaccctctcccgttccgtcggtccccgtaccgacggggtcccggaagggacggacggtcttaggtaactttaagttaccgtgaccgtacgtaccttactaaacttactaaactaaactaaacaaaacgttaaaacgtaaggtttcgggggttacggttaccggggaacggggtaaaacgggtaaacccgtaaaacggttaccggtaacccggttaccggttaacggttaccgaacccgggtaacccgtaaacgggtccccgtaccccggtacccccgttcgggtaacccttcccgttacccgtttcccccgg

SEQ ID NO: 309904 - DNA, 560 bp, Homo sapiens
  misc_feature: GZ8MTXP02FT9DO.51.38.D05.1.454.CMB.2.raw
  modified_base (256)..(256): a, c, t, g, unknown or other
  misc_feature (256)..(256): n is a, c, g, or t
  modified_base (301)..(301): a, c, t, g, unknown or other
  misc_feature (301)..(301): n is a, c, g, or t
  modified_base (311)..(311): a, c, t, g, unknown or other
  misc_feature (311)..(311): n is a, c, g, or t
  modified_base (317)..(317): a, c, t, g, unknown or other
  misc_feature (317)..(317): n is a, c, g, or t
  modified_base (357)..(357): a, c, t, g, unknown or other
  misc_feature (357)..(357): n is a, c, g, or t
  modified_base (463)..(463): a, c, t, g, unknown or other
  misc_feature (463)..(463): n is a, c, g, or t
  modified_base (498)..(498): a, c, t, g, unknown or other
  misc_feature (498)..(498): n is a, c, g, or t
  modified_base (509)..(509): a, c, t, g, unknown or other
  misc_feature (509)..(509): n is a, c, g, or t
  modified_base (535)..(535): a, c, t, g, unknown or other
  misc_feature (535)..(535): n is a, c, g, or t
  modified_base (544)..(544): a, c, t, g, unknown or other
  misc_feature (544)..(544): n is a, c, g, or t
  modified_base (550)..(550): a, c, t, g, unknown or other
  misc_feature (550)..(550): n is a, c, g, or t
tcagcgatcgtatacacgaccggtgctcgatttagtatctgatagttgggtttgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcatcaccatctcctgcacgtgggaccagcggtgactagttggtagtttaataactntcgtctccgtggtaccagcaccacccaggacaaacgcccccaaancatgatttangatgtnagtgactccggcctcgtaggggttcaactcgtccttctcnggtctaccgaagtccgggcaaccgacggtccctcccgtcgaacctatcgtctcggccctccgaacggcccgaggaacgcggctagtattacgtactgctagcctanataactacaatacaacgtataagttggtgtacggngacggacaaancgacggcttacgcgtacgccaaggcnccaccccgngtaccncgtcttcccg

SEQ ID NO: 309905 - DNA, 614 bp, Homo sapiens
  misc_feature: GZ8MTXP02GWDWB.51.38.D05.1.454.CMB.2.raw
  modified_base (199)..(199): a, c, t, g, unknown or other
  misc_feature (199)..(199): n is a, c, g, or t
  modified_base (245)..(245): a, c, t, g, unknown or other
  misc_feature (245)..(245): n is a, c, g, or t
  modified_base (319)..(319): a, c, t, g, unknown or other
  misc_feature (319)..(319): n is a, c, g, or t
tcagcgatcgtatacacgaccggtgctcgatttagtatctgatagttgggtttgggggaggcgtggtccagcctgggaggtccctgagactcgcctgtaaaccgtccggattcaccttcagtaactatgcaatgcactgggtccgccaggctccaggcaaggggctggactgggtggcaggcatatcatttgatggaancaagaagtactatgcagactcgtagagggcattcacatctccaganacagttccgatgacacagtctatctacacatcgagcagtgtagagacctgaacgacacggtcttatttttacgngtcgcgacgagacgcgtacgtcgcgtcgaccatactctgttcgttctttagatagtcgtagacgaacgaaggactagtgtactacgttcgtcctccgtccgccctaccgaccggacggccctacgttccccgttccctcccccgtcgacccctacccctacccgtaccgaacgaccgcccgtaccgtcggggaccgggaccaccggccggtcccggacccgtcgggtcccgtaccggtaccgttacgggaaccgtaacgttacccttaccgttaccgaccggtaccgtacctacg

SEQ ID NO: 309906 - DNA, 595 bp, Homo sapiens
  misc_feature: GZ8MTXP02IYLQU.51.38.D05.1.454.CMB.2.raw
  modified_base (237)..(237): a, c, t, g, unknown or other
  misc_feature (237)..(237): n is a, c, g, or t
  modified_base (255)..(255): a, c, t, g, unknown or other
  misc_feature (255)..(255): n is a, c, g, or t
  modified_base (259)..(259): a, c, t, g, unknown or other
  misc_feature (259)..(259): n is a, c, g, or t
  modified_base (272)..(272): a, c, t, g, unknown or other
  misc_feature (272)..(272): n is a, c, g, or t
  modified_base (311)..(311): a, c, t, g, unknown or other
  misc_feature (311)..(311): n is a, c, g, or t
  modified_base (393)..(393): a, c, t, g, unknown or other
  misc_feature (393)..(393): n is a, c, g, or t
  modified_base (413)..(413): a, c, t, g, unknown or other
  misc_feature (413)..(413): n is a, c, g, or t
  modified_base (425)..(425): a, c, t, g, unknown or other
  misc_feature (425)..(425): n is a, c, g, or t
  modified_base (442)..(442): a, c, t, g, unknown or other
  misc_feature (442)..(442): n is a, c, g, or t
tcagcgatcgtatacacgaccggtgctcgatttagtatctgatagttgggtttggggggggtctcaggaggcagcgctctcgggacgtctccaccatggcctgggctctgctattcctcaccctcctcactcagggcacgagggtcctgggcccagtctgccctgactcagcctgcctccgtgtcgtgggtctctggacagtcgatcaccatctcctgcacgtgggaccaggcggtnactagtttggtatttaanactntgtctctggtacngcaccaccaggacaaaccgcccccaaatcatgtatttangatgtcagtgacgtccggcccttcggtagggtttcgaatccgtcttctcgtcgtcctacgacgtccgcaacgccgccctccncgactctctcgcgccctcgnggcgacggacgnggcttgatttatacgtncacgcttatacgtaataacaaacgttacaaagtaaacgtaaggtttcgggttggttacggaacgggtacggaaacgtaaccgtcggtaccgtacgtaacgccaccggtaccaacggtcctaccggtccccgtcgtacctcgttccttaccccg

SEQ ID NO: 309907 - DNA, 571 bp, Homo sapiens
  misc_feature: GZ8MTXP02F4PAP.51.38.D05.1.454.CMB.2.raw
  modified_base (194)..(194): a, c, t, g, unknown or other
  misc_feature (194)..(194): n is a, c, g, or t
  modified_base (199)..(199): a, c, t, g, unknown or other
  misc_feature (199)..(199): n is a, c, g, or t
  modified_base (266)..(266): a, c, t, g, unknown or other
  misc_feature (266)..(266): n is a, c, g, or t
  modified_base (292)..(292): a, c, t, g, unknown or other
  misc_feature (292)..(292): n is a, c, g, or t
  modified_base (303)..(303): a, c, t, g, unknown or other
  misc_feature (303)..(303): n is a, c, g, or t
  modified_base (403)..(403): a, c, t, g, unknown or other
  misc_feature (403)..(403): n is a, c, g, or t
  modified_base (448)..(448): a, c, t, g, unknown or other
  misc_feature (448)..(448): n is a, c, g, or t
  modified_base (454)..(454): a, c, t, g, unknown or other
  misc_feature (454)..(454): n is a, c, g, or t
  modified_base (464)..(464): a, c, t, g, unknown or other
  misc_feature (464)..(464): n is a, c, g, or t
tcagcgatcgtatacacgaccggtgctcgatttagtatctgatagttgggtttggggtggggtctcaggaggcagcgctctcgggacgtctccaccatggcctgggctctgctattcctcacccctcctcactcagggcacagggtcctgggcccagtcctgccctgactcagcctgcctcgtgtctggtctcnggacngtcatcacatctctgctacgtgggaccaggcgtgactagttggttgttaatactatgtctctggacngcaccaccgagaccaacgccccaaancatgtatttanactatgtcagtcgactccggcctacggtaggttacacgttccgtcttcgtcgtcgtccgtacctaacgtccggacaaacgtccgtccctaccgtacaccncttcgcgtacgccacgcgaccgaggacaggctagtaacttgtacngactanctactaatanaacaagtataaagtaagtagtcggtacgtccggaggaacggtaacacgtagacccgtagtacggacacggaaccgtaacggcctacccgtcccgtgaccttctcccg

SEQ ID NO: 309908 - DNA, 554 bp, Homo sapiens
  misc_feature: GZ8MTXP02FF6OE.51.38.D05.1.454.CMB.2.raw
  modified_base (304)..(304): a, c, t, g, unknown or other
  misc_feature (304)..(304): n is a, c, g, or t
  modified_base (337)..(337): a, c, t, g, unknown or other
  misc_feature (337)..(337): n is a, c, g, or t
  modified_base (510)..(510): a, c, t, g, unknown or other
  misc_feature (510)..(510): n is a, c, g, or t
tcagcgatcgtatacacgaccggtgctcgatttagtatctgatagttggggtttggggctgggagacgagcccagcactggaagtcgccggtgtttccattcggtgatcatcactgaacacagaggactcaccatggagtttgggctgagcttgggttttcctcgttgctcttttaagaggtgtccagtgttatgtgcagctggtggagtcgtgggggaggcgtggtccagcctgggagtccctgagactcgcctagtaaaccgtcggattcacttcagtaacatgcaatgcacgtgggtaccnccaggctccaggcgaaggggctggggctggggngcgaggcatatcatttgatggaaagcaaggaagtcatgacagacctcggagacgggccgattccaccatctaccgagtacgactagttccgatcgaacacagtctatcctaacacgatgagcgtagcgtagacgtaccacggacgacgtaaccggtctttacgtttttaccgngtacgtccgaacccgaggaaacgcgtacgtcggcgtcggaaccc

SEQ ID NO: 309909 - DNA, 660 bp, Homo sapiens
  misc_feature: GZ8MTXP02HUFOZ.51.38.D05.1.454.CMB.2.raw
  modified_base (270)..(270): a, c, t, g, unknown or other
  misc_feature (270)..(270): n is a, c, g, or t
tcagcgatcgtatacacgaccggtgctcgatttagtatctgatagttgggtttgggggctttgcctgggctcttctattcctcaccctcctcactcagggcacagggtcctgggcccagtctgccctgactcagcctgcctccgtgtctgggtctcctggacagtcgatcaccatctcctgcactgggaccagcggtgacatttggtgtttaataactatgtctcctggtaccagcaccaccaggcaaagccccccaaatcatgatttangatgtcagtgatcggccctgagggtttcaatcgtcttctcgtggctaccgaacgtccggacaaccgcggcctccctgaccattcctcctggccctcgacgggccgaggggcgaggtcctagtatttactactcgcagcctactataatactaaatacaaattaaacgtaagtttcggggtagttccgggacgggaacggggaacctaaacgtcggtacccgtccgttaaggccaacggacccgaaggtccctaccggtccccccgttccgggtacctaccgtttcccgttacccggttcccccctacccccgtttccccgtacctttacccggtacgtaaccctaaccgtttccgtcggggtaaccggccggggtcttcgggggaacccg

SEQ ID NO: 309910 - DNA, 668 bp, Homo sapiens
  misc_feature: GZ8MTXP02GUAWC.51.38.D05.1.454.CMB.2.raw
  modified_base (240)..(240): a, c, t, g, unknown or other
  misc_feature (240)..(240): n is a, c, g, or t
tcagcgatcgtatacacgaccggtgctcgatttagtatctgatagttgggtttgggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatcctcctgcacgtgggaccaggcggtnactagttggtgtttataactatgtctcctggtacagccaccaccaggaccaaacgacccccaaatcatagtatttatgatgtctagtgactcggcctcgtaggggtttacgaacttccgtacttcgtcgtcggtacctaccgacgggtcccgactaaccgacccggtcccccttcccgtacgtaaccccgtattcccttccggtccggtccccgttacccgaacggggacccggacgggaaccggtacggtccgtagtaatttaacttaaccgtgaccctagaccttactaattaacaactaaattacaaaattaaccgtaggtttggggtacgttacggggacggtaacggaacctaacgtccgtaaccgttccgacggtacaaccggaccaacgggtcctacccggcccccgtacggtactacccg

SEQ ID NO: 309911 - DNA, 599 bp, Homo sapiens
  misc_feature: GZ8MTXP02JW636.51.38.D05.1.454.CMB.2.raw
  modified_base (308)..(308): a, c, t, g, unknown or other
  misc_feature (308)..(308): n is a, c, g, or t
  modified_base (349)..(349): a, c, t, g, unknown or other
  misc_feature (349)..(349): n is a, c, g, or t
  modified_base (467)..(467): a, c, t, g, unknown or other
  misc_feature (467)..(467): n is a, c, g, or t
  modified_base (474)..(474): a, c, t, g, unknown or other
  misc_feature (474)..(474): n is a, c, g, or t
tcagcgatcgtatacacgaccggtgctcgatttagtatctgatagttgggtttgggggctggggtctcaggaggcagcgctctcgggacgtctccaccatggcctgggctctgctattcctcaccctcctcactcagggcacagggtcctgggcccagtctgccctgactcagcctgcctcgtgtctgggtctcctggacagtcgatcacatctcctgcacgtggaccagcgtgactattggtagttaatactatcgtctctggtaccagccaccaccaggaccaaacgccccaaatcatgtatttangtatgtcagtgactccgtcctgagggtttcactcgctttcncgtcggctacgacgtccgactaaaccgcgccctaccgtagacccactcgtccgtcgacccgtccgacggaccgacggacgacggtcttacgtattatcgtacgctaagctacgattanaactaanacgtaaataacgtaggttggtacggttacgggacgggaaacggtaaacctaaacgtcggtaccgtaccgtacgggaccaacggaacccgaaggtcccgtacccgccccggttacgtccctaaccg

SEQ ID NO: 309912 - DNA, 621 bp, Homo sapiens
  misc_feature: GZ8MTXP02F6CTT.51.38.D05.1.454.CMB.2.raw
  modified_base (239)..(239): a, c, t, g, unknown or other
  misc_feature (239)..(239): n is a, c, g, or t
  modified_base (250)..(250): a, c, t, g, unknown or other
  misc_feature (250)..(250): n is a, c, g, or t
  modified_base (318)..(318): a, c, t, g, unknown or other
  misc_feature (318)..(318): n is a, c, g, or t
  modified_base (441)..(441): a, c, t, g, unknown or other
  misc_feature (441)..(441): n is a, c, g, or t
  modified_base (460)..(460): a, c, t, g, unknown or other
  misc_feature (460)..(460): n is a, c, g, or t
tcagcgatcgtatacacgaccggtgctcgatttagtatctgatagttgggtttggggtggggtctcaggaggcagcgctctcgggacgtctccaccatggcctgggctctgctattcctcaccctcctcactcagggcacagggtcctgggcccagtctgccctgactcagcctgcctccgtgtctgggtcctcctggacagtcgatcaccatcctcctgcacgtgggaccagcggtanactagttggtntttaataactatgtctctggtaccagcacccaccaggacaaacgcccccaaatcgaatgtattttagntatgtacgagtgtacgtccggtcctaggtacggttacacgtccgtcttctcgtcgtctacgacgtccgacaccgccgtcctccgacacctctcgtcgtccgccgtcgacggaccgaggtacgngcgtagtacttacgtcgcncgtactcctataactactaactaataactaaacgttaacgtaggttacgggtacggtaccgggacgggtaacggaccgtaacggtcgtaaccgttcggtaacgtccgaaccggaaccgtaccgtcccgtacccgtaccccgtacgtaccctccgttacccg

SEQ ID NO: 309913 - DNA, 701 bp, Homo sapiens
  misc_feature: GZ8MTXP02GJAS8.51.38.D05.1.454.CMB.2.raw
  modified_base (199)..(199): a, c, t, g, unknown or other
  misc_feature (199)..(199): n is a, c, g, or t
  modified_base (237)..(237): a, c, t, g, unknown or other
  misc_feature (237)..(237): n is a, c, g, or t
  modified_base (315)..(315): a, c, t, g, unknown or other
  misc_feature (315)..(315): n is a, c, g, or t
  modified_base (321)..(321): a, c, t, g, unknown or other
  misc_feature (321)..(321): n is a, c, g, or t
  modified_base (324)..(324): a, c, t, g, unknown or other
  misc_feature (324)..(324): n is a, c, g, or t
  modified_base (461)..(461): a, c, t, g, unknown or other
  misc_feature (461)..(461): n is a, c, g, or t
  modified_base (525)..(525): a, c, t, g, unknown or other
  misc_feature (525)..(525): n is a, c, g, or t
tcagcgatcgtatacacgaccggtgctcgatttagtatctgatagttgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacngtcgatcaccatctcctgcacgtgggaccaggcggtanactagtttgggttatttaactaacttatcgtcctcctggtaccagccaccaccgagacaaaccgacccccaaatcatnatttanagntgtacagtcgactccgccgttcggtaaggggttacaatccgtccctttacgtccgtcggccttaccgaacggttacccgacgaacccgacccggtcccttacccgtacgacctattccttcgccggtacccacccgngggaccgaaaggggtaccgacggtactagtaactttaaactacgttcggactactaccgttaanaaacgttaaactaaactaaaacgtaactaaaagttaacggttaagggtttcggggtacgggtaccgggaacgggtaaaaccggtaaacctaaacggttcccgtaacggttaccgtacgtaccgaccggtaaccgaacggtccccgccgtacccgtacgtacctccgttccgtcccg

SEQ ID NO: 309914 - DNA, 700 bp, Homo sapiens
  misc_feature: GZ8MTXP02HLSQE.51.38.D05.1.454.CMB.2.raw
  modified_base (317)..(317): a, c, t, g, unknown or other
  misc_feature (317)..(317): n is a, c, g, or t
tcagcgatcgtatacacgaccggtgctcgatttagtatctgatagttgggtttgggggaggcgtggtccagcctgggaggtccctgagactcgcctgtaaaccgtccggattcaccttcagtaactatgcaatgcactgggtccgccaggctccaggcaaggggctggactgggtgcaggcatatcatttgatggaagcaagaagtactatgcagactccgtgaagggccattcacatctccagagacagttccgatgacacagtctatctacacatgagcagtgtgagacctgacgacacgtcttactttttacgngtcgcgaccgtaggaacgctaaggtcggctcgggccaactacttacagttcgttactttttaggaattacgtccgtagggacgtacccgtaaaggggacctaaagtcgggtactaagttccgttacttccttccgggtaccctaccccgtaaccgaaaccggggtccccctaacggttaccccggtttccctttaccccccgtacgggtaccccctacccccgttacccgtaccgtaaaccggacgtacccgtaacccgtcggtaccgggggtaccacccggacggccccggtcccgtcgggggtcctcggtacccgtacggggtaaccgtaaacgggtaccctttacccgttccgttaccggtaaccggacccttaacccgg

SEQ ID NO: 309915 - DNA, 713 bp, Homo sapiens
  misc_feature: GZ8MTXP02GHEAH.51.38.D05.1.454.CMB.2.raw
  modified_base (242)..(242): a, c, t, g, unknown or other
  misc_feature (242)..(242): n is a, c, g, or t
  modified_base (278)..(278): a, c, t, g, unknown or other
  misc_feature (278)..(278): n is a, c, g, or t
  modified_base (328)..(328): a, c, t, g, unknown or other
  misc_feature (328)..(328): n is a, c, g, or t
tcagcgatcgtatacacgaccggtgctcgatttagtatctgatagttgggtttgggggaggcgtggtccagcctggggaggtccctgagactcgcctgtaaaccgtccggattcaccttcagtaactatgcaatgcactgggtccgccaggctccaggcgaaggggctggactgggtggcaggcatatcatttgatggaagcaagaagtactatgcagactccgtagagggcattcacatcncagagacagttcatgacacagtctatcacacatgancgaggtgtgaacgtactaggaacgacgtacggttcttttactttttacgnggtcgccgtacgaggaacgcgtaggtcgcctggaccatacttacgtagtgttctttagacttagtcgtaggacgaccgaaagggtactagttacggtctaacgtttccgtcgttccgttacccggaccctacccgaaccgtaccgggtacccttacggttccccgtttacccgtcccccgtggtaccccctacccccgttacgaaccgtaaggccccgaacccggttaccgttccgggggacgggtaacccaaccgggacccggggtccccggtacccgggttacgggtaccccgttcggggtacccggtttacgggaaaacccggtaccgggtttaaaccctttcccggttacccgtaacggtaccggtccctttaaaccgggg

SEQ ID NO: 309916 - DNA, 633 bp, Homo sapiens
  misc_feature: GZ8MTXP02H9IAD.51.38.D05.1.454.CMB.2.raw
  modified_base (320)..(320): a, c, t, g, unknown or other
  misc_feature (320)..(320): n is a, c, g, or t
tcagcgatcgtatacacgaccggtgctcgatttagtatctgatagttgggtttgggggaggcgtggtccagcctgggaggtccctgagactcgcctgtaaaccgtccggattcaccttcagtaactatgcaatgcactgggtccgccaggctccaggcaaggggctggactgggtggcaggcatatcatttgatggaagcaagaatactatgcagactcgtagaagggcgattcacatctcagagacagttccgatgacacagtctatctacacatgacgcagtgtgacgacctgacgacacggtctttacttttttacngtgccgtaccgaaggaagcgtaggtcggccttggcccaatactctagtcgttactttttgattaatcgtagggaacacccgtaaaaggggactaaagtcggtacaacgtttcgttccttcgttccgacccttaccgaaccgtaaacggggccccctaaagttccccggttacccttcccccgtacgggccctacccccgttaccaccgaaacgccgtacctccgtcggtcggggaccaacgggccgccgggtcccgtcgggctcggccgttacggaacgaacggtccttacgtaccgtacggtacaccgtccg

SEQ ID NO: 309917 - DNA, 622 bp, Homo sapiens
  misc_feature: GZ8MTXP02HHVNN.51.38.D05.1.454.CMB.2.raw
  modified_base (200)..(200): a, c, t, g, unknown or other
  misc_feature (200)..(200): n is a, c, g, or t
  modified_base (247)..(247): a, c, t, g, unknown or other
  misc_feature (247)..(247): n is a, c, g, or t
  modified_base (252)..(252): a, c, t, g, unknown or other
  misc_feature (252)..(252): n is a, c, g, or t
  modified_base (311)..(311): a, c, t, g, unknown or other
  misc_feature (311)..(311): n is a, c, g, or t
tcagcgatcgtatacacgaccggtgctcgatttagtatctgatagttgggtttggggtggggtctcaggaggcagcgctctcgggacgtctccaccatggcctgggctctgctattcctcaccctcctcactcagggcacagggtcctgggcccagtctgccctgactcagcctgcctccgtgtctgggtctcctggacngtcgatcacatctcctgcacgtgggaccaggcggtgactagttggtntttanaactatgtctcctgtaccagcaccaccaggcaaaacgccccaaaactcatcgtatttangatgtcagtgacgtccgtcctacgtaggggtttacatcccgtcttcgtcgtcggctacgacgtccggacaaacgccgcctccgtcgacctctctcgccggtaccctcgacggaccgaggacggaggtcctagtactttactacgtgtacacgtactactaactactaaacaacgttaacctaaaagtaaacgttaaggtttggggtacgtttaccggggaacggtaaacggaaccgtaaacgttcggaaccgttacgtacgtaccgacgaacccgtaggtccgtacccgtcccgtacggtcctacttcccg

SEQ ID NO: 309918 - DNA, 553 bp, Homo sapiens
  misc_feature: GZ8MTXP02G3IOB.51.38.D05.1.454.CMB.2.raw
  modified_base (232)..(232): a, c, t, g, unknown or other
  misc_feature (232)..(232): n is a, c, g, or t
  modified_base (306)..(306): a, c, t, g, unknown or other
  misc_feature (306)..(306): n is a, c, g, or t
  modified_base (316)..(316): a, c, t, g, unknown or other
  misc_feature (316)..(316): n is a, c, g, or t
  modified_base (421)..(421): a, c, t, g, unknown or other
  misc_feature (421)..(421): n is a, c, g, or t
  modified_base (435)..(435): a, c, t, g, unknown or other
  misc_feature (435)..(435): n is a, c, g, or t
  modified_base (440)..(440): a, c, t, g, unknown or other
  misc_feature (440)..(440): n is a, c, g, or t
  modified_base (449)..(449): a, c, t, g, unknown or other
  misc_feature (449)..(449): n is a, c, g, or t
tcagcgatcgtatacacgaccggtgctcgatttagtatctgatagttgggtttgggggctggggtctcaggaggcagcgctctcgggacgtctccaccatggcctgggctctgctattcctcaccctcctcactcaggcacagggtcctgggcccagtctgccctgactcagcctgcctcgtgtctggtctcctggacagtcgatcacatctctgcactgggaccagcggtnactagttggtgtttaataactatgtctcctggtaccagcaccaccaggacaaacgccccaaatcatgactttangatgtcagtngtccgcctgtaggggtttcaactcgtcttcgtctggcttaccgagtccggtacaaaccgtccgccctcctagaccctatcctacgtcgcctccgagccgaggacnggactgattatacngcganctataatanacaatacaaagtactaagttggacgttacggaggaacggtaaccaagtccggtactccgttaaggacaaccggacaaccggtctaccgtccccgtacgctcccg

SEQ ID NO: 309919 - DNA, 577 bp, Homo sapiens
  misc_feature: GZ8MTXP02GA7QJ.51.38.D05.1.454.CMB.2.raw
  modified_base (185)..(185): a, c, t, g, unknown or other
  misc_feature (185)..(185): n is a, c, g, or t
  modified_base (240)..(240): a, c, t, g, unknown or other
  misc_feature (240)..(240): n is a, c, g, or t
  modified_base (311)..(311): a, c, t, g, unknown or other
  misc_feature (311)..(311): n is a, c, g, or t
  modified_base (350)..(350): a, c, t, g, unknown or other
  misc_feature (350)..(350): n is a, c, g, or t
  modified_base (399)..(399): a, c, t, g, unknown or other
  misc_feature (399)..(399): n is a, c, g, or t
  modified_base (458)..(458): a, c, t, g, unknown or other
  misc_feature (458)..(458): n is a, c, g, or t
  modified_base (463)..(463): a, c, t, g, unknown or other
  misc_feature (463)..(463): n is a, c, g, or t
  modified_base (467)..(467): a, c, t, g, unknown or other
  misc_feature (467)..(467): n is a, c, g, or t
tcagcgatcgtatacacgaccggtgctcgatttagtatctgatagttgggtttgggggctggggtctcaggaggcagcgctctcgggacgtctccaccatggcctgggctctgctattcctcaccctcctcactcagggcacagggtcctgggcccagtctgccctgactcagcctgcctccgtntctggtctcctggacagtcgatcacctatcctcctagccatgggaccaggcggtnactattgggttattacaatatgtctccttggaccagcaccacccagacaacgcccccaaatcatgtattangatgtcagtgatccggcctgaggggttttacaatccgtnttcgtctgggccctacgtacggtccggacaaaccgcgtcccccttacgnaccctatccgtcgacggcctaccgacgggccgacggtacggagtcgtagatttagtacngctanctanatacgtactaatactaaagtaagtagtagggtacgtacgggacggtaacgacctaaacgtcgaccgtcgtacgcgaacgaccgacgtccgtccgtacccgtacgtctacg

SEQ ID NO: 309920 - DNA, 599 bp, Homo sapiens
  misc_feature: GZ8MTXP02GISUZ.51.38.D05.1.454.CMB.2.raw
  modified_base (339)..(339): a, c, t, g, unknown or other
  misc_feature (339)..(339): n is a, c, g, or t
  modified_base (357)..(357): a, c, t, g, unknown or other
  misc_feature (357)..(357): n is a, c, g, or t
tcagcgatcgtatacacgaccggtgctcgatttagtatctgatagttgggtttgggggaggcgtggtccagcctgggaggtccctgagactcgcctgtaaaccgtccggattcaccttcagtaactatgcaatgcactgggtccgccaggctccaggcaaggggctggactgggtgcaggcatatcatttgatggaagacaagaagtactatgacagacctccggtaggaacgggccgtattcaccaatctccagagacagttccgatcgacacagttctatacacacagtgagcaggtgtgacgaccgtaggacgacgacgttctttcgtttttacgngtcgtcgaccgaggaacncgtagtcggtcctggaccaactatctagttcgttacgttttaggaattcgttacggagggacgaaccgaaagggtacctaaggtcgtactacgttcgtcctcgtacgcctaccgacgacgccacttccggtccctcccgcgaccacccgtctacgaacgcgcctaccgtcggtacggctaccgtccggccggtaccgcgtcgaccgtcgtaggaacgacgtactaccgtctcgacgtctacg

SEQ ID NO: 309921 - DNA, 562 bp, Homo sapiens
  misc_feature: GZ8MTXP02JM1AZ.51.38.D05.1.454.CMB.2.raw
  modified_base (242)..(242): a, c, t, g, unknown or other
  misc_feature (242)..(242): n is a, c, g, or t
  modified_base (248)..(248): a, c, t, g, unknown or other
  misc_feature (248)..(248): n is a, c, g, or t
  modified_base (253)..(253): a, c, t, g, unknown or other
  misc_feature (253)..(253): n is a, c, g, or t
  modified_base (350)..(350): a, c, t, g, unknown or other
  misc_feature (350)..(350): n is a, c, g, or t
tcagcgatcgtatacacgaccggtgctcgatttagtatctgatagttggggtttgggggggtctcaggaggcagcgctctcgggacgtctccaccatggcctgggctctgctattcctcaccctcctcactcagggcacagggtcctgggcccagtctgccctgactcagcctgcctccgtgtctgggtctctggacagtcgatcaccatctcctgcactgggaccaggcgtgacattggtntttaanaactntgtctctggtaccagcaccacccaggcaaacgcccccaaactcatacgatttactgatgtcagtgatccggcctcgagggtttcgaatcgaccttcnctgctcgaagtccgctaacacggcctccctgaccagtcctctcgccctcgagccgaggcgacggctacgtattactcgtagctagctcgatatacaatacaaataactagttggtcgttcggcggtacggacctaaagtcgaaaccgtcgtacgaccgacgtacccgaaggtcctaccggtcccgtccggtaacctccgttacgttccccgg

SEQ ID NO: 309922 - DNA, 839 bp, Homo sapiens
  misc_feature: GZ8MTXP02JLYCC.51.38.D05.1.454.CMB.2.raw
  modified_base (143)..(143): a, c, t, g, unknown or other
  misc_feature (143)..(143): n is a, c, g, or t
  modified_base (231)..(231): a, c, t, g, unknown or other
  misc_feature (231)..(231): n is a, c, g, or t
  modified_base (313)..(313): a, c, t, g, unknown or other
  misc_feature (313)..(313): n is a, c, g, or t
  modified_base (327)..(327): a, c, t, g, unknown or other
  misc_feature (327)..(327): n is a, c, g, or t
tcagcgatcgtatacacgaccggtgctcgatttagtatctgatagttgggtttggggtggggtctcaggaggcagcgctctcgggacgtctccaccatggcctgggctctgctattcctcaccctcctcactcgagggcacgngggtcctgggcccagtctcgccctgactcagcctgcctcgtgtcgtggtctccgtaggacagtcatcacatctcctgcacgtcggacnggcgtagactgttggtattaactatagtcgtctccgtacggaccacgaccaacccgacgacggacctaaaccgaccccaatnagtagttatttagnttagtcgtatacggtcgtaaccggttccggtccccggtttagggtaaccgggtttaccgtaacgttcccccgtttcgttaccgtttccggtacgttacccccgtaccggtaaaccgggttacccggggtaacccaaaacccggttcccccgggttcccccgttaccccctaacgggtaaaccctttcccggttacccgttacggttcccccggttacccgaccggggaacccggggttacccggaaaacgggacccgggttaaagtttcgttaacggttaactttttaaccgttacggcccttaaaggtccgttacgttaaacctagtttaaaaccaatttaaacgggaacctaaaagtttaaacggttgggggtttacgttacgggggacggggttaaccgaaaacgggtaacccttaaaccgggtcgttaacccggtaccgtttaaacgggccttaaaacccgccgttaacgccgtccccggttaaccctcgttaacggtccctttcccg

SEQ ID NO: 309923 - DNA, 633 bp, Homo sapiens
  misc_feature: GZ8MTXP02GEL9A.51.38.D05.1.454.CMB.2.raw
  modified_base (212)..(212): a, c, t, g, unknown or other
  misc_feature (212)..(212): n is a, c, g, or t
  modified_base (260)..(260): a, c, t, g, unknown or other
  misc_feature (260)..(260): n is a, c, g, or t
  modified_base (317)..(317): a, c, t, g, unknown or other
  misc_feature (317)..(317): n is a, c, g, or t
  modified_base (466)..(466): a, c, t, g, unknown or other
  misc_feature (466)..(466): n is a, c, g, or t
  modified_base (482)..(482): a, c, t, g, unknown or other
  misc_feature (482)..(482): n is a, c, g, or t
  modified_base (491)..(491): a, c, t, g, unknown or other
  misc_feature (491)..(491): n is a, c, g, or t
  modified_base (496)..(496): a, c, t, g, unknown or other
  misc_feature (496)..(496): n is a, c, g, or t
tcagcgatcgtatacacgaccggtgctcgatttagtatctgataggttggggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccntcctctgcacgtcgggacaggcggtgactagttggtatttaataactntgtctctggtaccagccaccaccgaggaccaaaccgcccccaaatcatagtatttangatgacagtgacgtccggccttaggtacggggtttacaacgttccggtcctttcctcgtcgtaccgtaccgtaaccggttccggaccaaccggtccggtacccctccgtacgactactccgtccgtcgaccctcgacgggccgagacgnggtctagtattactcngacagctanattanaactaagtactaataacgtaaggttgggtacggtacggacggtaacgtaaaccaagtccgtaaccgttacgtacgaccgaccgaaccggaacgtcccgtacccggtaccccgtcgtaaccctcgtacctttcccccg

SEQ ID NO: 309924 - DNA, 632 bp, Homo sapiens
  misc_feature: GZ8MTXP02JQMP0.51.38.D05.1.454.CMB.2.raw
  modified_base (223)..(223): a, c, t, g, unknown or other
  misc_feature (223)..(223): n is a, c, g, or t
  modified_base (255)..(255): a, c, t, g, unknown or other
  misc_feature (255)..(255): n is a, c, g, or t
  modified_base (260)..(260): a, c, t, g, unknown or other
  misc_feature (260)..(260): n is a, c, g, or t
  modified_base (303)..(303): a, c, t, g, unknown or other
  misc_feature (303)..(303): n is a, c, g, or t
  modified_base (315)..(316): a, c, t, g, unknown or other
  misc_feature (315)..(316): n is a, c, g, or t
  modified_base (318)..(318): a, c, t, g, unknown or other
  misc_feature (318)..(318): n is a, c, g, or t
  modified_base (320)..(320): a, c, t, g, unknown or other
  misc_feature (320)..(320): n is a, c, g, or t
  modified_base (322)..(322): a, c, t, g, unknown or other
  misc_feature (322)..(322): n is a, c, g, or t
tcagcgatcgtatacacgaccggtgctcgatttagtatctgatagttgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctccgtggacagtcgatcaccatctcctgcacgngggaccaggcggtgactagttggtagtttaanaactntgtctcctaggtacacgcaccacccaggcaaacgacccccaancatcgatttagnntngngngcgtccgcctggtaggtacatctcctctcgtcgacacgacgccgccaccgtcccgtcctccgcgacctctcgtcgtccgacccgacggtacgggacggaacgggtacggacgtacttaagttacttaacgttcgtcgacgtacgtacctataactactaaacgtaaacttagtaaaacgttaaggtacgggtttacgggtacggtaccgggaacgggtaaacgtaaacccgtaacggttacgtaccgttaccgtacgaccgaaccgacgccgtccgtacccggtccgtacgtcctaccgtttcctacccg

SEQ ID NO: 309925 - DNA, 717 bp, Homo sapiens
  misc_feature: GZ8MTXP02GKKE6.51.38.D05.1.454.CMB.2.raw
  modified_base (245)..(245): a, c, t, g, unknown or other
  misc_feature (245)..(245): n is a, c, g, or t
  modified_base (286)..(286): a, c, t, g, unknown or other
  misc_feature (286)..(286): n is a, c, g, or t
  modified_base (330)..(330): a, c, t, g, unknown or other
  misc_feature (330)..(330): n is a, c, g, or t
tcagcgatcgtatacacgaccggtgctcgatttagtatctgatagttgggtttgggggaggcgtggtccagcctgggaggtccctgagactcgcctgtaaaccgtccggattcaccttcagtaactatgcaatgcactgggtccgccaggctccaggcgaaggggctggactggggtggcaggcatatcatttgatggaagcaagaagtactatgcagactccgtggaagggccgattcacatcnccgagagacagttccgatgacacagtctatctacacatganctagtgtagacgacctagaaccgacacggtctttactttttagngtgccgtaccgaggagcgtaggtcgcgtacggaccactacttctgtcgtatttttagacttagtcgtagggaacgtacccgaaaggggtacctaaggttcgtactacgttcgtaccgtttaccgtcccgaaccccttacccgaaccgtaacccgggggacccctaacggttcccgggttaccccttcccccgttacggacccctaccccttaccccgacgtaaacgaccgacccgtaccggttccgggtaacgggggtccaaaccgacccgggcccggggtccccggtaagggggtcccttacccgggggtccttaacggggtaacccggtaaacgggttacccgtttaaccccttccggttacccggtaacctaacccggttccgg

SEQ ID NO: 309926 - DNA, 602 bp, Homo sapiens
  misc_feature: GZ8MTXP02IXA9O.51.38.D05.1.454.CMB.2.raw
  modified_base (208)..(208): a, c, t, g, unknown or other
  misc_feature (208)..(208): n is a, c, g, or t
  modified_base (274)..(274): a, c, t, g, unknown or other
  misc_feature (274)..(274): n is a, c, g, or t
  modified_base (438)..(438): a, c, t, g, unknown or other
  misc_feature (438)..(438): n is a, c, g, or t
  modified_base (538)..(538): a, c, t, g, unknown or other
  misc_feature (538)..(538): n is a, c, g, or t
tcagcgatcgtatacacgaccggtgctcgatttagtatctgatagttgggtttgggggctttgcctgggctctgctattcctcaccctcctcactcagggcacagggtcctgggcccagtctgccctgactcagcctgcctccgtgtctgggtctcctggacagtcgatcaccatctcctgcactgggaccagcggtgactattggtntttaataactatgtctccgtggtaccagccaccacccaggcaaaacgcccccaaatcatgtattangatgtcagtgactccggccctacgtaggggtttcgaattcgtcttctcgttggccttccgaaacggttcccggacaaaccgaccggccctaccctcgacccctagtcctcgtcggccctaccgcggccggaggacgaggcttagactttagtactgcacgtctntaaactataacaacttacaaacttaaacgtaagttgggtggttaccgggcggaaacgggacctaaacgtcggaccgtccgtagtcgacgaccgaggtccncgtcccctcggtcactcgttaccttcccacctactctacggtgacccatccgagcgcggcacgg

SEQ ID NO: 309927 - DNA, 611 bp, Homo sapiens
  misc_feature: GZ8MTXP02IEO69.51.38.D05.1.454.CMB.2.raw
  modified_base (212)..(212): a, c, t, g, unknown or other
  misc_feature (212)..(212): n is a, c, g, or t
  modified_base (271)..(271): a, c, t, g, unknown or other
  misc_feature (271)..(271): n is a, c, g, or t
  modified_base (308)..(308): a, c, t, g, unknown or other
  misc_feature (308)..(308): n is a, c, g, or t
  modified_base (313)..(313): a, c, t, g, unknown or other
  misc_feature (313)..(313): n is a, c, g, or t
tcagcgatcgtatacacgaccggtgctcgatttagtatctgatagttgggtttgggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcatcaccntctcctgcatgggaccagcggtgactattggtacgtttataactatgtctctggtaccngcaccaccaggcaaacgcccccaaaatcatcgatttntgatntcagtgactcggcctcgtaggggtttcaatccgtctttctctggcttacacggtccggacaccgaccgggtccctcctgaccctaactttccctccgtacgcctaccggacggtaccggacggtacggcggtctagtacgtttacgttactacgtactacgtactactataactaactaactactaaacttaaacgtaacgttacgggttacggttacggtacggaacggtaacgtaacgtacgtaccgtacgtacgtacgaacgtaccgacgtaccgtccgtcccgtaccgtactcg

SEQ ID NO: 309928 - DNA, 597 bp, Homo sapiens
  misc_feature: GZ8MTXP02H8F89.51.38.D05.1.454.CMB.2.raw
  modified_base (234)..(234): a, c, t, g, unknown or other
  misc_feature (234)..(234): n is a, c, g, or t
  modified_base (244)..(244): a, c, t, g, unknown or other
  misc_feature (244)..(244): n is a, c, g, or t
  modified_base (248)..(248): a, c, t, g, unknown or other
  misc_feature (248)..(248): n is a, c, g, or t
  modified_base (253)..(253): a, c, t, g, unknown or other
  misc_feature (253)..(253): n is a, c, g, or t
  modified_base (305)..(305): a, c, t, g, unknown or other
  misc_feature (305)..(305): n is a, c, g, or t
  modified_base (456)..(456): a, c, t, g, unknown or other
  misc_feature (456)..(456): n is a, c, g, or t
tcagcgatcgtatacacgaccggtgctcgatttagtatctgatagttgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcatcaccatctcctgcacgtgggaccagcggtnactattggtnttanaactntgtctctgtaccagcaccacccaggacaaacgcccccaaatcatgtatttangatgtcagtgagtccgtccctcgtaggggttttacgaactcgtcccttctcgtcgtactccaacggttccgaccaaaccgaccggtccctaccctcgaccactcctcgtcgccctccgacggccgaggtacgacggtctagactttatacncgactagctacatactaacaataacaaataacgtaagtttgggtacgttacggaacgggacggaactaaacgtcgaccgttacgtaacgtcacgtccgaacggtcctaccgtccccgtacgtcctaccgttccttaccccg

SEQ ID NO: 309929 - DNA, 752 bp, Homo sapiens
  misc_feature: GZ8MTXP02JPPHC.51.38.D05.1.454.CMB.2.raw
  modified_base (263)..(263): a, c, t, g, unknown or other
  misc_feature (263)..(263): n is a, c, g, or t
  modified_base (269)..(269): a, c, t, g, unknown or other
  misc_feature (269)..(269): n is a, c, g, or t
tcagcgatcgtatacacgaccggtgctcgatttagtatctgatagttgggtttgggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactgggaccagcggtgactattggtgttataactatgtctcnggtacngcaccaccagcaacgaccccaaatcatcgtatttatgatgtacagtgacgtccgcccttgacggggtttcaactcgtcttctcgtggacctcgacgtccgacaacgaccggcctcccgtcgacccactcctccgtcgccctccgacgggtacccggacgggaaccggaacggtcgttacggtaacttttaaacgttccttaggtccgaacgcttaccctaattaaactaaaccgaaacttaaacgtaaaaccttaaaacgttaaaagggttttcgggggttacgggtttacccgggggtaccggggaaaacgggggtaaacccccgttaaaaaaccggttccggggttaaaccccgggtttaacccccgttaaacgggggtttaacccgaaaacccgggtaaccccccggtaaaaaccgggggacccccgttttaccccggacccccccccgggtttcgggttaacccggtttaaaccccccg

SEQ ID NO: 309930 - DNA, 638 bp, Homo sapiens
  misc_feature: GZ8MTXP01AGCLB.2.4.A04.1.454.CMB.2.raw
  modified_base (222)..(222): a, c, t, g, unknown or other
  misc_feature (222)..(222): n is a, c, g, or t
  modified_base (604)..(604): a, c, t, g, unknown or other
  misc_feature (604)..(604): n is a, c, g, or t
tcagacgctcgacacacgaccggtgctcgatttagagtagtgatcagggggctttctgagagtcatggatctcatgtgcaagaaaatgaagcacctgtggttcttcctcctgctggtggcggctcccagatgggtcctgtcccagctgcagttgcaggagtcgggcccaggactggtgaagccttcggagaccctgtcccctcacctgcactgtctctggtncctcatcagctagtagtagttattacgtgggctggatcgccagccccgagggaagggctggagtggagttggggagtttctagttagtgggtacgggggaacctacgtaaccgaacccgtcctacaagacgtcgacgtccacgtactcccgttaagaaaccacgtccaaagtaaacccaattcctaccctagaaactcgaactctatcgaccgcgcaacgacacggtcttacgtttattagttcggtacgggaccggttggttaaacggttggaacttacgtcggggcccagggacgccgtggtccacccggttctcccttcgcgtcccttccgaacccgaacggggttccccttaagttcccgggtaaccctttcccccgnggtccctaccccttccgtaacccaaggtaacccg

SEQ ID NO: 309931 - DNA, 637 bp, Homo sapiens
  misc_feature: GZ8MTXP01BA3W0.2.4.A04.1.454.CMB.2.raw
  modified_base (220)..(220): a, c, t, g, unknown or other
  misc_feature (220)..(220): n is a, c, g, or t
  modified_base (602)..(602): a, c, t, g, unknown or other
  misc_feature (602)..(602): n is a, c, g, or t
tcagacgctcgacacacgaccggtgctcgatttagagtagtgatcagggggctttctgagagtcatggatctcatgtgcaagaaaatgaagcacctgtggttcttcctcctgctggtggcggctcccagatgggtcctgtcccagctgcagttgcaggagtcggcccaggactggtgaagccttcggagaccctgtccctcacctgcactgtctctggtncctccatcagcagtagtagttattacgtgggctggatcgccacgcccccgagggaaggggctggagtggagttggggtagtttctagttagtgggtcgggggaacctacgtacaacccgtcctcaagacgtcgacgtcacgtatccttagaacacgtccaaagaacctaattcctaccctagaaactacgaactctatcgaacccgccgacaacgacacggtcttagtttattagttacggttaccgggccggttaggttaacggttcggaccgttacgtcgggggacccaggggacgtcccggtaggtccgacccgtctccctcgacgcccttccgaacccgtaacggggccccagttcccgggtaaccctttccccccgngggtccccaccccttccctaacccgaacgaacccg

SEQ ID NO: 309932 - DNA, 578 bp, Homo sapiens
  misc_feature: GZ8MTXP01AL3ZE.2.4.A04.1.454.CMB.2.raw
  modified_base (347)..(347): a, c, t, g, unknown or other
  misc_feature (347)..(347): n is a, c, g, or t
  modified_base (504)..(504): a, c, t, g, unknown or other
  misc_feature (504)..(504): n is a, c, g, or t
  modified_base (553)..(553): a, c, t, g, unknown or other
  misc_feature (553)..(553): n is a, c, g, or t
  modified_base (559)..(559): a, c, t, g, unknown or other
  misc_feature (559)..(559): n is a, c, g, or t
tcagacgctcgacacacgaccggtgctcgatttagagtagtgatcagggggctttctgagagtcatggatctcatgtgcaagaaaatgaagcacctgtggttcttcctcctgctggtggcggctcccagatgggtcctgtcccagctgcagttgcaggagtcgggcccaggactggtgaagccttcggagacccctgtcccctcacctgcactgtctctggtgcctccatcagcagtagtagttatactggggctggatcgccagcccccgagggaaggggctggagtggattggggagtttcgtattagtgggtagggggaacctacgtacaacccgtcctcaagngtcgagtcacgtatccttagaacacgtccaaagaaccattctcctagaaactgaacctctatcgaccgccgcacgacacgggtcttgtttattagttgtacgggccggttgtaacgttggactacgtggggcaggggacgccgtggtccaccggtcnccctcacgcccttccgaccgaacgggcccagttccggtccttcccccgnggcccncccgttctccgaaagcccg

SEQ ID NO: 309933 - DNA, 598 bp, Homo sapiens
  misc_feature: GZ8MTXP01AS9U2.2.4.A04.1.454.CMB.2.raw
  modified_base (221)..(221): a, c, t, g, unknown or other
  misc_feature (221)..(221): n is a, c, g, or t
  modified_base (347)..(347): a, c, t, g, unknown or other
  misc_feature (347)..(347): n is a, c, g, or t
  modified_base (525)..(525): a, c, t, g, unknown or other
  misc_feature (525)..(525): n is a, c, g, or t
tcagacgctcgacacacgaccggtgctcgatttagagtagtgatcagggggctttctgagagtcatggatctcatgtgcaagaaaatgaagcacctgtggttcttcctcctgctggtggcggctcccagatgggtcctgtcccagctgcagttgcaggagtcgggcccaggactggtgaagccttcggagaccctgtccctcacctgcactgtctctggtncctcatcagcagtagtagttattacgtggggctggatcgccacgcccccgagggaggggctggagtggagttgggagtttctatttagtgggtagggggaacctacgtacaacccgtccctcaagngtcgagtcacgtatcctagaacacgtcaaagaacctaattctccctagaaactgaactctaatcgaccgccgacacggacacgggtcttggtttaattagttcggtaacgggtccggttggttaaaccggttggaccttacggtggggccagggacgccgtggtcacccgtctcctcncgcccttccgaccgaacggccccgagttccggtcccttcccccgtggccccacccgttcctaaccgaacgccg

SEQ ID NO: 309934 - DNA, 570 bp, Homo sapiens
  misc_feature: GZ8MTXP02FRPSR.2.4.A04.1.454.CMB.2.raw
  modified_base (222)..(222): a, c, t, g, unknown or other
  misc_feature (222)..(222): n is a, c, g, or t
tcagacgctcgacacacgaccggtgctcgatttagagtagtgatcagggggctttctgagagtcatggatctcatgtgcaagaaaatgaagcacctgtggttcttcctcctgctggtggcggctcccagatgggtcctgtcccagctgcagttgcaggagtcgggcccaggactggtgaagccttcggagaccctgtcccctcacctgcactgtctctggtncctcatcagcagtagtagtattactggggctggattcgccagcccccagggaagggctggagtggattgggagtttctattatggtggggaacctactacaacccgtcctcaagagtcgagtcaccgtatccttagacacgtccaagaaccaattctccctagaaactgaaactctatgaccgcgcagacacggctgttactattgtacggcgtgtaacgttggactacgtggggccagggagccgtggtcaccgtctccctcgacgccctccaaccgaacggggtccccacgttccgggtccttttccccccgtgggccctaaccccgttccctacccaacgtaccg

SEQ ID NO: 309935 - DNA, 598 bp, Homo sapiens
  misc_feature: GZ8MTXP02FO37A.2.4.A04.1.454.CMB.2.raw
  modified_base (223)..(223): a, c, t, g, unknown or other
  misc_feature (223)..(223): n is a, c, g, or t
tcagacgctcgacacacgaccggtgctcgatttagagtagtgatcagggggctttctgagagtcatggatctcatgtgcaagaaaatgaagcacctgtggttcttcctcctgctggtggcggctcccagatgggtcctgtcccagctgcagttgcaggagtcgggcccaggactggtgaagccttcgggagaccctgtcccctcacctgcactgtctctggtncctccatcagcagtagtagttattactggggctggattcgccagcccccagggagggctggagtggattgggagtttctattagtggtggggaacctacgtacaacccgtcctcaagagtcgagtcaccgtatccttagacacgtccaagaacctaattcctccctagaaactgaactctatcgacccgccgacagaccacggctagtttattattagtacgggccgttaggtaacgttggaactacgtggggaccaggggacgccgtggtccaccggtctcccgtcacgccctaccgaccgaacggggccccaagttcccggtaacctttcccccccgtggtccccacccccgttccctacccgaacggacccg

SEQ ID NO: 309936 - DNA, 577 bp, Homo sapiens
  misc_feature: GZ8MTXP02HS858.2.4.A04.1.454.CMB.2.raw
tcagacgctcgacacacgaccggtgctcgatttagagtagtgatcagggggctttctgagagtcatggatctcatgtgcaagaaaatgaagcacctgtggttcttcctcctgctggtggcggctcccagatgggtcctgtcccagctgcagttgcaggagtcgggcccaggactggtgaagccttcggagaccctgtccctcacctgcactgtctctggtgcctccatcagcagtagtagttattactggggctggattcgccagcccccgagggaagggctggagtggagttgggagtttctagttagtggtggggaacctactacgaaccccgtcctacaagagtcgacgtcaccgtatccttagaccacgtccaagaacctaaattcctaccctagaaactgaacttctatcgaccgccgcagaccaacggtctagtttagttattggtaccggcgttaggttaacgttggactacgtggggccagggagcgtggtccaccgtctcctcgacgcctccaccgaacggcccacgtccggtccttcccccgtggcccaccccttccaccgaacgcg

SEQ ID NO: 309937 - DNA, 577 bp, Homo sapiens
  misc_feature: GZ8MTXP02FYD0S.2.4.A04.1.454.CMB.2.raw
  modified_base (221)..(221): a, c, t, g, unknown or other
  misc_feature (221)..(221): n is a, c, g, or t
tcagacgctcgacacacgaccggtgctcgatttagagtagtgatcagggggctttctgagagtcatggatctcatgtgcaagaaaatgaagcacctgtggttcttcctcctgctggtggcggctcccagatgggtcctgtcccagctgcagttgcaggagtcgggcccaggactggtgaagccttcggagaccctgtccctcacctgcactgtctctggtncctccatcagcagtagtagttattactggggctggattcgccagcccccagggaaggggctggagtggattggggagtttctattagtgggtggggaacctactaccaacccgtccctcaagagtcgagtcaccgtatccttagaccacgtccaaagaaccaattctaccctagaaactgaaactctaatgaccgccgcacgacacggcttgttattattgtacggcgtagtacgtgactagtgggccaggagccgtggtcacccgtctccctcacgccctaccgaccgaaacggggccccagttcccggtccctttccccccgtggcccctaccccctcctacccaacgacccgg

SEQ ID NO: 309938 - DNA, 602 bp, Homo sapiens
  misc_feature: GZ8MTXP02FQ4YA.2.4.A04.1.454.CMB.2.raw
  modified_base (225)..(225): a, c, t, g, unknown or other
  misc_feature (225)..(225): n is a, c, g, or t
  modified_base (540)..(540): a, c, t, g, unknown or other
  misc_feature (540)..(540): n is a, c, g, or t
  modified_base (586)..(586): a, c, t, g, unknown or other
  misc_feature (586)..(586): n is a, c, g, or t
tcagacgctcgacacacgaccggtgctcgatttagagtagtgatcagggggctttctgagagtcatggatctcatgtgcaagaaaatgaagcacctgtggttcttcctcctgctggtggcggctcccagatgggtcctgtcccagctgcagttgcaggagtcgggcccaggactgggtgaagccttcgggacgaccctgtcccctcacctgcactgtctctggtncctccatcagcagtagtagttattacgtggggctggatcgccacgcccccgagggaaggggctggagtggattggggtagtttctatttagtgggtagggggaaccttacgtaaccaacccgttccctacaagagtcgacgtcaccgtatccttagacacgtccaaagaaccaattcctccctagaaactgaactctatcgaccgcgacagacctacggtcttgtttaattagttacggtaaccgggtccgttaaggtaacgtttgggacttacgtcgggggaccaggggacgtccggtggtccgaccgtctccncgacgccctaccacgacgggcccagtccggtcctccccgtgacccncctaccaccaagaccg

SEQ ID NO: 309939 - DNA, 571 bp, Homo sapiens
  misc_feature: GZ8MTXP02HV7LZ.2.4.A04.1.454.CMB.2.raw
  modified_base (224)..(224): a, c, t, g, unknown or other
  misc_feature (224)..(224): n is a, c, g, or t
  modified_base (367)..(367): a, c, t, g, unknown or other
  misc_feature (367)..(367): n is a, c, g, or t
  modified_base (372)..(372): a, c, t, g, unknown or other
  misc_feature (372)..(372): n is a, c, g, or t
  modified_base (517)..(517): a, c, t, g, unknown or other
  misc_feature (517)..(517): n is a, c, g, or t
tcagacgctcgacacacgaccggtgctcgatttagagtagtgatcagggggctttctgagagtcatggatctcatgtgcaagaaaatgaagcacctgtggttcttcctcctgctggtggcggctcccagatgggtcctgtcccagctgcagttgcaggagtcgggcccaggactgggtgaagccttcggagaccctgtcccctcacctgcactgtctctggtcncctccatcagcagtagtagttatacgtggggctggattcgccacgccccgagggagggcgtggagtggagttggggtagtttctagttagtggtagggggaacctacgtacctacccgtcctacaagagtcgacgtcaccgtntctanacacgtccaaagaacaattcctacctagaaactgaactctatcgaccgccgacacgacgacggtcttagtttattagttacggtacgggtcgtaggttaacgtggtaactcggtgggccgagggacgcggtagtccacgtctccncacgcctcgaccacggcccagtccgtccttcccgcgccaccctcctacgacgcg

SEQ ID NO: 309940 - DNA, 693 bp, Homo sapiens
  misc_feature: GZ8MTXP02G2R0N.2.4.A04.1.454.CMB.2.raw
  modified_base (222)..(222): a, c, t, g, unknown or other
  misc_feature (222)..(222): n is a, c, g, or t
tcagacgctcgacacacgaccggtgctcgatttagagtagtgatcagggggctttctgagagtcatggatctcatgtgcaagaaaatgaagcacctgtggttcttcctcctgctggtggcggctcccagatgggtcctgtcccagctgcagttgcaggagtcgggcccaggactggtgaagccttcggagaccctgtcccctcacctgcactgtctctggtncctccatcagcagtagtagttatacgtggggctggattcgccagcccccagggaagggctggagtggattggggatttctagttagtgggtacggggaacctacgtaccgaacccgttccctacgaaaggagtcgaacgtccgaaccgtatccttaagaacacgtccaaagaaaccaattccgtaccctagaaactgaaactctatgaccgtccgacacgacaaccggtcttagtttagttacttaggtaccgggtccgttaggttaacggtttggaacccgtttaacgcgggggtacccaagggggtacgtcccgggttggtccgtaacccggttcttccccgttacgaccgggtacccccttacccgaaacccgaaacgggggtcccccaaggtttccccgggtaaccctttcccccccgtggggtaccccctacccccggttacccttacccgaaaacggtaccccgg

SEQ ID NO: 309941 - DNA, 823 bp, Homo sapiens
  misc_feature: GZ8MTXP02HQKXU.2.4.A04.1.454.CMB.2.raw
  modified_base (223)..(223): a, c, t, g, unknown or other
  misc_feature (223)..(223): n is a, c, g, or t
tcagacgctcgacacacgaccggtgctcgatttagagtagtgatcagggggctttctgagagtcatggatctcatgtgcaaagaaaatgaagcacctgtggttcttcctcctgctggtggcggctcccagatgggtcctgtcccagctgcagttgcaggagtcgggcccaggactggtgaagccttcggagaccctgtccctcacctgcactgtctctggtcnctccatcagcagtagtagttatacgtggggctgatcgccacgccccgagggaagggctggagtggagttgggtagtttcgtagtagtagggtacggggaaacctaacgtaacccgaacccgttcctaaccgaaagtacgtcgaacgtaccgtaaccgttactaccgtttaacgaaccgacgttaccaaaacgtaaaacctaaacctttcctaacccttaagaaaacctttacgaaaaccttactaacgttaacgaccccgcccgaacgaacggtaaaccaccgggttacctttaacgggttttaatttaacgttaacggggttaaccggggtacccggtttaagggtttaaaaccggttcggggtaaaaccgtttaacgggccgggggtaacccggaaaagggggttacggacccgggttacgggttcccgtaaaacccccgggttctttccccaccgttaacccggaccccttaaccccggaaaccccgggaaaaccgggcccccgttaaacggttccccggggttaacccccttttcccccgtaccgggtacccccaaacccccggtttcccctaaacccgtaaaacggtaaccccgg

SEQ ID NO: 309942 - DNA, 620 bp, Homo sapiens
  misc_feature: GZ8MTXP02JIM81.2.4.A04.1.454.CMB.2.raw
  modified_base (203)..(203): a, c, t, g, unknown or other
  misc_feature (203)..(203): n is a, c, g, or t
  modified_base (222)..(222): a, c, t, g, unknown or other
  misc_feature (222)..(222): n is a, c, g, or t
  modified_base (342)..(342): a, c, t, g, unknown or other
  misc_feature (342)..(342): n is a, c, g, or t
  modified_base (347)..(347): a, c, t, g, unknown or other
  misc_feature (347)..(347): n is a, c, g, or t
  modified_base (605)..(605): a, c, t, g, unknown or other
  misc_feature (605)..(605): n is a, c, g, or t
tcagacgctcgacacacgaccggtgctcgatttagagtagtgatcagggggctttctgagagtcatggatctcatgtgcaagaaatgaagcacctgtggttcttcctcctgctggtggcggctcccagatgggtcctgtcccagctgcagttgcaggagtcgggcccaggactggtgaacgccttcggagaccctgtcccctnacctgcactgtctctggtncctcatcagcagtagtagttatacgtgggctggattcgccacgcccccgagggaacgggcgtaggagtggagttggggtagtttctattagtggtacggggaacctactacacccgtccnaacgngtcgacgtcaccgtatcctagacacgtccaaacgaaccaattcctaccgtagaaactagaaaccttctaatcgaacccgccgaccagaccacggcttaggtttacttagttcggttacgggtccgttaggttaaacggttcggacgttacggtcggggaccgacggggacgtcgggtacggtccaccggtcttccgcgacggtccctaccgaccgaacgggccctagtacccggtcctccccgtacggccctaccccncctaccgaacgaccg

SEQ ID NO: 309943 - DNA, 540 bp, Homo sapiens
  misc_feature: GZ8MTXP02F0OAW.2.4.A04.1.454.CMB.2.raw
  modified_base (385)..(385): a, c, t, g, unknown or other
  misc_feature (385)..(385): n is a, c, g, or t
  modified_base (461)..(461): a, c, t, g, unknown or other
  misc_feature (461)..(461): n is a, c, g, or t
  modified_base (479)..(479): a, c, t, g, unknown or other
  misc_feature (479)..(479): n is a, c, g, or t
tcagacgctcgacacacgaccggtgctcgatttagagtagtgatcagggggctttctgagagtcatggatctcatgtgcaagaaaatgaagcacctgtggttcttcctcctgctggtggcggctcccagatgggtcctgtcccagctgcagttgcaggagtcgggcccagggactggtgaagccttcggagaccctgtccctcacctgcactgtctctggtgcctccatcagcagtagtattattactggggctggattcgccagcccccaggaaggggctggagtggattgggagtttctatatggtggggaacctactacaacccgtcctcagagtcgagtcaccgtatccttagacacgtccaagaaccaattctaccctanaaactgaaactctatgaccgcgcagacaggctgttatattgtacggcgtgaacgttgactatgggccagggagcgnggtacacgtctcctcgancctacacctaacgggccctatccgggtcttccccctggcccacccctcctccgaagtaccg

SEQ ID NO: 309944 - DNA, 639 bp, Homo sapiens
  misc_feature: GZ8MTXP02GT8QO.2.4.A04.1.454.CMB.2.raw
  modified_base (223)..(223): a, c, t, g, unknown or other
  misc_feature (223)..(223): n is a, c, g, or t
tcagacgctcgacacacgaccggtgctcgatttagagtagtgatcagggggctttctgagagtcatggatctcatgtgcaagaaaatgaagcacctgtggttcttcctcctgctggtggcggctcccagatgggtcctgtcccagctgcagttgcaggagtcgggcccaggactggtgaagccttcggacgaccctgtcccctcacctgcactgtctctggtncctcatcagcagtagtagttattacgtggggctggattcgccacgcccccgagggaagggctggagtggagttggggtagtttcgtagttagtgggtacgggggtaacctactaccgtaacccgtccctacgaagacgtcgacgtcaccgtatccttagacacgtccaaagaaacctacttcctaccctagtaaactcgtaaactctatcgaccgcgacacgacgacggtcttagtttattagttaggtacggtcgtagttacggttggtacgtacggtggggaccgaggggtacgcggtcggtaccgtaccgtcctccgtcgacggtcccctaccgaacccgaacgggccccctacgttcccggttcccttcccccggcggtacccctaccccgtccgtacccgaaacgtacccg

SEQ ID NO: 309945 - DNA, 649 bp, Homo sapiens
  misc_feature: GZ8MTXP02GIXH0.2.4.A04.1.454.CMB.2.raw
  modified_base (342)..(342): a, c, t, g, unknown or other
  misc_feature (342)..(342): n is a, c, g, or t
tcagacgctcgacacacgaccggtgctcgatttagagtagtgatcagggggctttctgagagtcatggatctcatgtgcaagaaaatgaagcacctgtggttcttcctcctgctggtggcggctcccagatgggtcctgtcccagctgcagttgcaggagtcgggcccaggactggtgaagccttcggagaccctgtcccctcacctgcactgtctcgtggtcgcctccatcagcagtagtagttattacgtggggctggatcgcacgccccgagggagggctggagtggtagttgggtatttcgtattagtggtaggggaacctacgtaccaccgtcctanaagcgtcgacgtcacgtactcctagaccacgtccaacgaaccattcctacctagaactgaaactctaatcgaccgcgacacgacgtacgtcttagtttatagttacggtacgggtcgttaggttaaccgttggtacgtacggtcgggggacctagggggtacgtcccggttgggtacctaccggttccttacccgtacgtaccgccccgttaccgaacccggtaaccggggaccctaacggttcccggtaacccctttcccccggacggtccccctaccccgttacccgtacccgtaaacggacccg

SEQ ID NO: 309946 - DNA, 439 bp, Homo sapiens
  misc_feature: GZ8MTXP01EB6AK.22.80.H03.1.454.CMB.2.raw
  modified_base (433)..(439): a, c, t, g, unknown or other
  misc_feature (433)..(439): n is a, c, g, or t
tcagacatacgcgtcacgaccggtgctcgatttagctgtgcgtcgaagggaagggctggagtgggtttcatacattagtagtagtggtagtaccatatactacgcagactctgtgaagggccgattcaccatctccagggacaacgccaagaactcactgtatctgcaaatgaacagcctgagagccgaggacacggccgtgtattactgtgcgaggacctcatacgatttttggagtggttattcccccctctgactactgggccagggaaccctggtcaccgtctcctcagcctccaccaagggcccatcggtcttccccctggcaccctcctccaagagcacctctgggggcacacgcggcctggggctgccctggtcaaagggactacttccacgcgtatgtctgagcggggctggcaaggcgcatagnnnnnnn

SEQ ID NO: 309947 - DNA, 438 bp, Homo sapiens
  misc_feature: GZ8MTXP01BGZ1Q.22.80.H03.1.454.CMB.2.raw
  modified_base (435)..(438): a, c, t, g, unknown or other
  misc_feature (435)..(438): n is a, c, g, or t
tcagacatacgcgtcacgaccggtgctcgatttagctgtgcgtcgaagggaaaggggctggagtgggtttcatacattagtagtagtggtagtaccatatactacgcagactctgtgaagggccgattcaccatctccagggacaacgccaagaactcactgtatctgcaaatgaacagcctgagagccgaggacacggccgtgtattactgtgcgaggactcatacgatttttggagtggttactttcccccctctgactactggggccagggaaccctggtcaccgtctcctcagcctccaccaagggccccatcggtcttccccctggcacccctcctccaagagcacctctgggggcacacgcggcctgggctgccctggtcaaggctacttccacgcgtatgtcctgagcgggctggcaaggcgcatagnnnn

SEQ ID NO: 309948 - DNA, 442 bp, Homo sapiens
  misc_feature: GZ8MTXP01DYCSZ.22.80.H03.1.454.CMB.2.raw
  modified_base (437)..(442): a, c, t, g, unknown or other
  misc_feature (437)..(442): n is a, c, g, or t
tcagacatacgcgtcacgaccggtgctcgatttagctgtgcgtcgaagggaaggggctggagtgggtttcatacattagtagtagtggtagtaccatatactacgcagactctgtgaagggccgattcaccatctccagggacaacgccaagaactcactgtatctgcaaatgaacagcctgagagccgaggacacggccgtgtattactgtgcgaggacctcatacgtatttttggagttggttactttcccccctctgactacgtggggccagggaaccctggtcaccgtctcctcagcctccaccaaggcccatcgtccttccccctgccaccctcctccaagagcacctcgtgggggcacgacgccggcctgggctgcctggtcaaaggctacttccacgcgtatgtctgagcgggctggcaaggcgcatagnnnnnn

SEQ ID NO: 309949 - DNA, 438 bp, Homo sapiens
  misc_feature: GZ8MTXP02GXQCU.22.80.H03.1.454.CMB.2.raw
  modified_base (431)..(438): a, c, t, g, unknown or other
  misc_feature (431)..(438): n is a, c, g, or t
tcagacatacgcgtcacgaccggtgctcgatttagctgtgcgtcgaagggaaaggggctggagtgggtttcatacattagtagtagtggtagtaccatatactacgcagactctgtgaagggccgattcaccatctccagggacaacgccaagaactcactgtatctgcaaatgaacagcctgagagccgaggacacggccgtgtattactgtgcgaggacctcatacgatttttggagtggttatttccccctctgactactggggccagggaaccctggtcaccgtctcctcagcctccaccaaggccccatcggtcttccccctggcaccctcctccaagagcacctctggggcacacgcggccctggggctgcctggtcaaggctacttccacgcgtatgtctgagcgggctggcaaggcgcatagnnnnnnnn

SEQ ID NO: 309950 - DNA, 435 bp, Homo sapiens
  misc_feature: GZ8MTXP02IXSGC.22.80.H03.1.454.CMB.2.raw
  modified_base (344)..(344): a, c, t, g, unknown or other
  misc_feature (344)..(344): n is a, c, g, or t
  modified_base (432)..(435): a, c, t, g, unknown or other
  misc_feature (432)..(435): n is a, c, g, or t
tcagacatacgcgtcacgaccggtgctcgatttagctgtgcgtcgaagggaaagggctggagtgggtttcatacattagtagtagtggtagtaccatatactacgcagactctgtgaagggccgattcaccatctccagggacaacgccaagaactcactgtatctgcaaatgaacagcctgagagccgaggacacggccgtgtattactgtgcgaggacctcatacgtatttttggagttggttactttcccccctctgactacgtggggccagggaaccctggtcaccgtctcctcagcctccaccaaggcccatcggtctcccctgcaccctcctccaagngcacctctggggcacacgcggccctgggctgcctggtcaaggactacttccactcgtattgtctgagcgggctggcaaggcgcatagnnnn

SEQ ID NO: 309951 - DNA, 435 bp, Homo sapiens
  misc_feature: GZ8MTXP02JA7EV.22.80.H03.1.454.CMB.2.raw
  modified_base (431)..(435): a, c, t, g, unknown or other
  misc_feature (431)..(435): n is a, c, g, or t
tcagacatacgcgtcacgaccggtgctcgatttagctgtgcgtcgaagggaaaggggctggagtgggtttcatacattagtagtagtggtagtaccatatactacgcagactctgtgaagggccgattcaccatctccagggacaacgccaagaactcactgtatctgcaaatgaacagcctgagagccgaggacacggccgtgtattactgtgcgaggacctcatacgatttttggagtggttattccccctctgactactgggccagggaaccctggtcaccgtctcctcagcctccaccaaggcccatcggtcttccccctggccacccctcctccaagacgcacctctgggggcacacgcggccctggctgcctggtcaaggactacttccacgcgtatgtctgagcgggctggcaaggcgcatagnnnnn

SEQ ID NO: 309952 - DNA, 443 bp, Homo sapiens
  misc_feature: GZ8MTXP02GJP9W.22.80.H03.1.454.CMB.2.raw
  modified_base (224)..(224): a, c, t, g, unknown or other
  misc_feature (224)..(224): n is a, c, g, or t
  modified_base (348)..(348): a, c, t, g, unknown or other
  misc_feature (348)..(348): n is a, c, g, or t
  modified_base (438)..(443): a, c, t, g, unknown or other
  misc_feature (438)..(443): n is a, c, g, or t
tcagacatacgcgtcacgaccggtgctcgatttagctgtgcgtcgaagggaaaggggctggagtgggtttcatacattagtagtagtggtagtaccatatactacgcagactctgtgaagggccgattcaccatctccagggacaacgccaagaactcactgtatctgcaaatgaacagcctgagagccgaggacacggccgtgtattactgtgcgaggacctnatacgatttttggagttggttatttcccccctctgactactgggccagggaaccctggtcaccgtctcctcagcctccaccaagggccccatcggtccttccccctggccaccctcctccaagncacctcgtgggggcacacgccggccctggggctgcctggtcaaggactactccacgcgtatgtctgagcggggctggcaaggcgcaatgnnnnnn

SEQ ID NO: 309953 - DNA, 544 bp, Homo sapiens
  misc_feature: GZ8MTXP01APOOQ.41.38.D05.1.454.CMB.2.raw
  modified_base (359)..(359): a, c, t, g, unknown or other
  misc_feature (359)..(359): n is a, c, g, or t
  modified_base (415)..(415): a, c, t, g, unknown or other
  misc_feature (415)..(415): n is a, c, g, or t
tcagtctatactatcacgaccggtgctcgatttagtatctgatagttgggtttggggctgggcctaaggaagcagcactggtggtgcctcagccatggcctggacctttctcctcctcggcctcctctctcactgcacaggctctgtgacctcctatgtgctgactcagccaccctcagtgtcagtggccccaggaaagacggccaggattacctgtgggggaaacaacattggaagtaaaagtgtgcactggtaccagcagaagccaggccaggcccctgtgctggtcatctattatgatagcgaccggccctcaggggatccctgagcgattctcctggctccaactctagggaacncggccaccctgaccatcagcagggtcgaaggccggggatggaggccgactattacngtcaggtgtgggataggtagtagtgatcgagtcgggtggttcggcggagggaccaaggctcggacccgtccgaggtcgacgcccgaagggcctcggccccctgggtccacgttcgtcgttccccgcccc

SEQ ID NO: 309954 - DNA, 532 bp, Homo sapiens
  misc_feature: GZ8MTXP01CO8T8.41.38.D05.1.454.CMB.2.raw
  modified_base (362)..(362): a, c, t, g, unknown or other
  misc_feature (362)..(362): n is a, c, g, or t
  modified_base (419)..(419): a, c, t, g, unknown or other
  misc_feature (419)..(419): n is a, c, g, or t
  modified_base (464)..(464): a, c, t, g, unknown or other
  misc_feature (464)..(464): n is a, c, g, or t
tcagtctatactatcacgaccggtgctcgatttagtatctgatagttgggtttggggctgggcctaaggaagcagcactggtggtgcctcagccatggcctggacctttctcctcctcggcctcctctctcactgcacaggctctgtgacctcctatgtgctgactcagccaccctcagtgtcagtggccccaggaaagacggccaggattacctgtgggggaaacaacattggaaagtaaaagtgtgcactggtaccagcagaagccaggccaggcccctgtgctggtcatctattatgatagcgaccggccctcgagggatccctgacgcgattctcctggctccaactcgtagggaacncggccaccctgaccatcagcagggtcgaaggccggggatggaggccgactagttacngtcaggtgtgggataggtagtagtgatcgagtcgggtgttcgggnggagggaccaagctgaccgtcaggtcagcccgaggcctcgcccctggccacttctcgttccccgtccc

SEQ ID NO: 309955 - DNA, 734 bp, Homo sapiens
  misc_feature: GZ8MTXP01AUX1H.41.38.D05.1.454.CMB.2.raw
  modified_base (385)..(385): a, c, t, g, unknown or other
  misc_feature (385)..(385): n is a, c, g, or t
tcagtctatactatcacgaccggtgctcgatttagtatctgatagttgggtttggggctgggcctaaggaagcagcactggtggtgcctcagccatggcctggacctttctcctcctcggcctcctctctcactgcacaggctctgtgacctcctatgtgctgactcagccaccctcagtgtcagtcggccccaggaaagacggccaggattaccgtggtagggggaaacaacattggaaagtaaaagtgtgcactggtaccagcaagagccaggccaggcccctgtgctggtcatctattatgatagcgaccggccctcgagggactcccgtgacgcgtacttcgtccgtacggctacccgaactccggtaacggggaaacccncccggggccctaaccccgtacggaaccccacgttaccgaacgggcccggaagggggttaccggaaacggggcccggggggaatcggggaacggggtacccggtaactttacgttaaccgtcggttacgaaggggttgggttaggggaagttaagggtacggttaaggtcggaagttccgtaaggttccgggggttaggttaccggggtcgggggtaacggggacccgtaaaggggtccgttacgggaccccgggttacccgttaggggtccgaaccggaccccgaagggttcccgtaacccggcccccgttccggtcctaccgttcccgttccggtttcccccgtcccc

SEQ ID NO: 309956 - DNA, 542 bp, Homo sapiens
  misc_feature: GZ8MTXP01EW7NE.41.38.D05.1.454.CMB.2.raw
  modified_base (322)..(322): a, c, t, g, unknown or other
  misc_feature (322)..(322): n is a, c, g, or t
  modified_base (357)..(357): a, c, t, g, unknown or other
  misc_feature (357)..(357): n is a, c, g, or t
tcagtctatactatcacgaccggtgctcgatttagtatctgatagttgggtttggggctgggcctaaggaagcagcactggtggtgcctcagccatggcctggacctttctcctcctcggcctcctctctcactgcacaggctctgtgacctcctatgtgctgactcagccaccctcagtgtcagtggccccaggaaagacggccaggattacctgtgggggaaacaacattggaagtaaaagtgtgcactggtaccagcagaagccaggccaggcccctgtgctggcatctattatgatagcgacgccctgagggatcccngagcgattctcctggctccaactcgtagggaaccncggcccacccgtgacccatcagcgagggtcgaaggccgggatgaggccgactatactgcaggtgtgggataggtagtagtgatcgagtcgggtagtcggacggagggaccaaggctgaccggtcttacgggtcaggcccgaggttccgcgcccccgtggtccacgttcgtcgtttccccgccccg

SEQ ID NO: 309957 - DNA, 547 bp, Homo sapiens
  misc_feature: GZ8MTXP02FZUT8.41.38.D05.1.454.CMB.2.raw
  modified_base (215)..(215): a, c, t, g, unknown or other
  misc_feature (215)..(215): n is a, c, g, or t
  modified_base (365)..(365): a, c, t, g, unknown or other
  misc_feature (365)..(365): n is a, c, g, or t
  modified_base (520)..(520): a, c, t, g, unknown or other
  misc_feature (520)..(520): n is a, c, g, or t
tcagtctatactatcacgaccggtgctcgatttagtatctgatagttgggtttggggctgggcctaaggaagcagcactggtggtgcctcagccatggcctggacctttctcctcctcggcctcctctctcactgcacaggctctgtgacctcctatgtgctgactcagccaccctcagtgtcagtggccccaggaaagacggccaggattaccnggtagggggaaacaacattggaaagtaaaagtgtgcactggtaccagcagaagccaggccaggcccctgtgctggtcatctatatgatagcgaccggccctcagggactcccgtgacgcgattctcctggctccaactcgtacgggaacncggcccacccgtgacccatcgacgcgacggggtcgaacggccggggatggacggccgacttattacgtgtacgtaggtggtagggatagtagtagtagatcgagtcgggtgtcgggcggaggacagcgtgaccgtcgtaggcacgaccgaaggcncgcccctcggtcactctcgtccctccc

SEQ ID NO: 309958 - DNA, 433 bp, Homo sapiens
  misc_feature: GZ8MTXP01C6OSL.19.81.H04.1.454.CMB.2.raw
  modified_base (327)..(327): a, c, t, g, unknown or other
  misc_feature (327)..(327): n is a, c, g, or t
  modified_base (331)..(331): a, c, t, g, unknown or other
  misc_feature (331)..(331): n is a, c, g, or t
  modified_base (359)..(359): a, c, t, g, unknown or other
  misc_feature (359)..(359): n is a, c, g, or t
  modified_base (405)..(405): a, c, t, g, unknown or other
  misc_feature (405)..(405): n is a, c, g, or t
  modified_base (428)..(433): a, c, t, g, unknown or other
  misc_feature (428)..(433): n is a, c, g, or t
tcagtactctcgtgcacgaccggtgctcgatttagtagtgtagattcgcggatgtctctgtggtcaaggtgagtctgtcctggaatttctgtgacaacattgtcacagaaattccaggacagactcaccttgaccacagagacatccgcgaatacagcctacatggacctgggcagcctgacgtctgaagacacggctacatattattgtgtgagagattggaatcgggagactaactggagtcgtgacgttctttcgacccctggggccaggggacctcggtcattgtctcctcagcctccaccaaggcccatcggtcttcccccnggcncctgctccacggcgcacctccgagagcncagcggccctgggctgcctgggtcaaggctactccacgagagtacngagcgggctggcaaggcgcatgnnnnnn

SEQ ID NO: 309959 - DNA, 571 bp, Homo sapiens
  misc_feature: GZ8MTXP01AF1QE.19.81.H04.1.454.CMB.2.raw
  modified_base (232)..(232): a, c, t, g, unknown or other
  misc_feature (232)..(232): n is a, c, g, or t
  modified_base (341)..(341): a, c, t, g, unknown or other
  misc_feature (341)..(341): n is a, c, g, or t
  modified_base (538)..(538): a, c, t, g, unknown or other
  misc_feature (538)..(538): n is a, c, g, or t
  modified_base (540)..(540): a, c, t, g, unknown or other
  misc_feature (540)..(540): n is a, c, g, or t
  modified_base (542)..(542): a, c, t, g, unknown or other
  misc_feature (542)..(542): n is a, c, g, or t
  modified_base (544)..(545): a, c, t, g, unknown or other
  misc_feature (544)..(545): n is a, c, g, or t
  modified_base (547)..(571): a, c, t, g, unknown or other
  misc_feature (547)..(571): n is a, c, g, or t
tcagtactctcgtgcacgaccggtgctcgatttagtagtgtagattcgcggatgtctctgtggtcaaggtgagtctgtcctggaatttctgtgacaacattgtcacagaaattccaggacagactcaccttgaccacagagacatccgcgaatacagcctacatggacctgggcagccctgacgtctgaagacacggctacatattattgtgtgagagattggaatcggganactaactggagtcgtgacgttctttccgaccccgtggggccaggggacctcggtcattgtctcctcacgccctccaccgacgggcccatcggtccttcccccgtggccnccctgctccaggacgcacccgtccgagaacgccaacgacgcccggcccgtcggggccttcggcccgttcgggtaccaaacgggtacccttaaaccgttaacccgaaccggaaggtaacggttaaacccgtgggaacgggcccgggggcccttagggggaccccgaaaagggggccccggggtaaacgtaagtacggngngngnngnnnnnnnnnnnnnnnnnnnnnnnnn

SEQ ID NO: 309960 - DNA, 433 bp, Homo sapiens
  misc_feature: GZ8MTXP01A2U2L.19.81.H04.1.454.CMB.2.raw
  modified_base (294)..(294): a, c, t, g, unknown or other
  misc_feature (294)..(294): n is a, c, g, or t
  modified_base (326)..(326): a, c, t, g, unknown or other
  misc_feature (326)..(326): n is a, c, g, or t
  modified_base (358)..(358): a, c, t, g, unknown or other
  misc_feature (358)..(358): n is a, c, g, or t
  modified_base (412)..(412): a, c, t, g, unknown or other
  misc_feature (412)..(412): n is a, c, g, or t
  modified_base (422)..(422): a, c, t, g, unknown or other
  misc_feature (422)..(422): n is a, c, g, or t
  modified_base (428)..(433): a, c, t, g, unknown or other
  misc_feature (428)..(433): n is a, c, g, or t
tcagtactctcgtgcacgaccggtgctcgatttagtagtgtagattcgcggatgtctctttggtcaaggtgagtctgtcctggaatttctgtgacaacattgtcacagaaattccaggacagactcaccttgaccacagagacatccgcgaatacagcctacatggacctgggcagcctgacgtctgaagacacggctacatattatgtgtgagagattggaatcgggagactaactggagtcgtgacgttctttcgacccctggggccaggggacctcggtcattgtctcctnagcctccaccaaggcccatcggtcctcccccngcgccctgctccaggacgcactcgagagcacngcgcccctgggctgccgtggtcaacggctactcccagagagtactgagcgggcnggcaagggcncatagnnnnnn

SEQ ID NO: 309961 - DNA, 553 bp, Homo sapiens
  misc_feature: GZ8MTXP01CBBED.19.81.H04.1.454.CMB.2.raw
  modified_base (366)..(366): a, c, t, g, unknown or other
  misc_feature (366)..(366): n is a, c, g, or t
  modified_base (389)..(389): a, c, t, g, unknown or other
  misc_feature (389)..(389): n is a, c, g, or t
  modified_base (408)..(408): a, c, t, g, unknown or other
  misc_feature (408)..(408): n is a, c, g, or t
  modified_base (485)..(485): a, c, t, g, unknown or other
  misc_feature (485)..(485): n is a, c, g, or t
  modified_base (528)..(553): a, c, t, g, unknown or other
  misc_feature (528)..(553): n is a, c, g, or t
tcagtactctcgtgcacgaccggtgctcgatttagtagtgtagattcgcggatgtctctgtggtcaaggtgagtctgtcctggaatttctgtgacaacattgtcacagaaattccaggacagactcaccttgaccacagagacatccgcgaatacagcctacatggacctggggcagcctgacgtctgaagacacggctacattattattgtgtgagagattggaagtcggggagactaacgtgggagtcggtgtacgtttcttttcccggaccccgtgggggcccgagggggtaccctcggtctagtttcggtcctcctcacgcccctccacccgaacgggccctagtccggtcccttcccccgnggccgcccctgcctccgaggacncacccgtcccgagacgccncgacggcccggcccgtggggctcggccgtgggtaccaaacgggtcccttaccgtccccgaagggagtacgttacggnggacgggccgggacgacgggacggacgggtcggactaggtagnnnnnnnnnnnnnnnnnnnnnnnnnn

SEQ ID NO: 309962 - DNA, 606 bp, Homo sapiens
  misc_feature: GZ8MTXP01A6ULH.19.81.H04.1.454.CMB.2.raw
  modified_base (234)..(234): a, c, t, g, unknown or other
  misc_feature (234)..(234): n is a, c, g, or t
  modified_base (553)..(553): a, c, t, g, unknown or other
  misc_feature (553)..(553): n is a, c, g, or t
  modified_base (582)..(582): a, c, t, g, unknown or other
  misc_feature (582)..(582): n is a, c, g, or t
  modified_base (584)..(606): a, c, t, g, unknown or other
  misc_feature (584)..(606): n is a, c, g, or t
tcagtactctcgtgcacgaccggtgctcgatttagtagtgtagattcgcggatgtctctgtggtcaaggtgagtctgtcctggaatttctgtgacaacattgtcacagaaattccaggacagactcaccttgaccacagagacatccgcgaatacagcctacatggacctgggcagcctgacgtctgaagacacggctacattattattgtgtgagagtagttggaatcggganactaacgtggtagtcgtgtacgtttctttccgaccccgtggggccgagggtaccctcggtctagttcgtcctcctcacgcccctacccaaccgaacgggcccctacgtcccggttccccctttccccccgtgggccccgtccccgtcgtcccgtcccgaacgggacccgccgtaaccccgtccggaacggaacgacccgaaccgaccgggccccggggtcccgtcgggggtccctcgggtcccgttacggggtaacctaaacggggtaccccttaaccgttaccccgaaggtagtaacgtacgtgggacgggccgggtntacgggaccgacgggccggaactaagagngnnnnnnnnnnnnnnnnnnnnnnn

SEQ ID NO: 309963 - DNA, 439 bp, Homo sapiens
  misc_feature: GZ8MTXP02G1C16.19.81.H04.1.454.CMB.2.raw
  modified_base (408)..(408): a, c, t, g, unknown or other
  misc_feature (408)..(408): n is a, c, g, or t
  modified_base (432)..(439): a, c, t, g, unknown or other
  misc_feature (432)..(439): n is a, c, g, or t
tcagtactctcgtgcacgaccggtgctcgatttagtagtgtagattcgcggatgtctctgtggtcaaggtgagtctgtcctgtaatttctgtgacaacattgtcacagaaattccaggacagactcaccttgaccacagagacatccgcgaatacagcctacatggacctgggcagcctgacgtctgaagacacggctacatattattgtgtgagagattggaatcgggagactaactggagtcgtgacgttctttcgacccctggggccaggggacctcggtcattgtctcctcagcctccaccaaggcccatcggtcttcccctggccgcctgctccacggacgccacctccgagacgcacagcggccctgggctgcctggtcaaggactactcccagagagtacngagcgggctggcaaggcgcatagnnnnnnnn

SEQ ID NO: 309964 - DNA, 428 bp, Homo sapiens
  misc_feature: GZ8MTXP02H8FEM.19.81.H04.1.454.CMB.2.raw
  modified_base (326)..(326): a, c, t, g, unknown or other
  misc_feature (326)..(326): n is a, c, g, or t
  modified_base (330)..(330): a, c, t, g, unknown or other
  misc_feature (330)..(330): n is a, c, g, or t
  modified_base (355)..(355): a, c, t, g, unknown or other
  misc_feature (355)..(355): n is a, c, g, or t
  modified_base (420)..(420): a, c, t, g, unknown or other
  misc_feature (420)..(420): n is a, c, g, or t
  modified_base (425)..(428): a, c, t, g, unknown or other
  misc_feature (425)..(428): n is a, c, g, or t
tcagtactctcgtgcacgaccggtgctcgatttagtagtgtagattcgcggatgtctctgtggtcaaggtgagtctgtcctggaatttctgtgacaacattgtcacagaaattccaggacagactcaccttgaccacagagacatccgcgaatacagcctacatggacctgggcagcctgacgtctgaagacacggctacatattattgtgtgagagattggaatcgggagactaactggagtcgtgacgttctttcgacccctggggccaggggacctcggtcattgtctcctcagcctccaccaaggcccatcggtcttccccnggcnccctgctccaggagcacctccgagngcacagcggccctgggctcgctgcaaggctactaccacgagagtactgagcgggctggacaggcnatagnnnn

SEQ ID NO: 309965 - DNA, 512 bp, Homo sapiens
  misc_feature: GZ8MTXP01DJ2V3.25.64.F09.1.454.CMB.2.raw
  modified_base (478)..(478): a, c, t, g, unknown or other
  misc_feature (478)..(478): n is a, c, g, or t
tcagactgtacagtcacgaccggtgctcgatttagcgcgtatacaaggggaggaactgctcagttaggacccagacggaaccatggaagcccagcgcagcttctcttcctcctgctactctggctcccagattccactggagaaatagtgatgacgcagtctccagccaccctgtctgtgtctccaggggacagagccaccctctcctgcagggccagtcagagtattagcggcaacttagcctggtaccagcagaaacctggccagggtcccaggctcctcatccacggtgcatccaccagggccactggaattccagccaggttcagtggcagtgggtctggggacagaacttctctctcaccatcagcagcctgcagtctgacgattttgctagtttattactgtcacaggtataataactggcctccgtgtacgtttggcctaaagggaccaaggtggaaaagcaaacgtaacngtaggcttggcaccaatctgtctcatcttcccgc

SEQ ID NO: 309966 - DNA, 521 bp, Homo sapiens
  misc_feature: GZ8MTXP01BREFO.25.64.F09.1.454.CMB.2.raw
  modified_base (234)..(234): a, c, t, g, unknown or other
  misc_feature (234)..(234): n is a, c, g, or t
  modified_base (291)..(291): a, c, t, g, unknown or other
  misc_feature (291)..(291): n is a, c, g, or t
  modified_base (355)..(355): a, c, t, g, unknown or other
  misc_feature (355)..(355): n is a, c, g, or t
tcagactgtacagtcacgaccggtgctcgatttagcgcgtatacaaggggaggaactgctcagttaggacccagacggaaccatggaagccccagcgcagcttctcttcctcctgctactctggctcccagattccactggagaaatagtgatgacgcagtctccagccaccctgtctgtgtctccaggggacagagccaccctctcctgcagggccagtcagagtatagcggnaacttagcctggtaccagcagaacctggccagggtcccaggctcctcatccacggtncatccacagggccactggaacttccagccaggttcagtggcagtgggtctgggacagaacttcnctctcaccatcagctagcctgcagtctgacgtattttgctagtttatactgtctagactagtaataaaactaacgtacgtacgtagtttggtacgacgggtaccgaagacgtggaacattacacgacgaacgtagttgggcgcgcactaactctcttctcttctcc

SEQ ID NO: 309967 - DNA, 511 bp, Homo sapiens
  misc_feature: GZ8MTXP01A5OML.25.64.F09.1.454.CMB.2.raw
  modified_base (295)..(295): a, c, t, g, unknown or other
  misc_feature (295)..(295): n is a, c, g, or t
  modified_base (465)..(465): a, c, t, g, unknown or other
  misc_feature (465)..(465): n is a, c, g, or t
  modified_base (488)..(488): a, c, t, g, unknown or other
  misc_feature (488)..(488): n is a, c, g, or t
  modified_base (491)..(491): a, c, t, g, unknown or other
  misc_feature (491)..(491): n is a, c, g, or t
  modified_base (499)..(499): a, c, t, g, unknown or other
  misc_feature (499)..(499): n is a, c, g, or t
  modified_base (507)..(507): a, c, t, g, unknown or other
  misc_feature (507)..(507): n is a, c, g, or t
tcagactgtacagtcacgaccggtgctcgatttagcgcgtatacaaggggaggaactgctcagttaggacccagacggaaccatggaagccccagcgcagcttctcttcctcctgctactctggctcccagattccactggagaaatagtgatgacgcagtctccagccaccctgtctgtgtctccgaggggacagagccaccctctcctgcagggccagtcagagtattagcggacaacttagcctggtaccagcagaaacctggccagggtcccaggctcctcatccacggtncatccacgagggccactggaacttccagccaggttcagtggcaggtgggtctggggacagtaaccttctctctcaccatcagcagcctgcagtctgacgtatttgctagtttattactgtcagctagtaataaaactggacctatagtttggaccgaggggtaccaagcnggaacattcagacgaatgttgcngcncaactctnttctcttnttcc

SEQ ID NO: 309968 - DNA, 660 bp, Homo sapiens
  misc_feature: GZ8MTXP01B2Y9D.25.64.F09.1.454.CMB.2.raw
tcagactgtacagtcacgaccggtgctcgatttagcgcgtatacaaggggaggaactgctcagttaggacccagacggaaccatggaagcccagcgcagcttctcttcctcctgctactctggctcccagattccactggagaaatagtgatgacgcagtctccagccaccctgtctgtgtctccaggggacagagccaccctctcctgcagggccagtcagagtattagcggcaacttagcctgggtaccagcagaaacctacggccgacggtcccgacggctcctcatccacggtggcatccaccacgggccactggaatccctagccacggttatacgtgggcacggttggggtcgtggggacgagtaaccgttcttcctaccttcacccactcacggctacgccctgcagtcgtgaccggtaattttttgtccgtaaggttttatttaacctggttctaacggactagttaaagttaaaaaacctggggtccgtaaccctaaggttttgggtacccgacgggggtaacccggtaaatccggtggggtaaccaacttcggtacgaaaccggggtaaacctcggttgggggcccttacggaacccgtaacccaaacctttcgtccggtttccgtttaacccttcggttttaacccccg

SEQ ID NO: 309969 - DNA, 538 bp, Homo sapiens
  misc_feature: GZ8MTXP01CHZD3.25.64.F09.1.454.CMB.2.raw
  modified_base (527)..(527): a, c, t, g, unknown or other
  misc_feature (527)..(527): n is a, c, g, or t
  modified_base (533)..(533): a, c, t, g, unknown or other
  misc_feature (533)..(533): n is a, c, g, or t
tcagactgtacagtcacgaccggtgctcgatttagcgcgtatacaagggggaggaactgctcagttaggacccagacggaaccatggaagccccagcgcagcttctcttcctcctgctactctggctcccagattccactggagaaatagtgatgacgcagtctccagccaccctgtctgtgtctccaggggacagagcccaccctctcctgcagggccagtcagagtatagcgcaacttgcctggtaccagcagaacctggccagggtcccaggctcctcactcccacggtgcactcccaccgaggggcccacgtggaactttcccaagcccgtaggttcaggtggcaggtggggtctggggacaggaacctttcgtctctccacatcagcagccctgcagtctgacgtattttgctagtttattactgtcagtcagtaaataaaactggaccgttactaggtttggaccgtaggggtaccaaggctggaacattcaagacgaactgttaggcttgcacaatcgtnttctcnttccc

SEQ ID NO: 309970 - DNA, 507 bp, Homo sapiens
  misc_feature: GZ8MTXP01A4KAS.25.64.F09.1.454.CMB.2.raw
  modified_base (293)..(293): a, c, t, g, unknown or other
  misc_feature (293)..(293): n is a, c, g, or t
  modified_base (493)..(493): a, c, t, g, unknown or other
  misc_feature (493)..(493): n is a, c, g, or t
  modified_base (497)..(497): a, c, t, g, unknown or other
  misc_feature (497)..(497): n is a, c, g, or t
tcagactgtacagtcacgaccggtgctcgatttagcgcgtatacaaggggaggaactgctcagttaggacccagacggaaccatggaagccccagcgcagcttctcttcctcctgctactctggctcccagattccactggagaaatagtgatgacgcagtctccagccaccctgtctgtgtctccaggggacagagccaccctctcctgcagggccagtcagagtattagcggcaacttagcctggtaccagcagaacctggccagggtcccaggcctcctcatccacggtncatcccaccgagggccactggattccagccaggttcagtgcaggtggtctgggacagtaacttctctctcaccatcagcagcctgcagtctgacgtatttgctagtttattactgtcagcagtaataaaactggaccgtactagtttcggacgaggggaccaagtctggaactattcgagacgaatgttggcttgcaccntctnttctcttctc

SEQ ID NO: 309971 - DNA, 525 bp, Homo sapiens
  misc_feature: GZ8MTXP01EX7K2.25.64.F09.1.454.CMB.2.raw
  modified_base (360)..(360): a, c, t, g, unknown or other
  misc_feature (360)..(360): n is a, c, g, or t
tcagactgtacagtcacgaccggtgctcgatttagcgcgtatacaagggggaggaactgctcagttaggacccagacggaaccatggaagccccagcgcagcttctcttcctcctgctactctggctcccagattccactggagaaatagtgatgacgcagtctccagccaccctgtctgtgtctccaggggacagagccaccctctcctgcagggccagtcagagtattagcggcaacttagcctggtaccagcagaaacctggccagggtcccaggctcctcatccacggtgcatccaccagggccactggaattcccagccaggttcagtggcaggtgggtctggggacagacttcnctctcacatcagcagcctgcagtctgacgtatttgctagtttattactgtacagctagttaataaaacgtggaccgtacgtaggtttcggaccgtagggtaccaagtctgggaacattcgagacgaactggttggcttgcaccaatctgttcttcgaacttcccg

SEQ ID NO: 309972 - DNA, 577 bp, Homo sapiens
  misc_feature: GZ8MTXP01EAHO1.25.64.F09.1.454.CMB.2.raw
tcagactgtacagtcacgaccggtgctcgatttagcgcgtatacaagggggaggaactgctcagttaggacccagacggaaccatggaagccccagcgcagcttctcttcctcctgctactctggctcccagattccactggagaaatagtgatgacgcagtctccagccaccctgtctgtgtctccaggggacagagcccaccctctcctgcagggccagtcagagtattagcggacaacttagcctggtaccagcagaacctggccagggtcccaggcctcctcactccgaggtgccactcccaccgagggcccacgtggaacttccagcctaggttcaggtggctaggtgggtctggggacaggtaacttctctctccacccatcagcagcctgcagtctgtacgttatttgactagtttacttactgtacagacgtaagtaaataaaacgtcggtaccgtaacgttagttttacggaccgtacgggggacctaagcgtaggaactattacgagaacgtaacgtggttcggcttacggccacctaattcgtcgttcttaaccttcgtttccccg

SEQ ID NO: 309973 - DNA, 641 bp, Homo sapiens
  misc_feature: GZ8MTXP01DZUDI.25.64.F09.1.454.CMB.2.raw
  modified_base (622)..(622): a, c, t, g, unknown or other
  misc_feature (622)..(622): n is a, c, g, or t
tcagactgtacagtcacgaccggtgctcgatttagcgcgtatacaagggggaggaactgctcagttaggacccagacggaaccatggaagccccagcgcagcttctcttcctcctgctactctggctcccagattccactggagaaatagtgatgacgcagtctccagccaccctgtctgtgtctccgaggggacaggacgcccaccctctcctgcagggccagtcagagtattagcggcaacttgcctggtaccagcagaactggccagggtcccaggcctcctcactccgacggtgaccacgtcccaaccgacggggccccaaacgttcgggaaaactttccccgaacggtaccccgtaagggtttacccaagggttcggggaccgtaaggggttcgggggtacgtacgggggaacctacggtaaaccctttcgtccttcctaccaacccaatccgaggccagccctgctacgtctagtaacgttagttttgacgttagtttacttacgtgtacagtactaaagttaaataaaacgtggtaccgtaacgtggtttacggacggtacgggacaaggcgtaggaacattacgagaacgtacgtggttcggcttgaactaccnttctgttctcttcgttccc

SEQ ID NO: 309974 - DNA, 584 bp, Homo sapiens
  misc_feature: GZ8MTXP01BPY9A.25.64.F09.1.454.CMB.2.raw
tcagactgtacagtcacgaccggtgctcgatttagcgcgtatacaagggggaggaactgctcagttaggacccagacggaaccatggaagccccagcgcagcttctcttcctcctgctactctggctcccagattccactggagaaatagtgatgacgcagtctccagccaccctgtctgtgtctccaggggacagagccaccctctcctgcagggccagtcagagtattagcggcaacttagcctggtaccagcagaacctggccagggtcccaggctcctcatccacggtgcatcccacgagggccatggaacttccagccaggttcaggtggcaggtgggtctggggactagaacttctctctcacatcagcagcctgcagtctgacgtatttgctagtttattactgtacagacgtaagttaataaaaccgtggtaccgttacgtaggttttacggaccgtaagggggacccaaaggtccgtagggaactacgttacgaacggaacgtaaacgttggttcggttccttacggaaccctaccgtaacttccgttacgtttcccttcgttaacgtttccccg

SEQ ID NO: 309975 - DNA, 544 bp, Homo sapiens
  misc_feature: GZ8MTXP01DT1B5.25.64.F09.1.454.CMB.2.raw
  modified_base (296)..(296): a, c, t, g, unknown or other
  misc_feature (296)..(296): n is a, c, g, or t
  modified_base (368)..(368): a, c, t, g, unknown or other
  misc_feature (368)..(368): n is a, c, g, or t
tcagactgtacagtcacgaccggtgctcgatttagcgcgtatacaagggggaggaactgctcagttaggacccagacggaaccatggaagccccagcgcagcttctcttcctcctgctactctggctcccagattccactggagaaatagtgatgacgcagtctccagccaccctgtctgtgtctccgaggggacagagcccaccctctcctgcagggccagtcagagtattagcggcaacttagcctggtaccagcagaaacctggccagggtcccaggctcctcatccacggtncatcccacgagggccagtggaacttcccagccaggttcaggtggcaggtgggtctggggacagtacttctcnctcacatcagcagcctgctagtctgtacgttatttcgatagtttatactgtacagactaagtaaataaaacgtggtaccgtagttaggtttcgacgacggggtaccaagccgtggaacattcgagaccgtaagtgacggcttacgccactaatcgtcttcttcttaacgttccccg

SEQ ID NO: 309976 - DNA, 520 bp, Homo sapiens
  misc_feature: GZ8MTXP01DT75M.25.64.F09.1.454.CMB.2.raw
  modified_base (515)..(515): a, c, t, g, unknown or other
  misc_feature (515)..(515): n is a, c, g, or t
tcagactgtacagtcacgaccggtgctcgatttagcgcgtatacaagggggaggaactgctcagttaggacccagacggaaccatggaagccccagcgcagcttctcttcctcctgctactctggctcccagattccactggagaaatagtgatgacgcagtctccagccaccctgtctgtgtctccaggggacagagccaccctctcctgcagggccagtcagagtattagcggcaacttagcctggtaccagcagaaacctggccagggtcccaggctcctcatccacggtgcatccaccagggccactggaattccagccaggttcagtggcagtgggtctggggacagaaccttctctctcaccatcagcagctgcagtctgacgtattttgctagtttattactgtcagctaagtaataaaacgtggaccgtacgtagtttggaccgaggggtacaagtctgggaacattcgagacgaacgtgttggcttcgcacaatctgttcttcttnttccc

SEQ ID NO: 309977 - DNA, 584 bp, Homo sapiens
  misc_feature: GZ8MTXP01EWR6R.25.64.F09.1.454.CMB.2.raw
  modified_base (297)..(297): a, c, t, g, unknown or other
  misc_feature (297)..(297): n is a, c, g, or t
  modified_base (379)..(379): a, c, t, g, unknown or other
  misc_feature (379)..(379): n is a, c, g, or t
tcagactgtacagtcacgaccggtgctcgatttagcgcgtatacaagggggaggaactgctcagttaggacccagacggaaccatggaagccccagcgcagcttctcttcctcctgctactctggctcccagattccactggagaaatagtgatgacgcagtctccagccaccctgtctgtgtctccgaggggacagagcccaccctctcctgcgagggccagtcagagtattagcggcaacttagcctggtaccagcagaacctggccagggtcccaggcctcctcactccaggtncactcccacgacgggccacgtggaacttcccgagtcccgaggttcaggtggctaggtcggggtctggggacaggtaacttcnctctcaccatcagcagcctgcagtctgacgttatttcgctagtttatactgtacagtactaagttaaactaaaacgtcggaccgttacgtacggttttacggaccgtagggggtaacccaaggtcgtacgggaactacttacggaacgttacgaaacgtggttagggcttcggcacctaattctcgttcttcttaacgttccccg

SEQ ID NO: 309978 - DNA, 579 bp, Homo sapiens
  misc_feature: GZ8MTXP01EBTHW.25.64.F09.1.454.CMB.2.raw
  modified_base (295)..(295): a, c, t, g, unknown or other
  misc_feature (295)..(295): n is a, c, g, or t
  modified_base (369)..(369): a, c, t, g, unknown or other
  misc_feature (369)..(369): n is a, c, g, or t
tcagactgtacagtcacgaccggtgctcgatttagcgcgtatacaagggggaggaactgctcagttaggacccagacggaaccatggaagccccagcgcagcttctcttcctcctgctactctggctcccagattccactggagaaatagtgatgacgcagtctccagccaccctgtctgtgtctccaggggacagagccaccctctcctgcagggccagtcagagtattagcggcaacttagcctggtaccagcagaaacctggccagggtcccaggctcctcactccacggtncatccacacgggccatggaattccagccaggttcagtggcaggtgggtctgggacagtaccttctctctcaccntccagcagctgcagtctgacgtatttgctagtttattactgtactagtactaagttaataaaaacgtcggtaccgtacgtaggttttacggaccgtaaggggaacctaaggccgtagggaacctagttacgacggttaacgtaaaccgtggttcgggcttcggcctaacctaagttccgttcgttcctttaacgttaaccgttttccccg

SEQ ID NO: 309979 - DNA, 623 bp, Homo sapiens
  misc_feature: GZ8MTXP01A0MLU.25.64.F09.1.454.CMB.2.raw
  modified_base (346)..(346): a, c, t, g, unknown or other
  misc_feature (346)..(346): n is a, c, g, or t
tcagactgtacagtcacgaccggtgctcgatttagcgcgtatacaagggggaggaactgctcagttaggacccagacggaaccatggaagccccagcgcagcttctcttcctcctgctactctggctcccagattccactggagaaatagtgatgacgcagtctccagccaccctgtctgtgtctccgaggggacagagcccacctctcctgcagggccagtcagagtattagcggactaacttagcctggtaccagcagaacctggccaggtccaggctctcactccagtgcactccacgaggccagtggaacttccagccgtaggttcaggtggcaggtggtcnggggacagtaacttctcgtctccacactcagtcacgcctgcacgtctagacgttattttcggacttacgttttataccgttgtaccgtaggacttaagttaaacgttaaaaccgtcgggtaacccgttacgttaacggggtttttccggaacccggtaacgggggttacccaaacgggtcccgttaggggaacctaacgttacgaacggttaaccgtaaacgtggttacggcgttacgtccactaacgttcgtcgttaccttcgttaactttccccg

SEQ ID NO: 309980 - DNA, 515 bp, Homo sapiens
  misc_feature: GZ8MTXP01AKY4U.25.64.F09.1.454.CMB.2.raw
  modified_base (502)..(502): a, c, t, g, unknown or other
  misc_feature (502)..(502): n is a, c, g, or t
tcagactgtacagtcacgaccggtgctcgatttagcgcgtatacaagggggaggaactgctcagttaggacccagacggaaccatggaagccccagcgcagcttctcttcctcctgctactctggctcccagattccactggagaaatagtgatgacgcagtctccagccaccctgtctgtgtctccaggggacagagccaccctctcctgcagggccagtcagagtatagcggcaacttagcctggtaccagcagaacctggccagggtcccaggctcctcactccacggtgcatcccaccgagggccacgtggaacttccagccaggttcaggtggcaggtggggtctggggacagacttcgctctcaccatcagcagcctgcagtctgacgtatttgctagtttattactgtcagcgagcgtagcgtacgtcgcctcgtactacgtttggccgtaggggccgtaaggggtcgacttcagtcgacttggttgctgcaacntcttgtcttctcc

SEQ ID NO: 309981 - DNA, 587 bp, Homo sapiens
  misc_feature: GZ8MTXP01D077V.25.64.F09.1.454.CMB.2.raw
  modified_base (289)..(289): a, c, t, g, unknown or other
  misc_feature (289)..(289): n is a, c, g, or t
  modified_base (563)..(563): a, c, t, g, unknown or other
  misc_feature (563)..(563): n is a, c, g, or t
tcagactgtacagtcacgaccggtgctcgatttagcgcgtatacaagggggaggaactgctcagttaggacccagacggaaccatggaagccccagcgcagcttctcttcctcctgctactctggctcccagattccactggagaaatagtgatgacgcagtctccagccacctgtctgtgtctccgaggggacagacgccacctctcctgcagggccagtcagtagtattagcggactaacttagcctggtaccagacagaaacctggaccagggtcccaggctcctnatccgaggtcacactccacgaggccagtgaactccagtccagttcaggtgctaggtgggtctgggacagtaaccttctctcctacacccatcacgcacgcctgacgtacgtcgtagtacgttattttcgacgttagtttattacctggttacaggtactaaagttaaactaaaaacgtcggtaaccgttacgttacggtttcggaccgtaacggggactaacggtcctggaacctagttaccgaagacgaaacgtgttacggcttacggcaacncttctcttcttcttaacttccccg

SEQ ID NO: 309982 - DNA, 623 bp, Homo sapiens
  misc_feature: GZ8MTXP01AYGT0.25.64.F09.1.454.CMB.2.raw
  modified_base (295)..(295): a, c, t, g, unknown or other
  misc_feature (295)..(295): n is a, c, g, or t
  modified_base (378)..(378): a, c, t, g, unknown or other
  misc_feature (378)..(378): n is a, c, g, or t
tcagactgtacagtcacgaccggtgctcgatttagcgcgtatacaagggggaggaactgctcagttaggacccagacggaaccatggaagccccagcgcagcttctcttcctcctgctactctggctcccagattccactggagaaatagtgatgacgcagtctccagccaccctgtctgtgtctccgaggggacagagccaccctctcctgcagggccagtcagagtattagcggcaacttagcctggtaccagcagaacctggccagggtcccaggctcctcatccgacggtnccactcccaccgaggggccccacgtgggaacttcccgaggcccaggtttccaggtggcaggtgggtctggggacagtacttcnctctcaccatcagcacgctgcagtctgacgtatttgactagtttattctgtctagacgtaagtaaacttaaaacgtcggtaccgttacgttaggtttcggaccggtaacggggtacccgtaaaggtcgttacgggaaccgtaagttaccgaacggttaacgtaaaccgttcgggttcgggttccgttacggaacctacccgtaacgttccttaccggtttccttaaccgttaaccgtttcccccg

SEQ ID NO: 309983 - DNA, 626 bp, Homo sapiens
  misc_feature: GZ8MTXP01BOTUM.25.64.F09.1.454.CMB.2.raw
  modified_base (295)..(295): a, c, t, g, unknown or other
  misc_feature (295)..(295): n is a, c, g, or t
tcagactgtacagtcacgaccggtgctcgatttagcgcgtatacaagggggaggaactgctcagttaggacccagacggaaccatggaagccccagcgcagcttctcttcctcctgctactctggctcccagattccactggagaaatagtgatgacgcagtctccagccaccctgtctgtgtctccgaggggacagagcccaccctctcctgcagggccagtcagagtattagcggcaacttagcctggtaccagcagaacctggccagggtcccaggctcctcatccacggtncatcccacgagggccatggaattccagccaggttcagtcggcaggtgggtctggggactgtaacttctctctcaccatcagcagcctgcagtctgacgtatttgacttagtttattactgtcaggtactaagttaaagtaaaaccgtcgggtaaccgttaaccgttaggtttttacgggacccggtaaggggtaacccgaaaggtccgttaacggggaacctaagttacggaaacggttaaacccggtaaacgttgggttacgggccgttcgaaccctaaacccgttaacgttccgttacgtttacctttaaccgttaacccgtttccccg

SEQ ID NO: 309984 - DNA, 804 bp, Homo sapiens
  misc_feature: GZ8MTXP01B0A8W.25.64.F09.1.454.CMB.2.raw
tcagactgtacagtcacgaccggtgctcgatttagcgcgtatacaagggggaggaactgctcagttaggacccagacggaaccatggaagccccagcgcagcttctcttcctcctgctactctggctcccagattccactggagaaatagtgatgacgcagtctccagccaccctgtctgtgtctccgaggggacagacgcccaccctctcctgcagggccagtcagagtattagcggactaacttagcctggtaccagcagaacctggccagggtcccaggcctcctcactcccgacggtgccactccccgaccgacggggaccccaacgttgggaaactttccccgaaggtccccgtaaaggggtttccaagggttcggggacctaaggggttcggggggttaccttaggggggaaccctagggttaaaccctttccgttaaccctcccgttacccgaaaccctacttacccgaaacggcccgtaacgggccccttgggaccctaacgggttccttacgggtaacccgtttaagttttttcgggtaccctttaaggttttttaacttaacccgttgggttacctaacgggttacctaaagtttaaaacgttaaaaaaccgttccgggttaacccgttaaacgttacgggtttttacgggaaccccggtaagggggtaacccctaaggtcgttacggggaacctacgttacggtaacggaccgtaaacggtcggttacggttccgttacggccctaaccgttaacttccggttacgtttcccttaaccgttcgttttcccccg

SEQ ID NO: 309985 - DNA, 593 bp, Homo sapiens
  misc_feature: GZ8MTXP01ARDRB.25.64.F09.1.454.CMB.2.raw
  modified_base (383)..(383): a, c, t, g, unknown or other
  misc_feature (383)..(383): n is a, c, g, or t
tcagactgtacagtcacgaccggtgctcgatttagcgcgtatacaagggggaggaactgctcagttaggacccagacggaaccatggaagccccagcgcagcttctcttcctcctgctactctggctcccagattccactggagaaatagtgatgacgcagtctccagccaccctgtctgtgtctccgaggggacagagccacctctcctgcagggccagtcagagtattagcgctaacttgcctgaccagcagaaacctggccagggtcccaggcctccgtcactccgaggtgccatcccaccgagggccagtggaacttcccgagccgtaggttcagtggctaggtcggggtctggggacaggtaacttctctctaccacntcagcacgcctgacgtagtctagtacgttagttttcgacttacgtttattacgtgtacagtactaaggttaaataaaacgtcggtaccgtagtagtttcggaccgtaagggggtaccaaaggtcgtagggaactacgttacgaaggacgaaacgttgggttacggcgttacgaacctacctctcggtcttaccttcgttaactttccccg

SEQ ID NO: 309986 - DNA, 515 bp, Homo sapiens
  misc_feature: GZ8MTXP01B93EU.25.64.F09.1.454.CMB.2.raw
  modified_base (360)..(360): a, c, t, g, unknown or other
  misc_feature (360)..(360): n is a, c, g, or t
  modified_base (503)..(503): a, c, t, g, unknown or other
  misc_feature (503)..(503): n is a, c, g, or t
tcagactgtacagtcacgaccggtgctcgatttagcgcgtatacaagggggaggaactgctcagttaggacccagacggaaccatggaagccccagcgcagcttctcttcctcctgctactctggctcccagattccactggagaaatagtgatgacgcagtctccagccaccctgtctgtgtctccaggggacagagccaccctctcctgcagggccagtcagagtattagcggcaacttagcctggtaccagcagaaacctggccagggtcccaggctcctcatccacggtgcatccatcagggccactggaattccagccaggttcagtggccaggtgggtctggggacagacttcnctctcaccatcagcagcctgcagtctgtacgtatttgctagtttattactgtcaggctaagttaataaaacgtggtaccgtacgtaggttttacggccgtaggggaccaagcgtggacatcagacgacttgttggctgcaacntcttgtcttctc

SEQ ID NO: 309987 - DNA, 610 bp, Homo sapiens
  misc_feature: GZ8MTXP01A9CM5.25.64.F09.1.454.CMB.2.raw
  modified_base (288)..(288): a, c, t, g, unknown or other
  misc_feature (288)..(288): n is a, c, g, or t
  modified_base (372)..(372): a, c, t, g, unknown or other
  misc_feature (372)..(372): n is a, c, g, or t
  modified_base (381)..(381): a, c, t, g, unknown or other
  misc_feature (381)..(381): n is a, c, g, or t
  modified_base (402)..(402): a, c, t, g, unknown or other
  misc_feature (402)..(402): n is a, c, g, or t
  modified_base (588)..(588): a, c, t, g, unknown or other
  misc_feature (588)..(588): n is a, c, g, or t
tcagactgtacagtcacgaccggtgctcgatttagcgcgtatacaaggggggaggaactgctcagttaggacccagacggaaccatggaagccccagcgcagcttctcttcctcctgctactctggctcccagattccatggagaaatagtgatgacgcagtctccagccaccctgtctgtgtctccgaggggacagacgcccaccctctcctgcagggccagtcagagtatagcggacaacttgcctaggtaccagcagaaacctggccagggtcccaggctccctnactcccgaggtgcatcccaccgaggggcccacgtgggaaacttcccgagcctaggtttcaggtcgcgaggtgggtctggggacngtaacttcnctctcacatcagcagcctgcngtctgacgtatttgactagtttactacttggtacacgtagtaagtaaacgtaaaacgtcggtaccgttaacgttaggttttacggacccggtaagggggtaccctaaagggtccgttagggaacctaagttacgacggttaaccgtaaccgtgggttacgggcttacggcctaacgtcttccgttnttcctttccgaactttcccccg

SEQ ID NO: 309988 - DNA, 609 bp, Homo sapiens
  misc_feature: GZ8MTXP01BX54W.25.64.F09.1.454.CMB.2.raw
  modified_base (294)..(294): a, c, t, g, unknown or other
  misc_feature (294)..(294): n is a, c, g, or t
  modified_base (345)..(345): a, c, t, g, unknown or other
  misc_feature (345)..(345): n is a, c, g, or t
  modified_base (354)..(354): a, c, t, g, unknown or other
  misc_feature (354)..(354): n is a, c, g, or t
tcagactgtacagtcacgaccggtgctcgatttagcgcgtatacaagggggaggaactgctcagttaggacccagacggaaccatggaagccccagcgcagcttctcttcctcctgctactctggctcccagattccactggagaaatagtgatgacgcagtctccagccaccctgtctgtgtctccgaggggacagacgcccaccctctcctgcagggccagtcagagtatagcggcaacttgcctggtaccagcagaacctggccagggtcccaggcctcctcatccaggtncatcccacagggccagtgatccagccaggtcagtgcaggtgggctgggacngtaacttcntctcaccatcagcagcctgctagtctagacgttattttcgacttagtttattactgtacagactaaagtaaacttaaaacgtcggtaccgttaacgttacggttttacgggaaccggtaacgggggtaacccgtaaaggccggttagggaaaccctaagttaccgtaaaggaaccggtaaacgttcggttacgggttccttacggaaccctaacctaacgttcttacggttccttaaccgttaacgtttcccccg

SEQ ID NO: 309989 - DNA, 602 bp, Homo sapiens
  misc_feature: GZ8MTXP01BJPM1.25.64.F09.1.454.CMB.2.raw
  modified_base (294)..(294): a, c, t, g, unknown or other
  misc_feature (294)..(294): n is a, c, g, or t
  modified_base (540)..(540): a, c, t, g, unknown or other
  misc_feature (540)..(540): n is a, c, g, or t
tcagactgtacagtcacgaccggtgctcgatttagcgcgtatacaagggggaggaactgctcagttaggacccagacggaaccatggaagccccagcgcagcttctcttcctcctgctactctggctcccagattccactggagaaatagtgatgacgcagtctccagccaccctgtctgtgtctccgaggggacagacgcccacctctcctgcagggccagtcagagtatagcgcaacttgcctggtaccagcaagaaacctggccagggtcccaggcctctcatccgaggtncactccaccgagggccagtggaacttcccgagtcctaggttcaggtcggacgtaggtggggtctaggggaactcggtaacctttcgtcctctacccaacctatccgagcctagcagtgacgagttcgtagtaacgttagttttgacttagtttacttacgtgtacaggtactaaaggttaaactaaaacgtcggtaccgtacgttaggtttacggaccgtaggggtaacctaggtcgtcgggaacngtacgaggtaacgtaacgttggcgcgtcgactaacgtacttcgttcttaaccgttcgtcccg

SEQ ID NO: 309990 - DNA, 624 bp, Homo sapiens
  misc_feature: GZ8MTXP01CMELJ.25.64.F09.1.454.CMB.2.raw
tcagactgtacagtcacgaccggtgctcgatttagcgcgtatacaagggggaggaactgctcagttaggacccagacggaaccatggaagccccagcgcagcttctcttcctcctgctactctggctcccagattccactggagaaatagtgatgacgcagtctccagccaccctgtctgtgtctccaggggacagagccaccctctcctgcagggccagtcagagtattagcggcaacttgcctggtaccagcagaaacctggccagggtcccaggctcctcatccgacggtgccaactcccaccgagggcccaacgtggaaactttcccgaagcccgtagggtttccaaggttggccgtaaggttgggggtacttgggggaacctaggtaacctttcctcttctacaacctatccagcacgcctgcagtctagtactagttttgctagtttattactgttacgagtactaagttaaactaaaacgtcggaccgttaagtacggttttcggaccgtaaggggaacccaagtccgtaggaaccaagttcgaacgacgtaaaccgtggttcgggcttacgaaccacctaacttcgttcgttacctttccgttaacgttttccccg

SEQ ID NO: 309991 - DNA, 636 bp, Homo sapiens
  misc_feature: GZ8MTXP01AST9I.25.64.F09.1.454.CMB.2.raw
tcagactgtacagtcacgaccggtgctcgatttagcgcgtatacaagggggaggaactgctcagttaggacccagacggaaccatggaagccccagcgcagcttctcttcctcctgctactctggctcccagattccactggagaaatagtgatgacgcagtctccagcccaccctgtctgtgtctccgaggggacagacgcccaccctctcctgcagggccagtcagagtatagcgacaacttgcctggaccagcagaacctggccagggtcccaggcctcctcatccaggtgcactcccacgacgggccaacgtggaacttccgagtcccgtaggttcaggtggactagggtcgggtctggggaactcggtaacctttcgtcctctccaccatcacgcacgctgcctagtcgtacgtacgttagttttcgtcttagtttacttacttcggtactagtacgtaagttaaacgttaaaacgttcggtacccgttaagttacggttttacggaaccggtacggggtaaccaaggtccgtaagggaactaacgttacgaacgaacggtaaacgtgggttcggcgttacggaaccctaccgtaacgttccttcggttaccttccgttaactttcccccg

SEQ ID NO: 309992 - DNA, 622 bp, Homo sapiens
  misc_feature: GZ8MTXP01A8FN8.25.64.F09.1.454.CMB.2.raw
  modified_base (214)..(214): a, c, t, g, unknown or other
  misc_feature (214)..(214): n is a, c, g, or t
  modified_base (299)..(299): a, c, t, g, unknown or other
  misc_feature (299)..(299): n is a, c, g, or t
  modified_base (572)..(572): a, c, t, g, unknown or other
  misc_feature (572)..(572): n is a, c, g, or t
  modified_base (595)..(595): a, c, t, g, unknown or other
  misc_feature (595)..(595): n is a, c, g, or t
tcagactgtacagtcacgaccggtgctcgatttagcgcgtatacaagggggaggaactgctcagttaggacccagacggaaccatggaagccccagcgcagcttctcttcctcctgctactctggctcccagattccactggagaaatagtgatgacgcagtcctccagccaccctgtctgtgtctccgaggggacagacgccacccctctccngcagggccagtcagagtatagcgacaacttagcctggtaccagcagaacctggccagggtcccaggcctcctcgatccgacggtnccactcccaaccgacgggccacgtacggtaacttcccgacggtacccgaggtttaccacggtggaccgtagggttcggggtcgtacgggggactacggtaccctttctccgttcacccgactactcaagccacgccgtcgcgtacgtcgtacgtacgttagtttacgttaccgtttagtttacttacgtactacgtagtaacggtaaacgtaaacgtaacgtacgtacgttacgttcggttacgggaccggacggtacgacgtcgaggaacanacgacgacgtagtacgcggttcncaacactctctcttctcttcgttcccg

SEQ ID NO: 309993 - DNA, 743 bp, Homo sapiens
  misc_feature: GZ8MTXP01CZOQ9.25.64.F09.1.454.CMB.2.raw
tcagactgtacagtcacgaccggtgctcgatttagcgcgtatacaagggggaggaactgctcagttaggacccagacggaaccatggaagccccagcgcagcttctcttcctcctgctactctggctcccagattccactggaagaaatagtgatgacgcagtctccagccacctgtctgtgtctccgaggggacagacgcccaccctctcctgcgagggccagtcagagtatagcgactaacttgcctggtaccagacaacgaaaccgtggccgagggtcccaggcctcctcactcccgaaggtcgacactccgaaccgacgggacctacgtacggtaacttcccgagccgtaggttccaaggtcggacgtagggtcgggtacgtagggacctacgtaaccgtttctcctactacccaacctactaccgaacgtcacgtccgtgtaccgtacgttcgtacggttaaccggtttaagtttttccggtagttttaaacgtttacgttacgtacgtaacgtaacgttaaacgggtaaaacgttaaaacggttaaccggtaccggttaaacgtttacgggtttacgggttaccgggaaaccgggaacggtaacgtacggtaccgtaagtaacgtacgttaacggtaacgttaaacgggtcgtcgggttaccggttcttaacccggtaaccgttaaccgttcgtttaaccgttcgttttacccctaacgtttccccgtttaaccccg

SEQ ID NO: 309994 - DNA, 639 bp, Homo sapiens
  misc_feature: GZ8MTXP01CEFJW.25.64.F09.1.454.CMB.2.raw
  modified_base (292)..(292): a, c, t, g, unknown or other
  misc_feature (292)..(292): n is a, c, g, or t
  modified_base (373)..(373): a, c, t, g, unknown or other
  misc_feature (373)..(373): n is a, c, g, or t
tcagactgtacagtcacgaccggtgctcgatttagcgcgtatacaaggggggaggaactgctcagttaggacccagacggaaccatggaagccccagcgcagcttctcttcctcctgctactctggctcccagattccactggagaaatagtgatgacgcagtctccagccaccctgtctgtgtctccgaggggacagacgcccaccctctcctgcgagggccagtcagagtatagcggactaacttgcctggtaccagcaagaaccgtggccacgggtcccaggtcctccncactccgaggtgcactccccgacgacgggcctacgtaggaacttcccgagccgtaggttcaggtgcgtaggttgggtacgngggacacggtaacttctcctctaccacctagtccgagcacgcctgctagtcgtacgtacgttattttcgtacttacgtttattaacgttgtacgtaagtacgttaaacgttaaacgttaaaaccgtcgggtaacccgttaacgtacggttttacggaccggtaacgggaaccgaagtccgtaggaactagttacgaacgttaacgtaacgttcggttacggttcttacgccgtaactcgttctagtttcctcgttccgtttccccg

SEQ ID NO: 309995 - DNA, 530 bp, Homo sapiens
  misc_feature: GZ8MTXP01E49RH.25.64.F09.1.454.CMB.2.raw
  modified_base (295)..(295): a, c, t, g, unknown or other
  misc_feature (295)..(295): n is a, c, g, or t
  modified_base (342)..(342): a, c, t, g, unknown or other
  misc_feature (342)..(342): n is a, c, g, or t
  modified_base (348)..(348): a, c, t, g, unknown or other
  misc_feature (348)..(348): n is a, c, g, or t
  modified_base (356)..(356): a, c, t, g, unknown or other
  misc_feature (356)..(356): n is a, c, g, or t
  modified_base (372)..(372): a, c, t, g, unknown or other
  misc_feature (372)..(372): n is a, c, g, or t
tcagactgtacagtcacgaccggtgctcgatttagcgcgtatacaagggggaggaactgctcagttaggacccagacggaaccatggaagccccagcgcagcttctcttcctcctgctactctggctcccagattccactggagaaatagtgatgacgcagtctccagccaccctgtctgtgtctccaggggacagagccaccctctcctgcagggccagtcagagtattagcggcaacttagcctggtaccagcagaaacctggcccagggtcccaggctcctcatccacggtncatccacagggcatggaatccagccaggttcagtggcaggtgggtcngggacngaacttcnctctcaccatcagcancctgcagtctgacgtatttgctagtttattactgtcagcaagtaataaaactggaccgtactaggttttacggcgagggggaacccaagccgtggaacattcaacgttacgaaacgtggttagcttcgcaccctaatccttgttctttcaactttccc

SEQ ID NO: 309996 - DNA, 510 bp, Homo sapiens
  misc_feature: GZ8MTXP01BSJE6.25.64.F09.1.454.CMB.2.raw
  modified_base (237)..(237): a, c, t, g, unknown or other
  misc_feature (237)..(237): n is a, c, g, or t
  modified_base (282)..(282): a, c, t, g, unknown or other
  misc_feature (282)..(282): n is a, c, g, or t
  modified_base (291)..(291): a, c, t, g, unknown or other
  misc_feature (291)..(291): n is a, c, g, or t
  modified_base (334)..(334): a, c, t, g, unknown or other
  misc_feature (334)..(334): n is a, c, g, or t
  modified_base (348)..(348): a, c, t, g, unknown or other
  misc_feature (348)..(348): n is a, c, g, or t
  modified_base (461)..(461): a, c, t, g, unknown or other
  misc_feature (461)..(461): n is a, c, g, or t
  modified_base (483)..(483): a, c, t, g, unknown or other
  misc_feature (483)..(483): n is a, c, g, or t
  modified_base (487)..(487): a, c, t, g, unknown or other
  misc_feature (487)..(487): n is a, c, g, or t
tcagactgtacagtcacgaccggtgctcgatttagcgcgtatacaagggggaggaactgctcagttaggacccagacggaaccatggaagccccagcgcagcttctcttcctcctgctactctggctcccagattccactggagaaatagtgatgacgcagtctccagccaccctgtctgtgtctccgaggggacagagccaccctctcctgcagggccagtcagagtattagcggnaacttagcctggaccagcagaacctggccagggtcccaggctctnatccaggtncatccacagggccatggaatccagccaggtcagtgcagtggtntgggacagacttcnctctacgacatccagcacgcctgcagtctgtacgtatttcgctagtttattactgtcagcagtaataaaactggtactatggtttgaccgaggggtaccaaggcctgggaacnttcagacgaacgtgttggttcncgcncaactctgttcttcttcgttccc

SEQ ID NO: 309997 - DNA, 567 bp, Homo sapiens
  misc_feature: GZ8MTXP01AH5DA.25.64.F09.1.454.CMB.2.raw
  modified_base (298)..(298): a, c, t, g, unknown or other
  misc_feature (298)..(298): n is a, c, g, or t
  modified_base (355)..(355): a, c, t, g, unknown or other
  misc_feature (355)..(355): n is a, c, g, or t
tcagactgtacagtcacgaccggtgctcgatttagcgcgtatacaagggggaggaactgctcagttaggacccagacggaaccatggaagccccagcgctgcttctcttcctcctgctactctggctcccagattccactggagaaatagtgatgacgcagtctccagccaccctgtctgtgtctccgaggggacagacgcccaccctctcctgcagggccagtcagagtatagcgacaacttagcctggtaccagcagaacctggccagggtcccaggctccgtcactcccgaggtncactcccacgacggccagtggaactccgagtccgtaggttcaggtggcaggtcggtntgggacagtacttctctctcaccatcagctagcctgactgtctgtactagtttcgacttagtttattactggtacagtactaagtaaacgttaaaacgtcggtaccgttagttacggtttcggaaccgtaggggtaaccaaggtcgtagggaacctagttacgacgacgtaacgtggttacggcttgccactgtctcttcttcgcgttcccg

SEQ ID NO: 309998 - DNA, 790 bp, Homo sapiens
  misc_feature: GZ8MTXP01BYNGE.25.64.F09.1.454.CMB.2.raw
  modified_base (314)..(314): a, c, t, g, unknown or other
  misc_feature (314)..(314): n is a, c, g, or t
tcagactgtacagtcacgaccggtgctcgatttagcgcgtatacaagggggaggaactgctcagttaggacccagacggaaccatggaagccccagcgcagcttctcttcctcctgctactctggctcccagattccatggagaaatagtgatgacgcagtctccagccaccctgtctgtgtctccgaggggacagacgcccacctctcctgcagggccagtcagagttatagcggactaacgttagcctagggtaaccagacaacgaaaccgtggacccgacgggtcccaggtcctcctcactccgacggtcncactcccacgcggccacgtacggacttcccgaacggtcctaggtttcagggtcggacgtacgggttcgggggtacgtagggggtaactacggtaaccctttcgtccttacccgtaccgtaaacccgtaattccccggaggtacccgtaaacggttccccgttaggtacccgtacggttcccgttaggttaaccggtttaatttttcgggacttttaacggttttaacttaccgttacgttaaccgtaacggtaacggtaaaacggtttaaaacgttaaaaaaccggttcgggttaacccgttaacggtttaaacggggtttccggggaaaccggttaaaccggggggaaaccctaaacggggttccgtaacggggtaaactacgttaaccggaaacggttaaacggtaaacccgttggttccggttcgttacgtaacctacgtaacttcgtaccgttcttaaccgttctttccccg

SEQ ID NO: 309999 - DNA, 718 bp, Homo sapiens
  misc_feature: GZ8MTXP01EQDAD.25.64.F09.1.454.CMB.2.raw
tcagactgtacagtcacgaccggtgctcgatttagcgcgtatacaagggggaggaactgctcagttaggacccagacggaaccatggaagccccagcgcagcttctcttcctcctgctactctggctcccagattccactggagaaatagtgatgacgcagtctccagccaccctgtctgtgtctccgaggggacagacgcccaccctctcctgcagggccagtcagtagtattagcggactaacgttagccgtggtaccaggaccaaggaaaccctgggcccaacggggtccccaggtcctccctcaactcccgagggtcaccactcccaaccgacggggcccaacgtggaacttcccgaagccgtaggttcaaggtcggacgtagggttcggggtctagggggaacacggttaacctttcgtctacctaccgaacccctatccgaggccgtaacgccctagccgtaacgttcgttagtaaccgtttagttttacgtaccgtttaagttttacgttacccgtaggttactaacggtacgtaaagttaaacgttaaaaacgttcgggtacccgttaacgttacggttttacggaccggtaacggggtaaccgaacggtccgtaggaactagttaccgaagaaaccgtacgtcgggttacggttcttacggaacctaaccgtaacgtttcgttcttaccttcgttaacctttaaccccg

SEQ ID NO: 310000 - DNA, 587 bp, Homo sapiens
  misc_feature: GZ8MTXP01ESVMP.25.64.F09.1.454.CMB.2.raw
  modified_base (245)..(245): a, c, t, g, unknown or other
  misc_feature (245)..(245): n is a, c, g, or t
  modified_base (570)..(570): a, c, t, g, unknown or other
  misc_feature (570)..(570): n is a, c, g, or t
  modified_base (581)..(581): a, c, t, g, unknown or other
  misc_feature (581)..(581): n is a, c, g, or t
tcagactgtacagtcacgaccggtgctcgatttagcgcgtatacaagggggaggaactgctcagttaggacccagacggaaccatggaagccccagcgcagcttctcttcctcctgctactctggctcccagattccactggagaaatagtgatgacgcagtctccagccaccctgtctgtgtctccaggggacagagccaccctctcctgcagggccagtcagagtattagcgcaacttagccnggtaccagcaagaaacgtcggccgacgggtcccaggctcctacatcccacggtgcactcccaccgagggccactggaacttccagccgtaggttcaggtggacacgggttcgggggtctagggggacctaggtaacctttcctcgttacctccgaaaccctagtcacggcacgacctgcagtctagacgtattttgctagtttatactgtacagtactaagttaaataaaactcggtaccgtacgttaggtttacgggccgaagggggtacccaagtctggaactattacgaagaacgaacttggacgttcttcgaacaaccgtntcgtcttctcncgtccg

SEQ ID NO: 310001 - DNA, 772 bp, Homo sapiens
  misc_feature: GZ8MTXP01AU4RR.25.64.F09.1.454.CMB.2.raw
tcagactgtacagtcacgaccggtgctcgatttagcgcgtatacaaggggggaggaactgctcagttaggacccagacggaaccatggaagcccagcgcagcttctcttcctcctgctactctggctcccagattccactggagaaatagtgatgacgcagtctccagccaccctgtctgtgtctccgaggggacagacgcccaccctctcctgcgacgggccagtcagagtattaggcggactaacgttcgcctgggtaacccaggaccaacggaaaccgtggacccgacggggtcccaggtcctaccctacacgtccccgaggtcgacctacgtaccccgacggacgggggacccctaacggtacgggtaaactttcccgaaacggtcccggttaaagggtttccgaaacgggttcggggacctaacgggggtttcggggggtacgtacggggggacctaacggttcccgtttacctccgttacctaccccaaacctaattccgaaacgggccctaacggtccccgttggacctaacggtttccgttacggtaacgttttagttttcggtactttaaggttttactaccgttaggtactagtaacggtaagtaaacgttaaaacgtcggtacgtacgttacggtttacggccggaaacgggtaccctaaggtccgtaaggaactaacgttacgaaacggttaccgaaacggttgacggttccgttagaacccgtactaacttccttacgttaccttaacgttcttccccg

SEQ ID NO: 310002 - DNA, 500 bp, Homo sapiens
  misc_feature: GZ8MTXP02JQ4RA.25.64.F09.1.454.CMB.2.raw
  modified_base (205)..(205): a, c, t, g, unknown or other
  misc_feature (205)..(205): n is a, c, g, or t
  modified_base (355)..(355): a, c, t, g, unknown or other
  misc_feature (355)..(355): n is a, c, g, or t
tcagactgtacagtcacgaccggtgctcgatttagcgcgtatacaaggggaggaactgctcagttaggacccagacggaaccatggaagccccagcgcagcttctcttcctcctgctactctggctcccagattccactggagaaatagtgatgacgcagtctccagccaccctgtctgtgtctccaggggacagagccaccctntcctgcagggccagtcagagtattagcggcaacttagcctggtaccagcagaaacctggccagggtcccaggctcctcatccacggtgcatccaccaggccactggaattccagccaggttcagtggcagtgggtctgggacagacttcnctctcaccatcagcagcctgcagtctgacgtatttgctagttattactgttcagcagtataaaactggacgtacagtttaggactaggggaccaagctaggacatcagacgtaacgtgtcgctgcaccatctgtcttcactttcc

SEQ ID NO: 310003 - DNA, 536 bp, Homo sapiens
  misc_feature: GZ8MTXP02HR71C.25.64.F09.1.454.CMB.2.raw
  modified_base (292)..(292): a, c, t, g, unknown or other
  misc_feature (292)..(292): n is a, c, g, or t
  modified_base (364)..(364): a, c, t, g, unknown or other
  misc_feature (364)..(364): n is a, c, g, or t
  modified_base (403)..(403): a, c, t, g, unknown or other
  misc_feature (403)..(403): n is a, c, g, or t
tcagactgtacagtcacgaccggtgctcgatttagcgcgtatacaagggggaggaactgctcagttaggacccagacggaaccatggaagccccagcgcagcttctcttcctcctgctactctggctcccagattccactggagaaatagtgatgacgcagtctccagccaccctgtctgtgtctccgaggggacagagccaccctctcctgcagggccagtcagagtattagcggcaacttagcctggtaccagcagaacctggccaggtcccaggctcctcatccaggtncatcccacgagggcccacgtggaacttccagcctaggttcagtggcaggtgggtctggggacaggacgttcncttctcaccatccaaggcagtctggacgcctagaagttnttttgcttagtttattactgtcagtcagcgtagctagttcgaccgtcgggtatggtttcggaccgaggggaccaaggcgtaggagactacgaaacgtactggtcgctgacacgtactctcgttctttactacg

SEQ ID NO: 310004 - DNA, 503 bp, Homo sapiens
  misc_feature: GZ8MTXP02IS8OY.25.64.F09.1.454.CMB.2.raw
  modified_base (355)..(355): a, c, t, g, unknown or other
  misc_feature (355)..(355): n is a, c, g, or t
tcagactgtacagtcacgaccggtgctcgatttagcgcgtatacaagggggaggaactgctcagttaggacccagacggaaccatggaagccccagcgcagcttctcttcctcctgctactctggctcccagattccactggagaaatagtgatgacgcagtctccagccaccctgtctgtgtctccaggggacagagccacctctcctgcagggccagtcagagtattagcggcaacttagcctggtaccagcagaaacctggccagggtcccaggctcctcatccacggtgcatccaccagggccactggaattccagccaggttcagtggcagtggtctgggacagacttcnctctcaccatcagcagcatgcagtctgactatttgctagtttattactgttcagctagtaataaaactggacgtacgtagttttacggctaggggaccaagcgtaggacatcagtacgaacgtgtagcgtgcacactctctcttctac

SEQ ID NO: 310005 - DNA, 513 bp, Homo sapiens
  misc_feature: GZ8MTXP02I106X.25.64.F09.1.454.CMB.2.raw
tcagactgtacagtcacgaccggtgctcgatttagcgcgtatacaagggggaggaactgctcagttaggacccagacggaaccatggaagccccagcgcagcttctcttcctcctgctactctggctcccagattccactggagaaatagtgatgacgcagtctccagccaccctgtctgtgtctccaggggacagagccaccctctcctgcagggccagtcagagtattagcggcaacttagcctggtaccagcagaaacctggccagggtcccaggctcctcatccacggtgcatccaccagggccactggaattcccagccaggttcagtggcagtgggtctggggacagacttctctctcaccatcagcagcctgcagtctgacgtattttgctagtttattactgtacagtcagtataaaactggtaccgtactagtttggccgtaggggaccaagctaggacagtacagacgaactgtacgctgcgacactctgtcttcactttccc

SEQ ID NO: 310006 - DNA, 523 bp, Homo sapiens
  misc_feature: GZ8MTXP02INAN4.25.64.F09.1.454.CMB.2.raw
  modified_base (291)..(291): a, c, t, g, unknown or other
  misc_feature (291)..(291): n is a, c, g, or t
tcagactgtacagtcacgaccggtgctcgatttagcgcgtatacaagggggaggaactgctcagttaggacccagacggaaccatggaagccccagcgcagcttctcttcctcctgctactctggctcccagattccactggagaaatagtgatgacgcagtctccagccaccctgtctgtgtctccaggggacagagccacctctcctgcagggccagtcagagtattagcggcaacttgcctggtaccagcagaaacctggccaggtcccaggctcctcatccacggtncatccaccagggcccatggaacttccagccaggttcagtggcagtgggtctgggacagtacttctctctcaccatcagcagcctgctagtctgacgtattttcgactagtttattactgtacagtcaagtataaaactggaccgtactagtttggccgtaggggaccaaggctaggactatacacgacgaacgtgtacggctgaaccacactcgtgtaccttctacttcccg

SEQ ID NO: 310007 - DNA, 537 bp, Homo sapiens
  misc_feature: GZ8MTXP02HC5AC.25.64.F09.1.454.CMB.2.raw
  modified_base (431)..(431): a, c, t, g, unknown or other
  misc_feature (431)..(431): n is a, c, g, or t
  modified_base (485)..(485): a, c, t, g, unknown or other
  misc_feature (485)..(485): n is a, c, g, or t
tcagactgtacagtcacgaccggtgctcgatttagcgcgtatacaagggggaggaactgctcagttaggacccagacggaaccatggaagccccagcgcagcttctcttcctcctgctactctggctcccagattccactggagaaatagtgatgacgcagtctccagccaccctgtctgtgtctccaggggacagagccaccctctcctgcagggccagtcagagtattagcggcaacttagcctggaccagcagaaaccacggccgacggtccgacgcgcctcatcacggtgcatccaccacggccgacctggaattcccacgccacggttcgacgtaggcacggtggggtcgtgggacgagacgttctctctcaccaatcacgcacgcctgcagtcctgacgtatttgtctagtttattactgtcagnaagtataaaaatcggcgtacaagttttggccgaggggaccgaagctaggacaancagaacgtaaactgtcgggctgaacgacctaactctcgttctcctattcccc

SEQ ID NO: 310008 - DNA, 531 bp, Homo sapiens
  misc_feature: GZ8MTXP02G8LI9.25.64.F09.1.454.CMB.2.raw
tcagactgtacagtcacgaccggtgctcgatttagcgcgtatacaagggggaggaactgctcagttaggacccagacggaaccatggaagccccagcgcagcttctcttcctcctgctactctggctcccagattccactggagaaatagtgatgacgcagtctccagccaccctgtctgtgtctccaggggacagagccaccctctcctgcagggccagtcagagtattagcggcaacttagcctggtaccagcagaaacctggccaggtcccaggctcctcatccacggtgcatccaccagggccactggaattccagccaggttcagtggcaggtgggtctggggacagacttctctctcaccatcagcagcctgcagtctgacgtatttgctagtttattactgtacagtctaagttaataaaactggtaccgttacgtagtttacggaccgtaaggggaccaaggtcgtaggacatacgaacgacgaacgtgtacggctagcacactctgtccttctactttcccg

SEQ ID NO: 310009 - DNA, 519 bp, Homo sapiens
  misc_feature: GZ8MTXP02IGFVG.25.64.F09.1.454.CMB.2.raw
  modified_base (289)..(289): a, c, t, g, unknown or other
  misc_feature (289)..(289): n is a, c, g, or t
  modified_base (471)..(471): a, c, t, g, unknown or other
  misc_feature (471)..(471): n is a, c, g, or t
  modified_base (490)..(490): a, c, t, g, unknown or other
  misc_feature (490)..(490): n is a, c, g, or t
tcagactgtacagtcacgaccggtgctcgatttagcgcgtatacaagggggaggaactgctcagttaggacccagacggaaccatggaagccccagcgcagcttctcttcctcctgctactctggctcccagattccactggagaaatagtgatgacgcagtctccagccacctgtctgtgtctccaggggacagagccaccctctcctgcagggccagtcagagtatagcggcaacttagcctggtaccagcagaacctggccagggtccaggctcctcatccaggtncatccaccgagggccatggaattccagccaggttcagtggcaggtggtctgggacagacttctctctcaccatccagcagcctgccagtctagacgtattttgacttagtttatactgtacagtacgtaattaaacgtaacgtcgtacttagttaggttcgacggtacgagagcgagactanagacgaacgagtcgcgtcncgaacactctcgtacttctactcttcccg

SEQ ID NO: 310010 - DNA, 581 bp, Homo sapiens
  misc_feature: GZ8MTXP02GB1AP.25.64.F09.1.454.CMB.2.raw
tcagactgtacagtcacgaccggtgctcgatttagcgcgtatacaagggggaggaactgctcagttaggacccagacggaaccatggaagccccagcgcagcttctcttcctcctgctactctggctcccagattccactggagaaatagtgatgacgcagtctccagccaccctgtctgtgtctccaggggacagagccaccctctcctgcagggccagtcagagtattagcggcaacttagcctggtaccagcagaaacctggccagggtcccaggctcctcatccacggtgcatcccaccagggccactggaacttccagccaggttcagtggcagtgggtctgggacagacttctctctcacatcagcagcctgcagtctgactatttgctagtttatactgtacagactaagttaaataaaaacgtcgggtaccgttacgtaggttttacggaccgtaagggggaccaaaggtccgtagggaactacgtacgaacggaacgtaaacgtgggttacgggacttacggaacccgtaacccgtaagttcctcggtttacctttccgtaactttcccccg

SEQ ID NO: 310011 - DNA, 526 bp, Homo sapiens
  misc_feature: GZ8MTXP02FW4L8.25.64.F09.1.454.CMB.2.raw
  modified_base (294)..(294): a, c, t, g, unknown or other
  misc_feature (294)..(294): n is a, c, g, or t
  modified_base (341)..(341): a, c, t, g, unknown or other
  misc_feature (341)..(341): n is a, c, g, or t
  modified_base (347)..(347): a, c, t, g, unknown or other
  misc_feature (347)..(347): n is a, c, g, or t
  modified_base (379)..(379): a, c, t, g, unknown or other
  misc_feature (379)..(379): n is a, c, g, or t
tcagactgtacagtcacgaccggtgctcgatttagcgcgtatacaagggggaggaactgctcagttaggacccagacggaaccatggaagccccagcgcagcttctcttcctcctgctactctggctcccagattccactggagaaatagtgatgacgcagtctccagccaccctgtctgtgtctccaggggacagacgccaccctctcctgcagggccagtcagagtattagcggcaacttagcctggtaccagcagaaacctggccaggtcccaggctcctcatccacggtncatccacagggccatggaacttccagccaggttcagtgcagtggtcngggacngtacttctctctcacatcagcagctgcagtcngtacgttattgcttagtttacttactgtacagactaagtaaataaaacgtggtaccgttacgtaggtttcgaccggtagggaactaagcgtaggacatacgaacgacgtaacgtggtacgctagccactatctctcttcactttccc

SEQ ID NO: 310012 - DNA, 519 bp, Homo sapiens
  misc_feature: GZ8MTXP02JHX3T.25.64.F09.1.454.CMB.2.raw
  modified_base (352)..(352): a, c, t, g, unknown or other
  misc_feature (352)..(352): n is a, c, g, or t
tcagactgtacagtcacgaccggtgctcgatttagcgcgtatacaagggggaggaactgctcagttaggacccagacggaaccatggaagccccagcgcagcttctcttcctcctgctactctggctcccagattccactggagaaatagtgatgacgcagtctccagccaccctgtctgtgtctccaggggacagagccaccctctcctgcagggccagtcagagtattagcggcaacttagcctggtaccagcagaaacctggccagggtcccaggctcctcatccacggtgcatcccaccagggccactggaattcccagccaggttcagtggcagtgggtctgggacngacttctctctcaccatcagcagcctgcagtctgacgtatttgctagtttattactgtcagctagtaataaaacgtggtaccgtacgtagtttcggcctagggggaccaaggctaggactagtacacgacgaactcgtaggctgcaccattctgtcttcactttccc

SEQ ID NO: 310013 - DNA, 629 bp, Homo sapiens
  misc_feature: GZ8MTXP02H7OHW.25.64.F09.1.454.CMB.2.raw
  modified_base (280)..(280): a, c, t, g, unknown or other
  misc_feature (280)..(280): n is a, c, g, or t
  modified_base (290)..(290): a, c, t, g, unknown or other
  misc_feature (290)..(290): n is a, c, g, or t
  modified_base (293)..(293): a, c, t, g, unknown or other
  misc_feature (293)..(293): n is a, c, g, or t
  modified_base (303)..(303): a, c, t, g, unknown or other
  misc_feature (303)..(303): n is a, c, g, or t
  modified_base (309)..(309): a, c, t, g, unknown or other
  misc_feature (309)..(309): n is a, c, g, or t
  modified_base (319)..(319): a, c, t, g, unknown or other
  misc_feature (319)..(319): n is a, c, g, or t
tcagactgtacagtcacgaccggtgctcgatttagcgcgtatacaagggggaggaactgctcagttaggacccagacggaaccatggaagccccagcgcagcttctcttcctcctgctactctggctcccagattccactggagaaatagtgatgacgcagtctccagccaccctgtctgtgtctccaggggacagagccaccctctcctgcagggccagtcagagtatagcgcaattagcctggaccagcagaaacctggccagggtcccaggctcctnatccacggtncancacacggcangatcancagtcagtgnagtggtctgggacagtacttctctctacacctatcgagacacgccgtcgcgtacgtacgtacgtaacgttagttttacgttacgttaacgttttaactttacgttacgttacgtagtacgtaaacgttaaaacgttaaaaaacgttaacgggtaaccgttaacgttaacggtttacgggtaccggtaaacgggggaaaccggaaacggacgtacggtaacgtaacgtacgaaacggaaacggtaaacgtacggtacggtacgtacgaaccgaaccgtaacttacgttacgttacctttaccttactcccg

SEQ ID NO: 310014 - DNA, 539 bp, Homo sapiens
  misc_feature: GZ8MTXP02GIHB5.25.64.F09.1.454.CMB.2.raw
  modified_base (293)..(293): a, c, t, g, unknown or other
  misc_feature (293)..(293): n is a, c, g, or t
tcagactgtacagtcacgaccggtgctcgatttagcgcgtatacaagggggaggaactgctcagttaggacccagacggaaccatggaagccccagcgcagcttctcttcctcctgctactctggctcccagattccactggagaaatagtgatgacgcagtctccagccaccctgtctgtgtctccaggggacagagccaccctctcctgcagggccagtcagagtattagcggcaacttagcctggtaccagcagaacctggccagggtcccaggctcctcatccacggtncatccaccaggggcccactggaacttcccagccaggttcagtggcaggtgggtctggggacagtacttctctctcaccatccagcagcctgcagtctgacgtatttgctagtttattactgtcagacagttaataaaacgtggtaccgtacgtagtttaggaccgtaggggaccaaggctacggacacgtacacgacgaacgtgtacgccgtggaaccgactactctcgtacttcctactttcccg

SEQ ID NO: 310015 - DNA, 506 bp, Homo sapiens
  misc_feature: GZ8MTXP02I6AG4.25.64.F09.1.454.CMB.2.raw
  modified_base (294)..(294): a, c, t, g, unknown or other
  misc_feature (294)..(294): n is a, c, g, or t
  modified_base (356)..(356): a, c, t, g, unknown or other
  misc_feature (356)..(356): n is a, c, g, or t
  modified_base (484)..(484): a, c, t, g, unknown or other
  misc_feature (484)..(484): n is a, c, g, or t
tcagactgtacagtcacgaccggtgctcgatttagcgcgtatacaagggggaggaactgctcagttaggacccagacggaaccatggaagccccagcgcagcttctcttcctcctgctactctggctcccagattccactggagaaatagtgatgacgcagtctccagccaccctgtctgtgtctccaggggacagagccaccctctcctgcagggccagtcagagtattagcggcaacttagcctggtaccagcagaaacctggccagggtcccaggctcctcatccacggtncatccacagggccactggaattccagccagttcagtggcagtgggtctggggacagacttcnctctcaccatcagcagcctgcagtctgacgtatttgctagtttattactgtacagcaagtataaaaactggaccgtaactagtttggacgaggggaccaagctggacagtcaagacgaactgtaggcngaacacactctgtctctactcc

SEQ ID NO: 310016 - DNA, 576 bp, Homo sapiens
  misc_feature: GZ8MTXP02JF05C.25.64.F09.1.454.CMB.2.raw
  modified_base (299)..(299): a, c, t, g, unknown or other
  misc_feature (299)..(299): n is a, c, g, or t
  modified_base (353)..(353): a, c, t, g, unknown or other
  misc_feature (353)..(353): n is a, c, g, or t
  modified_base (369)..(369): a, c, t, g, unknown or other
  misc_feature (369)..(369): n is a, c, g, or t
tcagactgtacagtcacgaccggtgctcgatttagcgcgtatacaagggggaggaactgctcagttaggacccagacggaaccatggaagccccagcgcagcttctcttcctcctgctactctggctcccagattccactggagaaatagtgatgacgcagtctccagccaccctgtctgtgtctccgaggggacagagccaccctctcctgcagggccagtcagagtattagcggacaacttagcctggtaccagcaagaaacctggccagggtcccaggcctcctcatccgacggtncatcccacgagggcccagtggaacttccagccaggttcagtggcaggtgggtcnggggacagtaccttcnctctcaccatcagcagcctgcagtctgacgtatttgacttagtttatactgtacagtactaagtaaacttaaaacgtcgggtaccgttaacgtaggtttacggaccggtaagggacccgaaagcgtacggactacgtacgaacgtaaacgtaacgtcggtacgcgtacgaaccgaaccgtattaccgtcttcttactactttccccg

SEQ ID NO: 310017 - DNA, 566 bp, Homo sapiens
  misc_feature: GZ8MTXP02JXMLF.25.64.F09.1.454.CMB.2.raw
  modified_base (294)..(294): a, c, t, g, unknown or other
  misc_feature (294)..(294): n is a, c, g, or t
  modified_base (354)..(354): a, c, t, g, unknown or other
  misc_feature (354)..(354): n is a, c, g, or t
tcagactgtacagtcacgaccggtgctcgatttagcgcgtatacaagggggaggaactgctcagttaggacccagacggaaccatggaagccccagcgcagcttctcttcctcctgctactctggctcccagattccactggagaaatagtgatgacgcagtctccagccaccctgtctgtgtctccaggggacagagccaccctctcctgcagggccagtcagagtattagcggcaacttagcctggtaccagcagaacctggccagggtcccaggctcctcactccacggtncatcccacgagggcccatggaacttccagccaggttcagtggcaggtgggtctggggacngtaccttctctctcaccatcagcagcctgcagtctgacgtatttcgctagtttattactgtacagtcaagttaataaaactcgggacctacgtaggtttacggacgtacggggaccaacggctacgggacacgtcgaacgaacggtaacgtggtacgccgttacggaaccgtaccgtaacgttctacggttacctttcctacgtttcccccg

SEQ ID NO: 310018 - DNA, 591 bp, Homo sapiens
  misc_feature: GZ8MTXP02JKYHC.25.64.F09.1.454.CMB.2.raw
  modified_base (356)..(356): a, c, t, g, unknown or other
  misc_feature (356)..(356): n is a, c, g, or t
tcagactgtacagtcacgaccggtgctcgatttagcgcgtatacaagggggaggaactgctcagttaggacccagacggaaccatggaagccccagcgcagcttctcttcctcctgctactctggctcccagattccactggagaaatagtgatgacgcagtctccagccaccctgtctgtgtctccaggggacagagccaccctctcctgcagggccagtcagagtattagcggcaacttagcctggtaccagcagaaacctggccagggtcccaggctcctcatccacggtgcactcccaccgagggccacgtggaacttccagccaggttcagtggcaggtgggtctgggacngacttctctctcaccatcagcagcctgcagtctgacgtatttgcttagtttatactgtcagtactaagtaaataaaacgtcgggtaccgtaacgttacggtttacggaccgtaacgggggtacccaaaggccgttacgggaactacgttacgaacggtaacgtaaacgttcgggtacggtcgtcggaacctaaccggtacttaccgttcgtttacctttccgtaactttcccccg

SEQ ID NO: 310019 - DNA, 581 bp, Homo sapiens
  misc_feature: GZ8MTXP02GCKQL.25.64.F09.1.454.CMB.2.raw
  modified_base (352)..(352): a, c, t, g, unknown or other
  misc_feature (352)..(352): n is a, c, g, or t
  modified_base (406)..(406): a, c, t, g, unknown or other
  misc_feature (406)..(406): n is a, c, g, or t
tcagactgtacagtcacgaccggtgctcgatttagcgcgtatacaagggggaggaactgctcagttaggacccagacggaaccatggaagccccagcgcagcttctcttcctcctgctactctggctcccagattccactggagaaatagtgatgacgcagtctccagccaccctgtctgtgtctccaggggacagagccaccctctcctgcagggccagtcagagtatagcgcaacttgcctggtacagcagaacctggccaggtccaggctcctcatccacggtgcatccaccagggccactggaacttccagccaggttcagtggcaggtggtcgtgggacagacttcnctctcacatcagcagcctgcagtctgacgtatttgctagtttattactgtcagntaagttaataaaaacgtggtaccgtaacgtacggttttacggaccggtaacggggtaccaaacggtcgttacggggaacctagttaccgaacggaaaccgtaaaccgtcggttaggggccttaggaaccgtaccgtaacgttaccttacggttacctttccgtaactttcccccg

SEQ ID NO: 310020 - DNA, 510 bp, Homo sapiens
  misc_feature: GZ8MTXP02JUNVH.25.64.F09.1.454.CMB.2.raw
tcagactgtacagtcacgaccggtgctcgatttagcgcgtatacaagggggaggaactgctcagttaggacccagacggaaccatggaagccccagcgcagcttctcttcctcctgctactctggctcccagattccactggagaaatagtgatgacgcagtctccagccaccctgtctgtgtctccaggggacagagccaccctctcctgcagggccagtcagagtattagcggcaacttagcctggtaccagcagaaacctggccagggtcccaggcctcctcatccacggtgcactcccaccagggccactggaattccagccaggttcagtggcaggtgggtctggggacagacttctctctcaccatcagcagcctgcagtctgacgtatttgctagtttattactgtcagtcagtaataaaacgtcggacgtactaggtttcgacgagggaccagcgtggaacatcagtacgaacgtgtggctgcaccatctgtcttcacttcc

SEQ ID NO: 310021 - DNA, 665 bp, Homo sapiens
  misc_feature: GZ8MTXP02FUUZI.25.64.F09.1.454.CMB.2.raw
  modified_base (341)..(341): a, c, t, g, unknown or other
  misc_feature (341)..(341): n is a, c, g, or t
tcagactgtacagtcacgaccggtgctcgatttagcgcgtatacaagggggaggaactgctcagttaggacccagacggaaccatggaagccccagcgcagcttctcttcctcctgctactctggctcccagattccactggagaaatagtgatgacgcagtctccagccaccctgtctgtgtctccaggggacagagccaccctctcctgcagggccagtcagagtattagcggcaacttagcctggtaccagcagaaacctggccagggtcccaggctcctcatccacggttcactcaccacggcgacctagtacgtacctacgccacggttacgtagnggtcgacgtgggtcgtcggacgacgacgttcttctctccacactcacgcgacgcctcgcgacgtcgtacgtacggtaagtttttcgtccgttaagttttatttaactgttacgtacgtacgtaagttaaactaaaacgttacgggtaccggttaaccgttaaggttttacgggttaccggaacggggtaaaccggaacgtaacgtcggggtaacgaacttacgtaaacggaacggtaaaaccgtaggtttcgggaacgttcgtacccgaaccgttaacggttactttcccggttctttacccgtacctttaccctttcccccgg

SEQ ID NO: 310022 - DNA, 511 bp, Homo sapiens
  misc_feature: GZ8MTXP02IPICU.25.64.F09.1.454.CMB.2.raw
tcagactgtacagtcacgaccggtgctcgatttagcgcgtatacaagggggaggaactgctcagttaggacccagacggaaccatggaagccccagcgcagcttctcttcctcctgctactctggctcccagattccactggagaaatagtgatgacgcagtctccagccaccctgtctgtgtctccaggggacagagccaccctctcctgcagggccagtcagagtattagcggcaacttagcctggtaccagcagaaacctggccagggtcccaggctcctcatccacggtgcatcccaccagggccactggaattcccagccaggttcagtggcagtgggtctggggacagacttctctctcaccatcagcagcatgcagtctgacgtatttgctagtttatactgtcagactagtaataaaacgtggaccgtacgtagttttggacgtaggggaccaagctaggactatcgagacgaacgtgtggctgacacctatctgtcttctac

SEQ ID NO: 310023 - DNA, 596 bp, Homo sapiens
  misc_feature: GZ8MTXP02HRDOQ.25.64.F09.1.454.CMB.2.raw
  modified_base (263)..(263): a, c, t, g, unknown or other
  misc_feature (263)..(263): n is a, c, g, or t
  modified_base (280)..(280): a, c, t, g, unknown or other
  misc_feature (280)..(280): n is a, c, g, or t
  modified_base (289)..(289): a, c, t, g, unknown or other
  misc_feature (289)..(289): n is a, c, g, or t
tcagactgtacagtcacgaccggtgctcgatttagcgcgtatacaagggggaggaactgctcagttaggacccagacggaaccatggaagccccagcgcagcttctcttcctcctgctactctggctcccagattccactggagaaatagtgatgacgcagtctccagccaccctgtctgtgtctccgaggggacagacgcccaccctctcctgcagggccagtcagagtattagcggcaattagcctggaccagcagaaccnggcaggccaggctcctnactcacgtncatccacgaggccagtgactccagcctaggtcaggtggctaggtggtctgggacagtaccttctcctctcaccatcagcacgcctgcagtctgacttatttcgacttagtttattactgtactagtactaaagttaaactaaaacgttcggtaaccgttacgttacgggtttacgggaaccggacgggggtaaaccctaaggtaccgttaacgggaactaacgtaccgaaacggtaaaccggtaaacgtggtcggtaacgtcggaaccgtaccctattcgtcgtttaccttacctaccgtttccccg

SEQ ID NO: 310024 - DNA, 513 bp, Homo sapiens
  misc_feature: GZ8MTXP02GK3RF.25.64.F09.1.454.CMB.2.raw
  modified_base (357)..(357): a, c, t, g, unknown or other
  misc_feature (357)..(357): n is a, c, g, or t
tcagactgtacagtcacgaccggtgctcgatttagcgcgtatacaagggggaggaactgctcagttaggacccagacggaaccatggaagccccagcgcagcttctcttcctcctgctactctggctcccagattccactggagaaatagtgatgacgcagtctccagccaccctgtctgtgtctccaggggacagagccaccctctcctgcagggccagtcagagtattagcggcaacttagcctggtaccagcagaaacctggccagggtcccaggctcctcatccacggtgcatccaccagggccactggaattccagccaggttcagtggcagtgggtctgggacagacttcnctctcaccatcagcagcctgcagtctgacgtatttgctagtttatatgtcagctagtaataaaactggtacgtacgtagtttggaccgtaggggtaccagtcgtggacagtacacgacgaacgtcgtacgctgcacatctagtcttacacttcccg

SEQ ID NO: 310025 - DNA, 530 bp, Homo sapiens
  misc_feature: GZ8MTXP02HRWNJ.25.64.F09.1.454.CMB.2.raw
  modified_base (518)..(518): a, c, t, g, unknown or other
  misc_feature (518)..(518): n is a, c, g, or t
tcagactgtacagtcacgaccggtgctcgatttagcgcgtatacaagggggaggaactgctcagttaggacccagacggaaccatggaagccccagcgcagcttctcttcctcctgctactctggctcccagattccactggagaaatagtgatgacgcagtctccagccaccctgtctgtgtctccaggggacagacgccaccctctcctgcagggccagtcagagtattagcggcaacttagcctggtacagcagaaacctggccagggtcccaggctcctcactccacggtgcatccacagggccactggaattccagccaggttcagtggcagtggtctgggacagtacttctctctcacatcagctacgcctgctagtctagacgttatttcgactagtttattacgtgtacagtataagttaataaaacgttcggtaccgttaagtagtttacggacgtacggggactaagcgtaggacatcagacgaacttgcgactgaaccgactatctntcttcacttccc

SEQ ID NO: 310026 - DNA, 521 bp, Homo sapiens
  misc_feature: GZ8MTXP02FV9FU.25.64.F09.1.454.CMB.2.raw
  modified_base (293)..(293): a, c, t, g, unknown or other
  misc_feature (293)..(293): n is a, c, g, or t
  modified_base (355)..(355): a, c, t, g, unknown or other
  misc_feature (355)..(355): n is a, c, g, or t
  modified_base (359)..(359): a, c, t, g, unknown or other
  misc_feature (359)..(359): n is a, c, g, or t
  modified_base (364)..(364): a, c, t, g, unknown or other
  misc_feature (364)..(364): n is a, c, g, or t
tcagactgtacagtcacgaccggtgctcgatttagcgcgtatacaagggggaggaactgctcagttaggacccagacggaaccatggaagccccagcgcagcttctcttcctcctgctactctggctcccagattccactggagaaatagtgatgacgcagtctccagccaccctgtctgtgtctccaggggacagagccaccctctcctgcagggccagtcagagtattagcggcaacttagcctggtaccagcagaaacctggccagggtcccaggctcctcatccaggtncatcccacgaggccactggaattcccagccaggttcagtggcagtggtctgggacagcttcnctcncaccntcagcagcctgcagtctgacgtatttgctagtttattactgtcagtctagtaataaaacgtcggtacgttacgtagtttggaccgtacgggggaccaagtcgtaggactagtaccgagacgaactcgtacggctgcgaccatctgtcttcagttccc

SEQ ID NO: 310027 - DNA, 531 bp, Homo sapiens
  misc_feature: GZ8MTXP02G0644.25.64.F09.1.454.CMB.2.raw
  modified_base (364)..(364): a, c, t, g, unknown or other
  misc_feature (364)..(364): n is a, c, g, or t
tcagactgtacagtcacgaccggtgctcgatttagcgcgtatacaagggggaggaactgctcagttaggacccagacggaaccatggaagccccagcgcagcttctcttcctcctgctactctggctcccagattccactggagaaatagtgatgacgcagtctccagccaccctgtctgtgtctccaggggacagagccaccctctcctgcagggccagtcagagtattagcggcaacttagcctggtaccagcagaaacctggccagggtcccaggctcctcatccacggtgcatcccaccagggccacgtggaattcccagccaggttcagtggcaggtgggtctggggacagtaccttcnctctcaccatccagcagcctgcagtctgacgtatttgctagtttattactgtcagctagttaaataaaacgtggtaccgtacgtaggtttggaccgtaagggggaccaaagcgtaggacatcgaagacgaacgtggtacgcctgccacatctgtacttcactttccc

SEQ ID NO: 310028 - DNA, 632 bp, Homo sapiens
  misc_feature: GZ8MTXP02GWVUH.25.64.F09.1.454.CMB.2.raw
  modified_base (295)..(295): a, c, t, g, unknown or other
  misc_feature (295)..(295): n is a, c, g, or t
  modified_base (375)..(375): a, c, t, g, unknown or other
  misc_feature (375)..(375): n is a, c, g, or t
  modified_base (610)..(610): a, c, t, g, unknown or other
  misc_feature (610)..(610): n is a, c, g, or t
tcagactgtacagtcacgaccggtgctcgatttagcgcgtatacaagggggaggaactgctcagttaggacccagacggaaccatggaagccccagcgcagcttctcttcctcctgctactctggctcccagattccactggagaaatagtgatgacgcagtctccagccaccctgtctgtgtctccgaggggacagagcccaccctctcctgcagggccagtcagagtattagcggcaacttgcctggtaccagcagaacctggccagggtcccaggcctcctcatccacggtncactcccaccgaggcccacgtggaacttccgagcccgtaggttcaggttcggcagggtggggctggggacaggacgttcncgttctaccgaccatccagcagtcgtaggacgtccgtagtaagttagtttgacgttaagttttacgttacgttgtacctagaccgtagtcggttacgcgttaacgggttcggaccccggttaccgggggttacgttacgggtttcgggacccgtagggggaccctaagggtccgtagggaagtaacgtaaccgtaaaacgtaacggtggtacgacgtaacggacctaacccgttnttaccgtacgtttcctactacg

SEQ ID NO: 310029 - DNA, 570 bp, Homo sapiens
  misc_feature: GZ8MTXP02HK37Z.25.64.F09.1.454.CMB.2.raw
tcagactgtacagtcacgaccggtgctcgatttagcgcgtatacaagggggaggaactgctcagttaggacccagacggaaccatggaagccccagcgcagcttctcttcctcctgctactctggctcccagattccactggagaaatagtgatgacgcagtctccagccaccctgtctgtgtctccgaggggacagagccaccctctcctgcagggccagtcagagtattagcggcaacttagcctggtaccagcaagaacctggccagggtcccaggcctcctcactccacggtgcaactcccaccgagggcccagtggaacttccgagccaggttcaggtggcaggtgggtctggggacagtacttctctttcactatcagcagcctgcagtctgacgttatttgacttagtttacttacgtgttcacgtctaagtaaacttaaaacgtcggaccgttacgtacgttttacgggacccgtaagggggacctaaggtccgtaggaactacgtaccgaggtaccgaaacgtgtcggctagccaacgatctgttcctcacttccgtcccg

SEQ ID NO: 310030 - DNA, 641 bp, Homo sapiens
  misc_feature: GZ8MTXP02H161U.25.64.F09.1.454.CMB.2.raw
  modified_base (385)..(385): a, c, t, g, unknown or other
  misc_feature (385)..(385): n is a, c, g, or t
tcagactgtacagtcacgaccggtgctcgatttagcgcgtatacaagggggaggaactgctcagttaggacccagacggaaccatggaagccccagcgcagcttctcttcctcctgctactctggctcccagattccactggagaaatagtgatgacgcagtctccagccaccctgtctgtgtctccgaggggacaggacgccaccctctcctgcagggccagtcagagtatagcgcaacttagcctggaccagcaagaacctggaccaggggtcccaggcctccgtcactccgaacggtgccatcccaccgacgggccacgtggaacttccagccaggttcaggtggcaggtgggctggggacagtacttctcgtctcaacctntcagcacgcctgctagtctgtacgtattttcgctttaagtttacttacgtgtacgtaggtcctaggtacggtacgtacggtacggttcggggtacccgtttacgggggtttacgttacgggtttttaccgggaccgggttaacgggggacctaacgggtccgttagggggaacttaacgtaaaccggaaaacggtaacgttacggtcggggtaacctcggaaccttaccgacgtttccgtcggtttaccctttccg

SEQ ID NO: 310031 - DNA, 564 bp, Homo sapiens
  misc_feature: GZ8MTXP02I11FA.25.64.F09.1.454.CMB.2.raw
tcagactgtacagtcacgaccggtgctcgatttagcgcgtatacaagggggaggaactgctcagttaggacccagacggaaccatggaagccccagcgcagcttctcttcctcctgctactctggcctcccagattccactggagaaatagtgatgacgcagtctccagccacctgtctgtgtctccgaggggacagagccaccctctcctgcagggccagtcagagtattagcgcaacttgcctggtaccagcagaaacctggccagggtccaggctcctcatccacggtgcatcccacagggccacgtggaacttcccgagccgaggttccaggtggcaggtggggtctggggacagtaccttcgtctctcaccatccagcacgcctgcagtctgtacgtatttcgattagtttattactgtacagactaagtaattaaaacgtggtaccgtactagtttcggaccgtaaggggacctaagcgtacggaactagtacgacgtaacgaacgtggtacggtctacggaaccgacctacttcgtagttcctttacactttccccg

SEQ ID NO: 310032 - DNA, 587 bp, Homo sapiens
  misc_feature: GZ8MTXP02GFOMN.25.64.F09.1.454.CMB.2.raw
  modified_base (294)..(294): a, c, t, g, unknown or other
  misc_feature (294)..(294): n is a, c, g, or t
tcagactgtacagtcacgaccggtgctcgatttagcgcgtatacaagggggaggaactgctcagttaggacccagacggaaccatggaagccccagcgcagcttctcttcctcctgctactctggctcccagattccactggagaaatagtgatgacgcagtctccagccaccctgtctgtgtctccgaggggacagagcccaccctctcctgcagggccagtcagagtatagcggcaacttgcctggtaccagcagaaacctggccagggtcccaggctcctcatccacggtncatcccaccgagggcccacgtggaacttccagccgaggttcaggtggcaggtggggtctggggacaggtaccttctctctcaccatcagcagcctgcagtctgtacgtatttgacttagtttattactgtacagactaagtaaataaaacgtcgggtaccgtacgtaggtttacgggaccgtaacggggaaccaaagtccgtaaggacctaagttacgaacggaaacgtaaacgtggtacgggtcttacggaacctacccgtagttccgtacgttccttactacgtttccccg

SEQ ID NO: 310033 - DNA, 504 bp, Homo sapiens
  misc_feature: GZ8MTXP02FTPK1.25.64.F09.1.454.CMB.2.raw
  modified_base (294)..(294): a, c, t, g, unknown or other
  misc_feature (294)..(294): n is a, c, g, or t
  modified_base (359)..(359): a, c, t, g, unknown or other
  misc_feature (359)..(359): n is a, c, g, or t
tcagactgtacagtcacgaccggtgctcgatttagcgcgtatacaagggggaggaactgctcagttaggacccagacggaaccatggaagccccagcgcagcttctcttcctcctgctactctggctcccagattccactggagaaatagtgatgacgcagtctccagccaccctgtctgtgtctccaggggacagagccaccctctcctgcagggccagtcagagtattagcggcaacttagcctggtaccagcagaaacctggccagggtcccaggctcctcatccacggtncatccaccagggccactggaattcccagccaggttcagtggcagtgggtctggggacagacttcnctctcaccatcaagcagcctgcagtctgacgatttgctagtttattactgtcagcaagtataaaaactggaccgtacagtttggccgaggggaccaagctggacagtcagacgaatcgtaggctgcaccatctgtcttcattccg

SEQ ID NO: 310034 - DNA, 559 bp, Homo sapiens
  misc_feature: GZ8MTXP02HAOFP.25.64.F09.1.454.CMB.2.raw
  modified_base (294)..(294): a, c, t, g, unknown or other
  misc_feature (294)..(294): n is a, c, g, or t
  modified_base (364)..(364): a, c, t, g, unknown or other
  misc_feature (364)..(364): n is a, c, g, or t
  modified_base (430)..(430): a, c, t, g, unknown or other
  misc_feature (430)..(430): n is a, c, g, or t
tcagactgtacagtcacgaccggtgctcgatttagcgcgtatacaagggggaggaactgctcagttaggacccagacggaaccatggaagccccagcgcagcttctcttcctcctgctactctggctcccagattccactggagaaatagtgatgacgcagtctccagccaccctgtctgtgtctccgaggggacagagccaccctctcctgcagggccagtcagagtattagcggctaacttgcctggtaccagcagaacctggccagggtcccaggctcctcatccacggtncatcccaccgaggggcccaacgtggaacttcccgagccgagggttcaggtggcaggtgggtctggggacngtacttctctcacaccatcagcagcctgcacgtctgtacgtatttcgcttagtttacttactgtanagactaagtaataaaacgtcggtaccgtacgtagtttcggacgtaaggggacagcgtacggactacgtacgaacggacgtaacgtggtacggctacgcgtaccacgttctacgtcctttctacttcccg

SEQ ID NO: 310035 - DNA, 718 bp, Homo sapiens
  misc_feature: GZ8MTXP02G1ILS.25.64.F09.1.454.CMB.2.raw
  modified_base (283)..(283): a, c, t, g, unknown or other
  misc_feature (283)..(283): n is a, c, g, or t
tcagactgtacagtcacgaccggtgctcgatttagcgcgtatacaagggggaggaactgctcagttaggacccagacggaaccatggaagccccagcgcagcttctcttcctcctgctactctggctcccagattccactggagaaatagtgatgacgcagtctccagccaccctgtctgtgtctccgaggggacagacgccaccctctcctgcagggccagtcagagtattagcggacaacttgcctggaccagcagaacctggccgaggtcccaggctccncatccgacggtgcatcccacgacgggacccacgtacggaacttcccgagtacccgtacggtttcgaaggtcggggactaggggttcggggtccgttacgggggaactacggtaccgtttccttccgtcctaccgacctaatcgaacgccacgtcctgctacgtcgtacggtacgttagttttcgaccgtttaagttttaacttacgttacgttactaggttaacctaaaggtttaaaacgttaaaaaccggttcggggttaaacccgttaacggtttaacgggttttaccggggaacccggtaaacgggggtaaacccgtaacggtacgtaacgggtaacgtaacgttacgaaacggtaaccggtaaacgttacggtacggtacctacggaacctaacgttacttccgtacgtttccttacctaccgtttccccg

SEQ ID NO: 310036 - DNA, 641 bp, Homo sapiens
  misc_feature: GZ8MTXP02I536P.25.64.F09.1.454.CMB.2.raw
  modified_base (298)..(298): a, c, t, g, unknown or other
  misc_feature (298)..(298): n is a, c, g, or t
  modified_base (432)..(432): a, c, t, g, unknown or other
  misc_feature (432)..(432): n is a, c, g, or t
  modified_base (487)..(487): a, c, t, g, unknown or other
  misc_feature (487)..(487): n is a, c, g, or t
  modified_base (600)..(600): a, c, t, g, unknown or other
  misc_feature (600)..(600): n is a, c, g, or t
tcagactgtacagtcacgaccggtgctcgatttagcgcgtatacaagggggaggaactgctcagttaggacccagacggaaccatggaagccccagcgcagcttctcttcctcctgctactctggctcccagattccactggagaaatagtgatgacgcagtctccagccaccctgtctgtgtctccgaggggacagacgccaccctctcctgcgagggccagtcgaagtagtattagcggacaacttgcctggtaccagacaagaacctggaccgtagggtcccaggcctcccgtanactcccgaacgggtcaccacgtaccccgacggacgggtacccaggtacggtaaacttcccgaggtaccgtaggttcaggtcgggctagggtcgggtcgtacgggactacgtactttctctacctacaccgtaancgacgtccacgcctgactagtctacgtaagtttattttcggacttttacgtttancgtacgtagtaacgtaattaaacgtaaacgtaacggtcgtaagttacggtaggtacggacggtaacgactagacgtagtaacgtagaacggtacgtacgtacgtgggtaaccncgtaccgtaactctcgttcttcgtaccttactccgtacccg

SEQ ID NO: 310037 - DNA, 629 bp, Homo sapiens
  misc_feature: GZ8MTXP02JTB4N.25.64.F09.1.454.CMB.2.raw
  modified_base (294)..(294): a, c, t, g, unknown or other
  misc_feature (294)..(294): n is a, c, g, or t
tcagactgtacagtcacgaccggtgctcgatttagcgcgtatacaagggggaggaactgctcagttaggacccagacggaaccatggaagccccagcgcagcttctcttcctcctgctactctggctcccagattccactggagaaatagtgatgacgcagtctccagccaccctgtctgtgtctccgaggggacagagccaccctctcctgcagggccagtcagagtattagcggcaacttagcctggtaccagcagaacctggccagggtcccaggctcctcatccacggtncactcccacgacggccacgtagaactccgagtccgtaggtcaggtggcgtacgggttcgggtacgtgggactagtaccttctctccacacctatcacgcacgcctgacgtacgtacgtacgtacgttacgtttacgtacgttagtttaacgtttacgttacgtacgtagtaacgtaagttaaacgtaaaacgtacggtaccgttaacgttacggtttacggtaccggtaacgggaacggtaacgtacgtacggtaacgtacgtacgaacggtaacgtaacgtacggtacggtacgtacgtaacgacgtactactacgttacttactaccttaccg

SEQ ID NO: 310038 - DNA, 528 bp, Homo sapiens
  misc_feature: GZ8MTXP02FRR58.25.64.F09.1.454.CMB.2.raw
tcagactgtacagtcacgaccggtgctcgatttagcgcgtatacaagggggaggaactgctcagttaggacccagacggaaccatggaagccccagcgcagcttctcttcctcctgctactctggctcccagattccactggagaaatagtgatgacgcagtctccagccaccctgtctgtgtctccaggggacagagccaccctctcctgcagggccagtcagagtattagcggcaacttagcctggtaccagcagaaacctggccagggtccccaggcctcctcatccacggtgcatcccaccagggcccactggaacttccagccaggttcagtggcaggtgggtctggggacagacttctctctcaccatcagcagcctgcagtctgacgtatttgctagtttatactgtacagcagtaataaaactcggtactactagtttcggcgtaggggaccaagcgtaggacagtaccagacgtaacgtgtacgcgtcgcgtaccacttcctgttcttctactttcccg

SEQ ID NO: 310039 - DNA, 558 bp, Homo sapiens
  misc_feature: GZ8MTXP02F8NCV.25.64.F09.1.454.CMB.2.raw
tcagactgtacagtcacgaccggtgctcgatttagcgcgtatacaagggggaggaactgctcagttaggacccagacggaaccatggaagccccagcgcagcttctcttcctcctgctactctggctcccagattccactggagaaatagtgatgacgcagtctccagccaccctgtctgtgtctccaggggacagacgccaccctctcctgcagggccagtcagagtattagcggcaacttagcctggtaccagcagaaacctggccagggtcccaggcctcctcactccgacggtgcactcccgaccgagggccacgtggaacttccagccaggttcaggtggcaggtcgggtctggggacagtaccttcgtcctctcacctatcgagcacgcctgctagtctgtacgtatttgcgttagtttattactgtacagtactaagttaataaaacgtcggtaccgtaacgttaggtttacggacggtaacgggaccaagtcgtaggactatcgaacgacgaacgtcgtacgctcgcactactctgtctctacgttcccg

SEQ ID NO: 310040 - DNA, 766 bp, Homo sapiens
  misc_feature: GZ8MTXP02GDLD2.25.64.F09.1.454.CMB.2.raw
tcagactgtacagtcacgaccggtgctcgatttagcgcgtatacaagggggaggaactgctcagttaggacccagacggaaccatggaagccccagcgcagcttctcttcctcctgctactctggctcccagattccactggagaaatagtgatgacgcagtctccagccaccctgtctgtgtctccgaggggacagacgcccaccctctcctgcagggccagtcagagtattagcggactaacttagcctggtacagcagaaacctggccagggtccaggcctcctcactccgacggtgaccactccccgaacgacggggccctaacgtcgggtaaaactttccccgaaggtcccgttaagggtttaccgaagggttcggggccgtaaggggtttcgggggtaccgttagggggaaacctacgggttaaccctttccgttccgttacccttaccaaaccctaaacgttccgaaacgtcccgaacgtccccgttggacccgtaacggttcccgtaggttaacccgtttaagtttttcggaaccgtttaaggtttttaacttaccgttggtttaaccaaggtacgtaaaacgttaaaacgttaaaaacggttcgggtaacccgtttaaacggttacggttttacgggaccggtaaacgggggtaaccaaagggtcgttacgggaactacgtaccgaaggaaaccggtaacgtcgggttacgccgtaagccgtaacgtacttaccgtctttcctactactttccccgg

SEQ ID NO: 310041 - DNA, 515 bp, Homo sapiens
  misc_feature: GZ8MTXP02FNGYS.25.64.F09.1.454.CMB.2.raw
  modified_base (294)..(294): a, c, t, g, unknown or other
  misc_feature (294)..(294): n is a, c, g, or t
  modified_base (361)..(361): a, c, t, g, unknown or other
  misc_feature (361)..(361): n is a, c, g, or t
tcagactgtacagtcacgaccggtgctcgatttagcgcgtatacaagggggaggaactgctcagttaggacccagacggaaccatggaagccccagcgcagcttctcttcctcctgctactctggctcccagattccactggagaaatagtgatgacgcagtctccagccaccctgtctgtgtctccaggggacagagccaccctctcctgcagggccagtcagagtattagcagcaacttagcctggtaccagcaagaaacctggccagggtcccaggctcctcatccaggtncatccacgaggtccactggaacttccgagccaggttcaggtggccaggtgggctggggacagcttcnctctcaccatcagtcagctgcagtctagacgtatttgctagtttatactgtcagcagtaataaaacgtgaccgtacgtagtttcggacgtaggggaccaaggtctaggacatacgagacgaacgtacgtggtcgtgacacactctcgtctctac

SEQ ID NO: 310042 - DNA, 537 bp, Homo sapiens
  misc_feature: GZ8MTXP02GOU2G.25.64.F09.1.454.CMB.2.raw
  modified_base (344)..(344): a, c, t, g, unknown or other
  misc_feature (344)..(344): n is a, c, g, or t
  modified_base (351)..(351): a, c, t, g, unknown or other
  misc_feature (351)..(351): n is a, c, g, or t
tcagactgtacagtcacgaccggtgctcgatttagcgcgtatacaagggggaggaactgctcagttaggacccagacggaaccatggaagccccagcgcagcttctcttcctcctgctactctggctcccagattccactggagaaatagtgatgacgcagtctccagccaccctgtctgtgtctccaggggacagagccaccctctcctgcagggccagtcagagtattagcggcaacttagcctggtaccagcagaacctggccaggtcccaggctcctcactccacggtgcatcccacaggccatggaattccagccaggtcagtgcagtggtctgggacngacttcnctctcacatcagcagcctgcagtctgacgtatttgctagtttatactgtctagactaagttaataaaacgtgggtaccgttaacgtaggtttcggaccgtaacggggacctaaaggcgtaggaccagtacgaacgtacgaacgttgacggtctagccgaactacgttctgtccttacactttcccc

SEQ ID NO: 310043 - DNA, 600 bp, Homo sapiens
  misc_feature: GZ8MTXP02FHOFF.25.64.F09.1.454.CMB.2.raw
tcagactgtacagtcacgaccggtgctcgatttagcgcgtatacaagggggaggaactgctcagttaggacccagacggaaccatggaagccccagcgcagcttctcttcctcctgctactctggctcccagattccactggagaaatagtgatgacgcagtctccagccaccctgtctgtgtctccgaggggacagagccaccctctcctgcagggccagtcagagtattagcggacaacttagcctggtaccagcagaacctggccagggtcccaggcctcctcactccgacggtgccatccccaccgagggcccacgtggaaacttcccagcctaggttcaggtggcaggtcggggtctggggactaggtaccttctcctctacacatcagccacgccctgctagtctgtacgtatttgacttagtttatacgtgtacagactaagtaataaaacgtcgggtacctacgtaggtttcggaccgtaggggaccaaggtcgtacggacactacgaacggaacgtaaaccgtggttacggccttacggaaccctaaccgtaacttaccggttacgtttaccttaccgtacgtttcccccg

SEQ ID NO: 310044 - DNA, 638 bp, Homo sapiens
  misc_feature: GZ8MTXP02JWF8M.25.64.F09.1.454.CMB.2.raw
  modified_base (235)..(235): a, c, t, g, unknown or other
  misc_feature (235)..(235): n is a, c, g, or t
  modified_base (248)..(248): a, c, t, g, unknown or other
  misc_feature (248)..(248): n is a, c, g, or t
  modified_base (251)..(251): a, c, t, g, unknown or other
  misc_feature (251)..(251): n is a, c, g, or t
  modified_base (259)..(259): a, c, t, g, unknown or other
  misc_feature (259)..(259): n is a, c, g, or t
  modified_base (267)..(267): a, c, t, g, unknown or other
  misc_feature (267)..(267): n is a, c, g, or t
  modified_base (273)..(273): a, c, t, g, unknown or other
  misc_feature (273)..(273): n is a, c, g, or t
  modified_base (309)..(309): a, c, t, g, unknown or other
  misc_feature (309)..(309): n is a, c, g, or t
  modified_base (358)..(358): a, c, t, g, unknown or other
  misc_feature (358)..(358): n is a, c, g, or t
  modified_base (404)..(404): a, c, t, g, unknown or other
  misc_feature (404)..(404): n is a, c, g, or t
tcagactgtacagtcacgaccggtgctcgatttagcgcgtatacaagggggaggaactgctcagttaggacccagacggaaccatggaagccccagctcagcttctcttcctcctgctactctgtctcccagattccagcggcgaaactgtgttgacacagtctccagccaccctgtctttgtcgtccgggggaacagccaccctctcctgcagggccgccagctgtgacaacgnttagctgtacaanganctgcagcnccagctcnatctangatactcaggtggccactggcactccccagccccgnttcgaggtcggctaggtcggggtctacggggactaggtacgttttaccnctaccactctcctaccgacgtacctaggacgtccgtagtaaagttntttcgacgttaagtttacttcgtagtctacgtccgtaccgacgtaaaggtacgtcgtaccctactaacttacgttaccgtaccgtttaccggacccggttaacgggaaaccgtaaaggtacggtaaactaacgtaaaccgtaaaacggtacgttacggtacggtacctacgaacctaaccgtacgttacgttcgttaccttactaccttcccgttaccccgtacctacttaccg

SEQ ID NO: 310045 - DNA, 627 bp, Homo sapiens
  misc_feature: GZ8MTXP02GW9SM.25.64.F09.1.454.CMB.2.raw
  modified_base (298)..(298): a, c, t, g, unknown or other
  misc_feature (298)..(298): n is a, c, g, or t
  modified_base (414)..(414): a, c, t, g, unknown or other
  misc_feature (414)..(414): n is a, c, g, or t
tcagactgtacagtcacgaccggtgctcgatttagcgcgtatacaagggggaggaactgctcagttaggacccagacggaaccatggaagccccagcgcagcttctcttcctcctgctactctggctcccagattccactggagaaatagtgatgacgcagtctccagccaccctgtctgtgtctccgaggggacagagccaccctctcctgcagggccagtcagagtattagcggacaacttagcctggtaccagcaagaacctggccacggtcccaggctcctcactccgacggtncactccaccgacgggccaacgtggaacttccagcccaggttccaggtcggcgaggtgggtctggggactagacttctctctcaccatcagcacgctgcagtctgtacttatttcgnttaagtttactattgtactaggactaaagtaaacttaaaacgtcgggtacccgttaagttagggttttacggaaccggtaacgggggtaaaccaacggtcggtaacggtaacaaacgtaccgaaacggtaaaccgtaaacgtgggttaacgccgttacggaaccgtaacccttaacgttccgttacggttcctttaaccgtcgtttacccccg

SEQ ID NO: 310046 - DNA, 546 bp, Homo sapiens
  misc_feature: GZ8MTXP02GD4EQ.25.64.F09.1.454.CMB.2.raw
  modified_base (350)..(350): a, c, t, g, unknown or other
  misc_feature (350)..(350): n is a, c, g, or t
tcagactgtacagtcacgaccggtgctcgatttagcgcgtatacaagggggaggaactgctcagttaggacccagacggaaccatggaagccccagcgcagcttctcttcctcctgctactctggctcccagattccactggagaaatagtgatgacgcagtctccagccaccctgtctgtgtctccaaggggacagagccaccctctcctgcagggccagtcagagtattagcggcaacttgcctggtaccagcagaaacctggccagggtcccaggcctcctcatccaggtgcatccacaggccatggaatccagccagtcagtggcagtggtctgggacagacttcnctctcacatccaagcagcctgcagtctgacgtatttgctagtttatactgtacagctaagttaataaaacgtggtaccgttaacgtaggttttacggaccgtaacggggaaccaaaggcgtagggactaactaccgaagaaaccgtaacgtggtacggcctagaaccgtaccaatctgttactactactttccccg

SEQ ID NO: 310047 - DNA, 588 bp, Homo sapiens
  misc_feature: GZ8MTXP02IKVN8.25.64.F09.1.454.CMB.2.raw
  modified_base (259)..(259): a, c, t, g, unknown or other
  misc_feature (259)..(259): n is a, c, g, or t
  modified_base (358)..(358): a, c, t, g, unknown or other
  misc_feature (358)..(358): n is a, c, g, or t
  modified_base (370)..(370): a, c, t, g, unknown or other
  misc_feature (370)..(370): n is a, c, g, or t
  modified_base (385)..(385): a, c, t, g, unknown or other
  misc_feature (385)..(385): n is a, c, g, or t
tcagactgtacagtcacgaccggtgctcgatttagcgcgtatacaagggggaggaactgctcagttaggacccagacggaaccatggaagccccagcgcagcttctcttcctcctgctactctggctcccagattccactggagaaatagtgatgacgcagtctccagccaccctgtctgtgtctccaggggacagacgccaccctctcctgcagggccagtcagagtatagcgcaattagcctggaccagcagaaccngcaggtccagctctcatccacgtgcactcccaccagggcccacgtggaacttcgagccctaggttcaggtggcaggtggggtctggggacagtacttcnctctcaacccgntccagccagcccgtncgtcgtcgtagtacgttatttcgacttagttacttactgtactagtactaagttaaactaaacgtcggtaccgttacgttacggttacggaccgtacgggtaaccagtcgtacggacgacgtacgaacgtaaccggtaacgttcgtacggtacgtacgaaccgtacctacgttaccgtcgtttacccttacgtacctttcccg

SEQ ID NO: 310048 - DNA, 604 bp, Homo sapiens
  misc_feature: GZ8MTXP02IMF97.25.64.F09.1.454.CMB.2.raw
  modified_base (379)..(379): a, c, t, g, unknown or other
  misc_feature (379)..(379): n is a, c, g, or t
  modified_base (425)..(425): a, c, t, g, unknown or other
  misc_feature (425)..(425): n is a, c, g, or t
tcagactgtacagtcacgaccggtgctcgatttagcgcgtatacaagggggaggaactgctcagttaggacccagacggaaccatggaagccccagcgctgcttctcttcctcctgctactctggctcccagattccactggagaaatagtgatgacgcagtctccagccaccctgtctgtgtctccgaggggacagacgcccaccctctcctgcagggccagtcagagtattagcggacaattagccgttggaccagcaacgaaacctggccaagggtcccaggcctcctcactccgacgtgcactaccacgacggccagtggaacttccagactaggttcagtcggcaggtggtacctaggggactaggtacctttnccttctaccaccatccgagtccacgccctgctacgtctagacgttntttcgacgttagtttacttacttgtactacggtactaaagttaaacgtaaaaacgttcggtaacgttaacgttacggtttacggaccggtaacggggtaaccgaagtacgtacggtaacactacgaacgtaactacgtgtacggctacgaacacgtacttctcgtcttactacttcccg

SEQ ID NO: 310049 - DNA, 650 bp, Homo sapiens
  misc_feature: GZ8MTXP02I7BID.25.64.F09.1.454.CMB.2.raw
  modified_base (299)..(299): a, c, t, g, unknown or other
  misc_feature (299)..(299): n is a, c, g, or t
tcagactgtacagtcacgaccggtgctcgatttagcgcgtatacaagggggaggaactgctcagttaggacccagacggaaccatggaagccccagcgcagcttctcttcctcctgctactctggctcccagattccactggagaaatagtgatgacgcagtctccagccaccctgtctgtgtctccgaggggacagacgcccaccctctcctgcagggccagtcagagtattagcggctaacttagcctggtaccagcagaacctggccagggtcccaggcctcctcatccgacggtnacatcccaccgacggggtccacgtggaacttcccgaagccgtaaggttccaggtggcctaggtcggggtctaggggactagtaccttctctctacactctcagccagcctgacacgtcgtagtccgttatttcgacgttagtttacttacgtagttactaggtaccttaaggttaaactaaaacggtcgggtaacccgttacgttacgggttttaccgggaccgtaaagggggtaccctaaacgggtcgtacggtaaactacgtacgacggtaaaccgtaacgtcgggtacggtcgttacggaacccgaccgtactttccggtacgtttacctttaccgtacctttccccg

SEQ ID NO: 310050 - DNA, 647 bp, Homo sapiens
  misc_feature: GZ8MTXP02FH5XQ.25.64.F09.1.454.CMB.2.raw
  modified_base (227)..(227): a, c, t, g, unknown or other
  misc_feature (227)..(227): n is a, c, g, or t
tcagactgtacagtcacgaccggtgctcgatttagcgcgtatacaagggggaggaactgctcagttaggacccagacggaaccatggaagccccagcgcagcttctcttcctcctgctactctggctcccagattccactggagaaatagtgatgacgcagtctccagccaccctgtctgtgtctccgaggggacagacgccaccctctcctgcagggccagtcagngtattagcggcaactagcctggtacagcagaaacctggccaggtcccaggctcctcactccgacggtgcactccaccgaggggccacgtggaaacttcccgagcccgtaagggtttccaaggttcggcctagggttcggggtcctaggggacaggtacctttctccgtctcaaccatcaagcaacgtcctggaccacggtctacgggtaacgttacgtttacgtacttaacggttttactttaccgttacggttacacggtactaaacgttaaaacgtaaaaacgttcggtaaccgttacgttaacggttttcggaccggtaacggggaacccaacgtcgtaggtaacagtaccgtaacgacgtaaacgtgtacggctacgaaccgtacacttacgtcgtttacctcgtaccgtttcccg

SEQ ID NO: 310051 - DNA, 679 bp, Homo sapiens
  misc_feature: GZ8MTXP02GY2B4.25.64.F09.1.454.CMB.2.raw
  modified_base (662)..(662): a, c, t, g, unknown or other
  misc_feature (662)..(662): n is a, c, g, or t
tcagactgtacagtcacgaccggtgctcgatttagcgcgtatacaagggggaggaactgctcagttaggacccagacggaaccatggaagccccagcgcagcttctcttcctcctgctactctggcctcccagattccactggagaaatgtgatgacgcagtctccagcccaccctgtctgtgtctccgaggggacagacgcccaccctctcctgcgagggccagtcagagtattagcgactaacttagcctaggtaccagaccaaggaaacccgtcggacccgtaacggggtccccaggtccctccctacacgtcccgacggtcaccacctcccgaccgacgggcccagtacggtaaccttcccgaagtccgtacggttcgagggtgacgtacggggtcggtcgtgggaactacgtccttccgtccgttaccacgaccctatccgagccgacgtcctagaccgtagtcgtaggtacgtttatttcgtacgtttagtttacgttacgtcgtactagaacgttaaagttaaaacgtaaaccggttcggtaaacccgttacgttacgggtttacccggaaacgggtaacgggtaacctaacggtccgtaaggaactagtacggaaacgtacgtacgtcgacgtcacgaactacgtacgttcgtntacctcgtacttccccg

SEQ ID NO: 310052 - DNA, 533 bp, Homo sapiens
  misc_feature: GZ8MTXP02FGIS3.25.64.F09.1.454.CMB.2.raw
tcagactgtacagtcacgaccggtgctcgatttagcgcgtatacaagggggaggaactgctcagttaggacccagacggaaccatggaagccccagcgcagcttctcttcctcctgctactctggctcccagattccactggagaaatagtgatgacgcagtctccagccaccctgtctgtgtctccaggggacagagccaccctctcctgcagggccagtcagagtattagcggcaacttagcctggtaccagcagaaacctggccagggtcccaggctcctcatccaggtgcatccaccagggccactggaacttccagccaggttcagtggcaggtgggtctggggacaggtaccttctcctctcacctatcagcagcctgcagtctgacgtatttgtctagtttattactgtactagacaagtaataaaacgtggaccgtacgtacgtttggaccgtacggggaaccagtcgtaggacagtcaacgacgaacgtgtacgcgtcgaacacactctcgttctcacttcccg

SEQ ID NO: 310053 - DNA, 671 bp, Homo sapiens
  misc_feature: GZ8MTXP02JF2M6.25.64.F09.1.454.CMB.2.raw
tcagactgtacagtcacgaccggtgctcgatttagcgcgtatacaagggggaggaactgctcagttaggacccagacggaaccatggaagccccagcgctgcttctcttcctcctgctactctggctcccagattccactggaagaaatagtgatgacgcagtctccagccaccctgtctgtgtcctccgaggggaccagacgcccaccctctcctgcgagggccaggtcagagtattagcggactaacttgcctggtaccagcagaacctggccgaggtcccaggcctcctcactccgacgtcgcactccaccgagggccctagtacggtaacttcccgagtccgtacggttcgaggtcgggtacgtagggttcggggtacgtagggactaggtaccttcgtcgtcctaccgacgactacgaacgcgacgccgtcgacctagttcctaggtacgtttagtttcgacgtttaacgtttacgtcttacgtactacgtacgtaaagttaaacgttaaaacgtcggtacccgttagttacggtttacggaacggtacgggaaccgtaggcgtacggtacgtacgtacgaacggtaacgtacggtcggtacggtcctacgtaacctaaacccgtacgtttccgtacgtttcccgtttacgttaccgtttcccccg

SEQ ID NO: 310054 - DNA, 648 bp, Homo sapiens
  misc_feature: GZ8MTXP02HPLXA.25.64.F09.1.454.CMB.2.raw
  modified_base (207)..(207): a, c, t, g, unknown or other
  misc_feature (207)..(207): n is a, c, g, or t
  modified_base (274)..(274): a, c, t, g, unknown or other
  misc_feature (274)..(274): n is a, c, g, or t
  modified_base (278)..(278): a, c, t, g, unknown or other
  misc_feature (278)..(278): n is a, c, g, or t
  modified_base (289)..(289): a, c, t, g, unknown or other
  misc_feature (289)..(289): n is a, c, g, or t
tcagactgtacagtcacgaccggtgctcgatttagcgcgtatacaagggggaggaactgctcagttaggacccagacggaaccatggaagccccagcgcagcttctcttcctctgctactctggctcccagattccactggagaaatagtgatgacgcagtctccagccacctgtctgtgtctccgagggacagagccaccctctcngcagggccagtcagtagtatagcgactaatacgctaggaccagcagaacctggccacggtccaggcncctnactccaggtcnctactcccgaccgtagggccctagtacggaactccgagtcctagggttcaggtggaccgtagggtcgggtagtacggggactacggtacctttccgcctcctaccgaccctatcgaacggtcaccgtccgtacgccgtacgttcgtagtacgttactttacgtacgttacgtttaacgttacgttcgtacgagtactaaggttaaacgtaaacgttaccgggtacgttacgttacgtttacgggaccgtacgggaaactaggtacgtacggaacgtacgtacggaacggtaccgaagtacggtcggtacgaccgtaactaacgtacgttcttaacggttcctaccggttactttccccg

SEQ ID NO: 310055 - DNA, 497 bp, Homo sapiens
  misc_feature: GZ8MTXP01BMFNC.3.86.H09.1.454.CMB.2.raw
  modified_base (485)..(485): a, c, t, g, unknown or other
  misc_feature (485)..(485): n is a, c, g, or t
  modified_base (487)..(497): a, c, t, g, unknown or other
  misc_feature (487)..(497): n is a, c, g, or t
tcagagacgcactccacgaccggtgctcgatttagtgctatagacttgggtttgggattcacgttgcagatgtaggtctgggtgcgacaggctcctggaaaagggcttgagtggatgggaggttttgatcctgaagagcgtgaaagaatctacgcacagaatttccagggcagagtcaacatgaccgaggacacatccacagacacatcctacatggagttgaccagcctgagatctgaagacacgccgtgtattatgtgcaacagtcgcggctagcgcagcggccctgatgctttgatatctgggcccagggacattggtcacccgtctcttcagcctccacaagggcccatcggcttccccctggcacccgtcctccaagacgcacctcgtgggggcacacgccgcccgtgggctgccgtggtcaagggactacgttcccgagtcgcgtctcctggacgcggggctgggcaaagggcgcgaangnnnnnnnnnnn

SEQ ID NO: 310056 - DNA, 562 bp, Homo sapiens
  misc_feature: GZ8MTXP02H5X4F.3.86.H09.1.454.CMB.2.raw
  modified_base (533)..(533): a, c, t, g, unknown or other
  misc_feature (533)..(533): n is a, c, g, or t
  modified_base (552)..(562): a, c, t, g, unknown or other
  misc_feature (552)..(562): n is a, c, g, or t
tcagagacgcactccacgaccggtgctcgatttagtgctatagacttgggtttgggattcacgttgcagatgtaggtctgggtgcgacaggctcctggaaaagggcttgagtggatgggaggttttgatcctgaagagcgtgaaagaatctacgcacagaatttccagggcagagtcaacatgaccgaggacacatccacagacacatcctacatggagttgaccagcctgagatctgaagacacggccgtgtattatgtgcaacagtcgcgctagcgcagccggccctgatgtcttttgattagtcgtcggggcccagggactagttggtccaccccgtctcttcacgtccctccgaccgacgggcccctagtcccggttcccttccccccgtcggccctaccccctccctacccaaacgcgcccacccgtcgtcgggggccacgacgcccggcccgtgggcctcggtcccgtcggttaccgaacgggtacctaccgtttccggacgtcgcgtcgtcgtggacggcggtcgnggcgaacggcgcactacgnnnnnnnnnnn

SEQ ID NO: 310057 - DNA, 326 bp, Homo sapiens
  misc_feature: GZ8MTXP02IBU4H.3.86.H09.1.454.CMB.2.raw
  modified_base (322)..(326): a, c, t, g, unknown or other
  misc_feature (322)..(326): n is a, c, g, or t
tcagagacgcactccacgaccggtgctcgatttagtgctatagacttgggtttggggaagtagtccttgaccagcctgagatctgaagacacggccgtgtattattgtgcaacagtcgcggctagcgcagcgggccctgatgcttttgatatctggggcccagggacattggtcaccgtctcttcagcctccaccaagggcccatcggtcttccccctggcaccctcctccaagagcacctctgggggcacagcggccctgggctgcctggtcaaggactacttccgagtgcgtctctgagcgggctggcaaggcgcatagnnnnn

SEQ ID NO: 310058 - DNA, 592 bp, Homo sapiens
  misc_feature: GZ8MTXP02F12B6.3.86.H09.1.454.CMB.2.raw
  modified_base (579)..(579): a, c, t, g, unknown or other
  misc_feature (579)..(579): n is a, c, g, or t
  modified_base (581)..(582): a, c, t, g, unknown or other
  misc_feature (581)..(582): n is a, c, g, or t
  modified_base (584)..(585): a, c, t, g, unknown or other
  misc_feature (584)..(585): n is a, c, g, or t
  modified_base (587)..(588): a, c, t, g, unknown or other
  misc_feature (587)..(588): n is a, c, g, or t
  modified_base (590)..(592): a, c, t, g, unknown or other
  misc_feature (590)..(592): n is a, c, g, or t
tcagagacgcactccacgaccggtgctcgatttagtgctatagacttgggtttgggattcacgttgcagatgtaggtctgggtgcgacaggctcctggaaaagggcttgagtggatgggaggttttgatcctgaagagcgtgaaagaatctacgcacagaatttccagggcagagtcaacatgaccgaggacacatccacagacacatcctacatggagttgaccagcctgagatctgaagacacggccgtgtattattgtgcaacagtcgcggctagcgcagcgggcctgatgcttttgatatcgtggggcccagggacagttcggtcaccccgtctcttcacgtccctacccgaccgacggggccccagttccggttcccttccccccgtggccctaccccctccctacccaacgacgccaccctccgtcgggggccacgacggcccgggcccgtcggggccgtcggcccgtcgggtaccgaaacgggtaccgttaaccgttcccggagttcggtccgttcctcgtggacgggccggggtcgtcggggaccgaaacggggccgacgtaacgtacggngnngnncnncnnn

SEQ ID NO: 310059 - DNA, 738 bp, Homo sapiens
  misc_feature: GZ8MTXP02JSDTR.3.86.H09.1.454.CMB.2.raw
  modified_base (278)..(278): a, c, t, g, unknown or other
  misc_feature (278)..(278): n is a, c, g, or t
  modified_base (718)..(718): a, c, t, g, unknown or other
  misc_feature (718)..(718): n is a, c, g, or t
  modified_base (720)..(720): a, c, t, g, unknown or other
  misc_feature (720)..(720): n is a, c, g, or t
  modified_base (730)..(730): a, c, t, g, unknown or other
  misc_feature (730)..(730): n is a, c, g, or t
  modified_base (733)..(733): a, c, t, g, unknown or other
  misc_feature (733)..(733): n is a, c, g, or t
  modified_base (736)..(736): a, c, t, g, unknown or other
  misc_feature (736)..(736): n is a, c, g, or t
tcagagacgcactccacgaccggtgctcgatttagtgctatagacttgggtttgggattcacgttgcagatgtaggtctgggtgcgacaggctcctggaaaagggcttgagtggatgggaggtttttgatcctgaagagcgtgaaagaatctacgcacagtaatttccagggcagagtcaacatgaccgaggacacatccacagacacatcctacatggagttgaaccagcctgagatctagaaagaccgacggcgtgttacttaagttgtcgcaaancgtcgcggactagcgcgaggccggtccctagacgtgttcgttttgaacttagtcggttccggggccccgaagggtacctagtttcggtccgtacccccgttccttccttaccgaccgcccttacccccgaacccgaaccgggggtccccctaaggttcccccggttcccccttccccccgtcgggtaccccctaccccccttccctaacccgaaaccggtaccgacccctacccgtcgggtaccgggggccaaaccgccgggccccgggtccccgttggggtacccgttccggtcccggttaacgggtacccggtaaaacggttcccgtttaaacccggttcccggtaaggttcccgtccggttccgtcggttaccgggaccggggtccgggttacccgtcggggtacccggaaacgggggccctaccgaaacgttcggngngcgcgacgcngcncgncg

SEQ ID NO: 310060 - DNA, 533 bp, Homo sapiens
  misc_feature: GZ8MTXP01BFTA9.51.78.H01.1.454.CMB.2.raw
  modified_base (262)..(262): a, c, t, g, unknown or other
  misc_feature (262)..(262): n is a, c, g, or t
tcagcgatcgtatacacgaccggtgctcgatttagtgtgagtagtttgggtttgggcacgaccggtgctcgatttagtgtgagtagtttgggtttggggaggagtcagtctcagtcaggacacagcatggacatgagggtccccgctcagctcctggggctcctgctactctggctccgaggtgccagatgtgacatccagatgacccagtctccatcctcctgtctgcatctgtaggagacagagtcacatcactgccggnaagtcagagcattagcagcttatttaaatggtatcagcagagaccgaaggaaacgcccctaaactccctagatctatgaatcgcatccaaagtttggaaagtcgggtaccatctaagtcagtgacagtgatgtgggacagtattcactcgtcacctatcagcgagtgtacgcgtaacctaggtaactatttcgacttaaacttacttacgtaggtacaaacgttagacgttaacacgtaacccctcacgttctccgttaacgttaaccggg

SEQ ID NO: 310061 - DNA, 577 bp, Homo sapiens
  misc_feature: GZ8MTXP01DZF07.51.78.H01.1.454.CMB.2.raw
  modified_base (260)..(260): a, c, t, g, unknown or other
  misc_feature (260)..(260): n is a, c, g, or t
tcagcgatcgtatacacgaccggtgctcgatttagtgtgagtagtttgggtttggggggagaggagccccagccctgagattcccaggtgtttccattcagtgatcagcactgaacacagaggactcaccatggagttgggactgagctggtattttcctttggctattttaaaaggtgtccagtgtgaagtgctactggtggagtcgtgggggagcctggtacagcctggcaggtccctgagctctcctgtgcagcctntggattcactttgatgattatgccatgcacgtgggtccgcaagctccgaggggaaggcctggagtgggtctcacgttattagtggaatggtggtagtatagcctatggcgtactcgtgtggaaggggcctattcaccatctccagaacgaacaaccgaccaaacgaacctccctgtactctaggacaaagtgaacgagtctagagaacgcgtaggaacggaccgaacgggtcctttaggttactttaccgttgaccgaacaaaaacgcccgaaagggaaccaaaacggcgtacgtacgttactaacgttaagtaacg

SEQ ID NO: 310062 - DNA, 512 bp, Homo sapiens
  misc_feature: GZ8MTXP01D61D4.51.78.H01.1.454.CMB.2.raw
  modified_base (333)..(333): a, c, t, g, unknown or other
  misc_feature (333)..(333): n is a, c, g, or t
tcagcgatcgtatacacgaccggtgctcgatttagtgtgagtagtttgggtttggggctctgggagaggagccccagccctgagattcccaggtgtttccattcagtgatcagcactgaacacagaggactcaccatggagttgggactgagctggattttcctttggctattttaaaaggtgtccagtgtgaagtgctactggtggagtcgtgggggaggcctggtacagcctggcaggtccctgagactctcctgtgcagcctctggattcacctttgatgattatgccatgcacgtggtccgcaagctcgagggaggctggagtggtctnacgtattagtggaatagtgtaagatgctatgcgactgtgtgaggcgatcacatctacagagacaacgccaagaacctccctaggtatctgacaaatgaaacagtctgagagctggaagcgacggtccttagtacttacttgcgaacaaaacgccaaaggccaacagtccgttggtaacc

SEQ ID NO: 310063 - DNA, 566 bp, Homo sapiens
  misc_feature: GZ8MTXP01BQ81X.51.78.H01.1.454.CMB.2.raw
  modified_base (243)..(243): a, c, t, g, unknown or other
  misc_feature (243)..(243): n is a, c, g, or t
  modified_base (515)..(515): a, c, t, g, unknown or other
  misc_feature (515)..(515): n is a, c, g, or t
  modified_base (541)..(541): a, c, t, g, unknown or other
  misc_feature (541)..(541): n is a, c, g, or t
tcagcgatcgtatacacgaccggtgctcgatttagtgtgagtagtttgggtttgggcacgaccggtgctcgatttagtgtgagtagtttgggtttgggaggagtcagtctcagtcaggacacagcatggacatgagggtccccgctcagctcctggggctcctgctactctggctccgaggtgccagatgtgacatccagatgacccagtctccatcctcctgtctgcatctgtagagacagngtcacatcactgccggacagtcagagctattagcagtactttaatttaaagttggtaatcgagacaaggacgaaccgaagggaaaccgtaccccctaacctcccctagactactatgaatcgcatacctaaagttagggaaacggtcgggtacccatacgtaaggtcaggtgacgaggtggatcgtagggacagtattcactctacacactcgagcagtgtacgccgtactagaagttgtttaacacttaacttacttactcgtaacaacgngttaacgttaaccgacttaacccctnacgttcctcgttaacgtttccgggg

SEQ ID NO: 310064 - DNA, 568 bp, Homo sapiens
  misc_feature: GZ8MTXP01EBNRO.51.78.H01.1.454.CMB.2.raw
  modified_base (261)..(261): a, c, t, g, unknown or other
  misc_feature (261)..(261): n is a, c, g, or t
  modified_base (538)..(538): a, c, t, g, unknown or other
  misc_feature (538)..(538): n is a, c, g, or t
tcagcgatcgtatacacgaccggtgctcgatttagtgtgagtagtttgggtttggggggagaggagccccagccctgagattcccaggtgtttccattcagtgatcagcactgaacacagaggactcaccatggagttgggactgagctggattttccttttggctattttaaaaggtgtccagtgtgaagtgctactggtggagtcgtgggggagcctggtacagcctggcaggtccctgagactctcctgtgcagcctntggattcacctttgatgattatgccatgcacgtgggtccgcaagctccgaggggaacgggcctgggagtgggtctcgacgttattaggtggaataggtggtagtatagccctatgcggtactcgtggtagaacggggcctattcaccatctaccagagaacaacgcaacgaacctccctgtatctggactaaatgaacagtctgagagctaggacggtacgacgggtcctttggttattaccgttgaccgaacaaaaacggccaaagggccaaacgngcgtacgggttactaacttaaagttaacgg

SEQ ID NO: 310065 - DNA, 535 bp, Homo sapiens
  misc_feature: GZ8MTXP01D0MLT.51.78.H01.1.454.CMB.2.raw
  modified_base (455)..(455): a, c, t, g, unknown or other
  misc_feature (455)..(455): n is a, c, g, or t
tcagcgatcgtatacacgaccggtgctcgatttagtgtgagtagtttgggtttggggaggagtcagtctcagtcaggacacagcatggacatgagggtccccgctcagctcctggggctcctgctactctggctccgaggtgccagatgtgacatccagatgacccagtctccatccctccctgtctgcatctgtaggagacagagtcaccatcacttgccgggcaagtcagagcattagcagcttaattaaattggtatcagcagagaccagggaaacgcccctaactcctgatctatgatgcatctaattggaaagtcgggtaccatcgaagttcaagtgcagtggatcgtagggacagtacttcactctacactatcagctagtgtcgacgtactagtaagtattttagactaaacttactactgtaccaatagtacttacacgtacccctnaacgtccttacgtacgtttcgggacggacgggaaccgagggttggaagtactaacgaaacgacgttggtaacgcgtaacg

SEQ ID NO: 310066 - DNA, 525 bp, Homo sapiens
  misc_feature: GZ8MTXP01D1ZRY.51.78.H01.1.454.CMB.2.raw
  modified_base (283)..(283): a, c, t, g, unknown or other
  misc_feature (283)..(283): n is a, c, g, or t
  modified_base (308)..(308): a, c, t, g, unknown or other
  misc_feature (308)..(308): n is a, c, g, or t
  modified_base (363)..(363): a, c, t, g, unknown or other
  misc_feature (363)..(363): n is a, c, g, or t
tcagcgatcgtatacacgaccggtgctcgatttagtgtgagtagtttgggtttgggcacgaccggtgctcgatttagtgtgagtagtttgggtttgggcacgaccggtgctcgatttagtgtgagtagtttgggtttggggaggagtcagtctcagtcaggacacagcatggacatgagggtccccgctcagctccgtggggctcctgctactctggctccgaggtgccagatgtgacatccagatgacccagtcctcatccctcctgtctgcatctgtaganacagagtcaccatcacttgccgganaagtcagagcattagcagcttaattaaatggtatcagacagcgacaagggaaacncccctaactctagactctatgatgacatactaagtttaggaaagtcgggtacccatacgtaaggttcgaaggtggactaggtgatcgtggaactagtacttcactctaacacttatcagcagttgttcgacgtaactagaatatttgactaacgttctaacg

SEQ ID NO: 310067 - DNA, 505 bp, Homo sapiens
  misc_feature: GZ8MTXP01C8WU0.51.78.H01.1.454.CMB.2.raw
  modified_base (199)..(199): a, c, t, g, unknown or other
  misc_feature (199)..(199): n is a, c, g, or t
  modified_base (438)..(438): a, c, t, g, unknown or other
  misc_feature (438)..(438): n is a, c, g, or t
tcagcgatcgtatacacgaccggtgctcgatttagtgtgagtagtttgggtttggggaggagtcagtctcagtcaggacacagcatggacatgagggtccccgctcagctcctggggctcctgctactctggctccgaggtgccagatgtgacatccagatgacccagtctccatcctccctgtctgcatctgtagganacagagtcaccatcacttgccgggcaagtcagagcattagcagctattaaatggtatcagcagagacaggaaacgcccctaactcctgatctatgatgcatcaatttggaagtcgggtccatcaaggtcaagtgcagtgatcgtgggacagatttcactctcacatcagcagtgtgcgactagaagttagttttagactaaacttactactgtacaacagtacgttacacgtacccctnaacgtcttctacgttcggacggagggaaccgagggttacggaagataacaaacgtacttgtggctcg

SEQ ID NO: 310068 - DNA, 605 bp, Homo sapiens
  misc_feature: GZ8MTXP01C0DDL.51.78.H01.1.454.CMB.2.raw
  modified_base (145)..(145): a, c, t, g, unknown or other
  misc_feature (145)..(145): n is a, c, g, or t
  modified_base (217)..(217): a, c, t, g, unknown or other
  misc_feature (217)..(217): n is a, c, g, or t
  modified_base (258)..(258): a, c, t, g, unknown or other
  misc_feature (258)..(258): n is a, c, g, or t
  modified_base (317)..(317): a, c, t, g, unknown or other
  misc_feature (317)..(317): n is a, c, g, or t
  modified_base (342)..(342): a, c, t, g, unknown or other
  misc_feature (342)..(342): n is a, c, g, or t
tcagcgatcgtatacacgaccggtgctcgatttagtgtgagtagtttgggtttgggcacgaccggtgctcgatttagtgtgagtagtttgggtttgggaggagtcagtctcagtcaggacacagcatggacatgagggtccccgntcagctctggggctcctgctactctggctccgaggtgccagatgtgacatccagatgaccagtctccatccncctgtctgcatctgtaggagacagagtcacatcatgccggnaagtcagagcattagcagcttaattaaatcggtaatcagcaagagtaaccagggaaacncccctaaacgtcccctagatctaangaactgcactactaaagttaaggtaaaggtacgggtacgactacgtaacgtacgtagtaggacgtagtaggtagtacgtacggtacgtagtacttactactacgtactaacctaactacacgtacgtacgtacgtacgtacgtaaccgtacgtaagttaagtttaacgttaacgttaacttaacttacgttacgtaacgttaacgttaacgttacgttaacgtaaccgtaaccctacctacgttactccgttaacgttaacgg

SEQ ID NO: 310069 - DNA, 512 bp, Homo sapiens
  misc_feature: GZ8MTXP01CEM8C.51.78.H01.1.454.CMB.2.raw
  modified_base (276)..(276): a, c, t, g, unknown or other
  misc_feature (276)..(276): n is a, c, g, or t
  modified_base (385)..(385): a, c, t, g, unknown or other
  misc_feature (385)..(385): n is a, c, g, or t
  modified_base (441)..(441): a, c, t, g, unknown or other
  misc_feature (441)..(441): n is a, c, g, or t
tcagcgatcgtatacacgaccggtgctcgatttagtgtgagtagtttgggtttggggaggagtcagtctcagtcaggacacagcatggacatgagggtcccgctcagctcctggggctcctgctactctggctccgaggtgccagatgtgacatccagatgacccagtctccatcctccctgtctgcatctgtaggagacagagtcaccatcacttgccgggcaagtcagagcattagcagctaattaaatggtatcagcagagaccagggaaacncccctaactcctgatctatgatgcatcaagtttggaaagtcgggtccatcgaagttcaagtggcagtgggatcgtagggacagtatttcactctcaccatcagcagtgngcgactgaagtatttcgactaacttactatgtacaacagtattacacgtacccctnaacgtcttcacgtttcggacgggacggacgaggttcggaagattaaccgaaaagtacgtttggcttgaacc

SEQ ID NO: 310070 - DNA, 520 bp, Homo sapiens
  misc_feature: GZ8MTXP01CFB62.51.78.H01.1.454.CMB.2.raw
  modified_base (309)..(309): a, c, t, g, unknown or other
  misc_feature (309)..(309): n is a, c, g, or t
  modified_base (369)..(369): a, c, t, g, unknown or other
  misc_feature (369)..(369): n is a, c, g, or t
tcagcgatcgtatacacgaccggtgctcgatttagtgtgagtagtttgggtttgggcacgaccggtgctcgatttagtgtgagtagtttgggtttgggcacgaccggtgctcgatttagtgtgagtagtttgggtttggggaggagtcagtctcagtcaggacacagcatggacatgagggtccccgctcagctcctggggctcctgctactctggctccgaggtgccagatgtgacatccagatgacccagtctccatccctcctgtctgcatctgtacggagacagagtcacccatcacttgccggnaagtcagagcattagcagtacttaatttaaatggtatcagcaagaagaccaagggaaacncccctaaactcctgactctatgatgcatacaagtttggaaagtgggtacccatacgaagttcgagtggcaggtgatcgtgggactagtattcactctcaaccatcgagctagttgttcgcgtaactgaactatttgactaacgttaataac

SEQ ID NO: 310071 - DNA, 563 bp, Homo sapiens
  misc_feature: GZ8MTXP01BXN60.51.78.H01.1.454.CMB.2.raw
  modified_base (309)..(309): a, c, t, g, unknown or other
  misc_feature (309)..(309): n is a, c, g, or t
tcagcgatcgtatacacgaccggtgctcgatttagtgtgagtagtttgggtttgggcacgaccggtgctcgatttagtgtgagtagtttgggtttgggcacgaccggtgctcgatttagtgtgagtagtttgggtttggggaggagtcagtctcagtcaggacacagcatggacatgagggtccccgctcagctcctggggctcctgctactctggctccgaggtgccagatgtgacatccagatgacccagtctccatccctccctgtctgcatctgtaggagacagagtcaccatcacttgccgganaagtcagagcattagcagtcttaatttaaatggtatcagacaagaacgaccgaaggggaaacctccccctaaactcctagactctatgatgactatacctaaagtttggaaacggtcgggtaccctagtacgtaaggttcaaggtggacaggtgtatcgtaggacagtattcactctcaaccttatccgagacgtagttcggttcgaccgtaaccgtagtaacgttagtttcgacctaacgtttaaccgtaacg

SEQ ID NO: 310072 - DNA, 545 bp, Homo sapiens
  misc_feature: GZ8MTXP01ALS9Q.51.78.H01.1.454.CMB.2.raw
  modified_base (407)..(407): a, c, t, g, unknown or other
  misc_feature (407)..(407): n is a, c, g, or t
  modified_base (420)..(420): a, c, t, g, unknown or other
  misc_feature (420)..(420): n is a, c, g, or t
tcagcgatcgtatacacgaccggtgctcgatttagtgtgagtagtttgggtttggggaggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagcttaattaaattggtatcagcagagaccaagggaaacgcccctaacctcctgatctatgatgcatactaagtttggaaagttcggggtacccagtacgtaaggttcaaggtggcagggtaggatcgtagggactagtactttccactctcacctatcagcagtgngcgaactgaagtnttttgacctaactttactactagtacaaacgtagtacttaccacgtacccctgaacgtcttcgtacgttcgggacggtaagggaccgttagggttgaagactaacgaaacgacttggtcggctcg

SEQ ID NO: 310073 - DNA, 565 bp, Homo sapiens
  misc_feature: GZ8MTXP01D6UYF.51.78.H01.1.454.CMB.2.raw
  modified_base (264)..(264): a, c, t, g, unknown or other
  misc_feature (264)..(264): n is a, c, g, or t
  modified_base (320)..(320): a, c, t, g, unknown or other
  misc_feature (320)..(320): n is a, c, g, or t
  modified_base (480)..(480): a, c, t, g, unknown or other
  misc_feature (480)..(480): n is a, c, g, or t
  modified_base (542)..(542): a, c, t, g, unknown or other
  misc_feature (542)..(542): n is a, c, g, or t
tcagcgatcgtatacacgaccggtgctcgatttagtgtgagtagtttgggtttgggcacgaccggtgctcgatttagtgtgagtagtttgggtttggggaggagtcagtctcagtcaggacacagcatggacatgagggtccccgctcagctcctggggctcctgctactctggctccgaggtgccagatgtgacatccagatgacccagtcctccatccctcctgtctgcatctgtaggagacagagtcacatcactgccggnaagtcagagcattagcagtcttaatttaaatggtatcagcagagaccaagggaacncccctaactccctgatctatgaatgcattaccgtaaagtttacgggaaaggtcggggtaccctaagtacgtaaggttcaggtggacaggttggatcgtagggactagtatttacactctacacctatcagtcgagtgtacgcgtaaccgtagtaaagttnttttaacgaacttaacttacttactacgtacaaacgttagttacgttaacacgttaaccctnacgttctccgttaacggttcggg

SEQ ID NO: 310074 - DNA, 535 bp, Homo sapiens
  misc_feature: GZ8MTXP01DMGMT.51.78.H01.1.454.CMB.2.raw
  modified_base (347)..(347): a, c, t, g, unknown or other
  misc_feature (347)..(347): n is a, c, g, or t
  modified_base (359)..(359): a, c, t, g, unknown or other
  misc_feature (359)..(359): n is a, c, g, or t
tcagcgatcgtatacacgaccggtgctcgatttagtgtgagtagtttgggtttgggcacgaccggtgctcgatttagtgtgagtagtttgggtttgggcacgaccggtgctcgatttagtgtgagtagtttgggtttggggaggagtcagtctcagtcaggacacagcatggacatgagggtccccgctcagctcctgggctcctgctactctggctccgaggtgccagatgtgacatccagatgacccagtcctccatcctccctgtctgcatctgtaggagacagagtcaccatcacttgccggcaagtcagagcattagcagcttaattaaatgtatcagcagngacagggaaacncccctaactctgatctatgatgacatacctaagtttagggaaagtcggggtacccagtaccgtaaagggtttcaaggtggactaggtgatcgtggggaactaggtactttcacttcaacaccatcagtcaaggttgttcgcgtaaccgtgaagttatttcgactaactttctaacg

SEQ ID NO: 310075 - DNA, 658 bp, Homo sapiens
  misc_feature: GZ8MTXP01BEVLN.51.78.H01.1.454.CMB.2.raw
  modified_base (319)..(319): a, c, t, g, unknown or other
  misc_feature (319)..(319): n is a, c, g, or t
tcagcgatcgtatacacgaccggtgctcgatttagtgtgagtagtttgggtttgggcacgaccggtgctcgatttagtgtgagtagtttgggtttggggaggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcactgccggcaagtcagagcattagcagcttaatttaaatggtatcagcagagaccagggaaacncccctaactccctagatctatcgaaatgcataccgtaaagtttagggaaaggttcgggggtaccccaaagttccgtaaagggtttcaaggtggactaggttacggaattccgtaggggactaaggtacttttaccaaccttcgttaccaaccctattacccgaagcctaagggttcgttacggaccgtaacccgttaggtaaacgttagtttttcgaaccttaaaccttttaccttaacgttacggtaaccttaaaaccgttaggttaaaccgtttaaccaacccggttaaccccctcgtaacggttcccttaaccgttaaccggttttaacccggggg

SEQ ID NO: 310076 - DNA, 589 bp, Homo sapiens
  misc_feature: GZ8MTXP01BNPEE.51.78.H01.1.454.CMB.2.raw
  modified_base (282)..(282): a, c, t, g, unknown or other
  misc_feature (282)..(282): n is a, c, g, or t
  modified_base (306)..(306): a, c, t, g, unknown or other
  misc_feature (306)..(306): n is a, c, g, or t
  modified_base (345)..(345): a, c, t, g, unknown or other
  misc_feature (345)..(345): n is a, c, g, or t
  modified_base (357)..(357): a, c, t, g, unknown or other
  misc_feature (357)..(357): n is a, c, g, or t
tcagcgatcgtatacacgaccggtgctcgatttagtgtgagtagtttgggtttgggcacgaccggtgctcgatttagtgtgagtagtttgggtttgggcacgaccggtgctcgatttagtgtgagtagtttgggtttggggaggagtcagtctcagtcaggacacagcatggacatgagggtccccgctcagctcctggggctcctgctactctggctccgaggtgccagatgtgacatccagatgacccagtctccatcctcctgtctgcatctgtagganacagatcaccatcacttgccgganaagtcagagcattagcagtctaatttaatgatcagcagnaccagggaaacncccctaactctagactctatgatgcatacctaagttttaggaaacggttcgggtaccctaagtacgtaaacgggtttcaagggttcggcctaaggttcgggattccggttaggggaacctaggtaacttttccaccttcctcaacccttaattccgaggcctaaggttgttcggacccggttaacctagggtaaaccgttctttttagacccttaaaccgtttaactaaccg

SEQ ID NO: 310077 - DNA, 555 bp, Homo sapiens
  misc_feature: GZ8MTXP01BFLL1.51.78.H01.1.454.CMB.2.raw
  modified_base (278)..(278): a, c, t, g, unknown or other
  misc_feature (278)..(278): n is a, c, g, or t
  modified_base (467)..(467): a, c, t, g, unknown or other
  misc_feature (467)..(467): n is a, c, g, or t
tcagcgatcgtatacacgaccggtgctcgatttagtgtgagtagtttgggtttggggaggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagcttaattaaatggtatcagcagagaccagggaaacncccctaactcctgatctatgatgctatccaagtttggaaagtcgggtacccatcgaaggttcaaggtgctaggtgatcgtaggggacagtactttcactctacacatcagcaggtgtgacgtacctagtaacgttattttcgacttaaaccttactactcgtacaactagtacgttacacgtacccctnaacgtcttcgtacgtttcgggacgggaacggaccgttaggggttacgaaggtaactaacgaaaacggacgttacggtcgggctaaccg

SEQ ID NO: 310078 - DNA, 568 bp, Homo sapiens
  misc_feature: GZ8MTXP01EL1RF.51.78.H01.1.454.CMB.2.raw
  modified_base (188)..(188): a, c, t, g, unknown or other
  misc_feature (188)..(188): n is a, c, g, or t
  modified_base (282)..(282): a, c, t, g, unknown or other
  misc_feature (282)..(282): n is a, c, g, or t
  modified_base (310)..(310): a, c, t, g, unknown or other
  misc_feature (310)..(310): n is a, c, g, or t
  modified_base (373)..(373): a, c, t, g, unknown or other
  misc_feature (373)..(373): n is a, c, g, or t
  modified_base (395)..(395): a, c, t, g, unknown or other
  misc_feature (395)..(395): n is a, c, g, or t
tcagcgatcgtatacacgaccggtgctcgatttagtgtgagtagtttgggtttgggcacgaccggtgctcgatttagtgtgagtagtttgggtttgggcacgaccggtgctcgatttagtgtgagtagtttgggtttggggaggagtcagtctcagtcaggacacagcatggacatgagggtccccgntcagctcctggggctcctgctactctggctccgaggtgccagatgtgacatccagatgacccagtctccatccctcctgtctgcatctgtaganacagagtcaccatcacgttgacccgganaagtcagagacattacgcagtcttaatttaaatgtatcagaacagaacgaccgaagggaaacncccctaactctagactactatnatgactaatacctaaagtttacgggaaacggttcggggtacccaagttaccgtaaaggttcgaaggttcggactaggtggaatcgtagggactagtacttcaactctaaccacgatcgacgctagttgttcgactaacctagtaacgttctttcgactaacgttaacgtaacg

SEQ ID NO: 310079 - DNA, 628 bp, Homo sapiens
  misc_feature: GZ8MTXP01EB1SQ.51.78.H01.1.454.CMB.2.raw
  modified_base (319)..(319): a, c, t, g, unknown or other
  misc_feature (319)..(319): n is a, c, g, or t
tcagcgatcgtatacacgaccggtgctcgatttagtgtgagtagtttgggtttgggcacgaccggtgctcgatttagtgtgagtagtttgggtttggggaggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcacatcactgccggcaagtcagagcaattagcagcttaatttaaatggtatcagcagagaccaaggaaacncccctaacctccctgatctatgaatgcatacccgtaaagtttacgggaaagttcgggggtaccctaagtaccgtaaagggtttcgaggttagggacgtaggttagggtaacgttcgttaggggaacctaaggtaacttttaccaaccttaccgtactaaccctaataccgaacgtccgaaggttggtcgaccgtaaccgttagtaaagttattttaacggaccttaaacgtttaaccttacctagtacaaacgttagttaacgttaacacgttaacccctgacgttcctcgttaacggtttaaccgggg

SEQ ID NO: 310080 - DNA, 508 bp, Homo sapiens
  misc_feature: GZ8MTXP01C7R53.51.78.H01.1.454.CMB.2.raw
  modified_base (275)..(275): a, c, t, g, unknown or other
  misc_feature (275)..(275): n is a, c, g, or t
  modified_base (438)..(438): a, c, t, g, unknown or other
  misc_feature (438)..(438): n is a, c, g, or t
tcagcgatcgtatacacgaccggtgctcgatttagtgtgagtagtttgggtttggggaggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctattaaatggtatcagcagagacagggaaacncccctaactcctgatctatgatgcatccaatttggaaagtcgggaccatcaagttcaagtgcagtgatcgtgggacagtattcactctacaccatcagcagtgtgcgactagaagtattttgactaacttactactgtacaacagacgttacacgtacccctnaacgtcttctacgtttcgggcggagggaccgagggttaggaagataacgaaacgacgttgtcggctaacg

SEQ ID NO: 310081 - DNA, 532 bp, Homo sapiens
  misc_feature: GZ8MTXP01EMBAR.51.78.H01.1.454.CMB.2.raw
  modified_base (360)..(360): a, c, t, g, unknown or other
  misc_feature (360)..(360): n is a, c, g, or t
tcagcgatcgtatacacgaccggtgctcgatttagtgtgagtagtttgggtttgggcacgaccggtgctcgatttagtgtgagtagtttgggtttgggcacgaccggtgctcgatttagtgtgagtagtttgggtttggggaggagtcagtctcagtcaggacacagcatggacatgagggtccccgctcagctcctggggctcctgctactctggctccgaggtgccagatgtgacatccagatgacccagtctcatcctcctgtctgcatctgtagagacagagtcaccatcacttgccggcaagtcagagcattagcagctaatttaaatgtatcagcagaacaccaaggggaaacncccctaaactcctagactctatcgatgacatacctaatttggaaagtgggtacccatacaaggttcaagtgacagtgatcgtagggacagtcttacacttctctaaccattcgaacgctaaggttgttcgaccgtaacctgaacgttatttcgacttaacgttaactaaccg

SEQ ID NO: 310082 - DNA, 536 bp, Homo sapiens
  misc_feature: GZ8MTXP01EGE9M.51.78.H01.1.454.CMB.2.raw
  modified_base (276)..(276): a, c, t, g, unknown or other
  misc_feature (276)..(276): n is a, c, g, or t
tcagcgatcgtatacacgaccggtgctcgatttagtgtgagtagtttgggtttggggaggagtcagtctcagtcaggacacagcatggacatgagggtccccgctcagctcctggggctcctgctactctggctccgaggtgccagatgtgacatccagatgacccagtctccatccctccctgtctgcatctgtaggagacagagtcaccatcacttgccgggcaagtcagagcattagcagctaattaaatggtatcagcagagacaggaaacncccctaactctgatctatgatgcataccaagtttggaaagtcgggacccatcgtaagttcaagttgcagtgatcgtagggacagtattcactctacacatcagctagtgtcgacgtactagaacgttagtttagactaaacttactactagtacaacagtaacgttaaccacgtacccctcaacgtcttacgtacgtttcgggacgggtaacgggaccgagggttaggaagaataacgaaacgtacgttgtcggctaacg

SEQ ID NO: 310083 - DNA, 551 bp, Homo sapiens
  misc_feature: GZ8MTXP01DI6D4.51.78.H01.1.454.CMB.2.raw
  modified_base (225)..(225): a, c, t, g, unknown or other
  misc_feature (225)..(225): n is a, c, g, or t
  modified_base (254)..(254): a, c, t, g, unknown or other
  misc_feature (254)..(254): n is a, c, g, or t
  modified_base (319)..(319): a, c, t, g, unknown or other
  misc_feature (319)..(319): n is a, c, g, or t
  modified_base (361)..(361): a, c, t, g, unknown or other
  misc_feature (361)..(361): n is a, c, g, or t
tcagcgatcgtatacacgaccggtgctcgatttagtgtgagtagtttgggtttgggcacgaccggtgctcgatttagtgtgagtagtttgggtttgggcacgaccggtgctcgatttagtgtgagtagtttgggttggggaggagtcagtctcagtcaggacacagcatggacatgagggtccccgctcagctcctggggctcctgctactctggctccgaggtnccagatgtgacatccagatgacccagtcnccatccctcctgtctgcatctgtagagacagatcaccatcacttgccggcaagtcagagcattancagtactaatttaaatggtatcagcagcgaccaggggaaacncccctaactctagatctatgatgacatacctaaagtttagggaaagttcggggtacccagtacgaaggtttacgaggttggactaggtgatcgtagggacagtactttcacttctaacacttatacgagcgtagttcgttcgaccgtaaccctaagtaacgttatttacgacctaacgtttaacctaacg

SEQ ID NO: 310084 - DNA, 525 bp, Homo sapiens
  misc_feature: GZ8MTXP01CWL7M.51.78.H01.1.454.CMB.2.raw
  modified_base (276)..(276): a, c, t, g, unknown or other
  misc_feature (276)..(276): n is a, c, g, or t
  modified_base (449)..(449): a, c, t, g, unknown or other
  misc_feature (449)..(449): n is a, c, g, or t
  modified_base (495)..(495): a, c, t, g, unknown or other
  misc_feature (495)..(495): n is a, c, g, or t
tcagcgatcgtatacacgaccggtgctcgatttagtgtgagtagtttgggtttggggaggagtcagtctcagtcaggacacagcatggacatgagggtccccgctcagctcctggggctcctgccactctggctccgaggtgccagatgtgacatccagatgacccagtctccatcctcctgtctgcatctgtaggagacagagtcaccatcacttgccgggcaagtcagagcattagcagctattaaatggtatcagcagagaccaagggaaacncccctaactcctgatctatgatgcataccaagtttggaaagtcgggtaccatcgaaggttcaagtgcagtggatcgtgggacagtattcactctcacatcagctagtgtgcgactagaagttagtttcgacttaacttactactgtacaactagtagttaccacgtacccctnaacgtccttctacgtttcgggacggtacgggaaccgaggttggaanataacgaaaacgtacgttggtcggctaacg

SEQ ID NO: 310085 - DNA, 678 bp, Homo sapiens
  misc_feature: GZ8MTXP01AVNT6.51.78.H01.1.454.CMB.2.raw
  modified_base (328)..(328): a, c, t, g, unknown or other
  misc_feature (328)..(328): n is a, c, g, or t
tcagcgatcgtatacacgaccggtgctcgatttagtgtgagtagtttgggtttgggcacgaccggtgctcgatttagtgtgagtagtttgggtttggggaggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcactgccgggcaagtcagagcaattagcagtacttaatttaaattggtaatcagcagacgaccgaagggaaacncccctaacctcccagtatctatgaatcgctataccgtaaagtttacgggaaacggtcggggtaccctaagtaccgtaaaggttccgaagggtggacgtagggtacggaacttcggtacggggaactaggttaacttttccaaccttccgttaccgaaaccctacttaccgaacggtacctaagggttcggttaccggacccggttaaacccgttaggttaaaccgttagtttttaaccggaaccttaaacgtttaaccttaacgttacgtaaacttaaacgttcgttaaaccgttaaccacccgttaacccctagaccgttccttaaccgttaaccggtttaaccggggg

SEQ ID NO: 310086 - DNA, 533 bp, Homo sapiens
  misc_feature: GZ8MTXP01D4ZD0.51.78.H01.1.454.CMB.2.raw
  modified_base (349)..(349): a, c, t, g, unknown or other
  misc_feature (349)..(349): n is a, c, g, or t
  modified_base (362)..(362): a, c, t, g, unknown or other
  misc_feature (362)..(362): n is a, c, g, or t
tcagcgatcgtatacacgaccggtgctcgatttagtgtgagtagtttgggtttgggcacgaccggtgctcgatttagtgtgagtagtttgggtttgggcacgaccggtgctcgatttagtgtgagtagtttgggtttggggaggagtcagtctcagtcaggacacagcatggacatgagggtccccgctcagctcctggggctcctgctactctggctccgaggtgccagatgtgacatccagatgacccagtctccatccctccctgtctgcatctgtaggagacagagtcacatcacttgccgggcaagtcagagcattagcagcttatttaaatgtatcagacagngaccagggaaacncccctaactcctagactctatgatgcatacctaagtttagggaaagtcggggtacccatacgtaaaggtttcgaaggttggacaggtggatcgtagggacagtatttcactctcaccatcagcaggttgttcgacgaacctaggaagttatttcgactaactttaactaac

SEQ ID NO: 310087 - DNA, 673 bp, Homo sapiens
  misc_feature: GZ8MTXP01BW3YD.51.78.H01.1.454.CMB.2.raw
  modified_base (260)..(260): a, c, t, g, unknown or other
  misc_feature (260)..(260): n is a, c, g, or t
tcagcgatcgtatacacgaccggtgctcgatttagtgtgagtagtttgggtttggggggagaggagccccagccctgagattcccaggtgtttccattcagtgatcagcactgaacacagaggactcaccatggagttgggactgagctggtattttcctttggcttattttaaaaggtgtccagtgtgaagtgctatggtggagtcgtggggagcctggtacagcctggcaggtccctgagactctcctgtgcagcctntggattcactttgatgattatcgccagtgctacgtggggtccgcaaacggccgtaccgaagggggaacgggcctagggagttcggggtctacgtaacgttattaggttaggaaattaggtaggtagtatacggaccttaagtcggacggtactcgtaggtaggaaacggggccctaattccacctaactacctacccgaaaggaacgaaaccgaaaccggacccaaaacggaaacccttaccccgtagttaacttaccgttaggggaaacctaaaattacgaaacctaagtccgtaaggagaacggtcgtaagggacggaccgtaaccgggtcctttaaggttactttacgacgacgaacgaaaaacgcccaaagggaacaacaacgtactacggttactaacttaagtaacg

SEQ ID NO: 310088 - DNA, 525 bp, Homo sapiens
  misc_feature: GZ8MTXP01DSZEJ.51.78.H01.1.454.CMB.2.raw
  modified_base (306)..(306): a, c, t, g, unknown or other
  misc_feature (306)..(306): n is a, c, g, or t
  modified_base (430)..(430): a, c, t, g, unknown or other
  misc_feature (430)..(430): n is a, c, g, or t
  modified_base (459)..(459): a, c, t, g, unknown or other
  misc_feature (459)..(459): n is a, c, g, or t
tcagcgatcgtatacacgaccggtgctcgatttagtgtgagtagtttgggtttggggtctctgggagaggagccccagccctgagattcccaggtgtttccattcagtgatcagcactgaacacagaggactcaccatggagttgggactgagctggattttccttttggctattttaaaaggtgtccagtgtgaagtgctactggtggagtctgggggagcctggtacagcctggcaggtccctgagactctcctgtgcagcctctggattcactttgatgattatgccatgcacgtgggtccgnaagctccgaggggaggcctgggagtgggtctcacgtattaggtggaatagtggtaatatgcctatgcggactctgtagaagggccgattcacatctaccagacacaacgaccaaagaactcccnggtaactctagacaaatagaacagttacngagagctggaacgacacggtccttgtattacttgcgacaaaagcaaggccaagagtcgttggtaac

SEQ ID NO: 310089 - DNA, 537 bp, Homo sapiens
  misc_feature: GZ8MTXP01CWWEF.51.78.H01.1.454.CMB.2.raw
  modified_base (278)..(278): a, c, t, g, unknown or other
  misc_feature (278)..(278): n is a, c, g, or t
  modified_base (432)..(432): a, c, t, g, unknown or other
  misc_feature (432)..(432): n is a, c, g, or t
  modified_base (453)..(453): a, c, t, g, unknown or other
  misc_feature (453)..(453): n is a, c, g, or t
tcagcgatcgtatacacgaccggtgctcgatttagtgtgagtagtttgggtttggggaggagtcagtctcagtcaggacacagaatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctaatttaaatggtatcagcagagaccagggaaacncccctaactcctgatctatgatgcatcaatttaggaaagtgggtcccccatcgaaggttcaggtgcaaggtgatcgtgggacagtatttcactctacacatcagcagtgtgcgactagtaaagtattttaggactaacttactactagtacaanagtacgttacacgtacccctnacgtctacgcgtttccggacggtaaacgggaccgaagggttcggaagaattaaccgaaagtaacgtggttacgtcgttcgaacc

SEQ ID NO: 310090 - DNA, 562 bp, Homo sapiens
  misc_feature: GZ8MTXP01BGEDN.51.78.H01.1.454.CMB.2.raw
  modified_base (278)..(278): a, c, t, g, unknown or other
  misc_feature (278)..(278): n is a, c, g, or t
tcagcgatcgtatacacgaccggtgctcgatttagtgtgagtagtttgggtttggggaggagtcagtctcagtcaggacacagcatggacatgagggtccccgctcagctcctggggctcctgctactctggctccgaggtgccagatgtgacatccagatgacccagtcctccatccctccctgtctgcatctgtaggagacagagtcaccatcacttgccgggcaagtcagagcattagcagctattaaatggtatcagcagagaccaaggaaacncccctaactcctgatctatgatgacatacctaagtttggaaagtccggggtacccagtcaaggttcaaggtgctagtggatcgtagggactagtactttcactctcaccatcagctagtgtgcgactagtaacgttattttacgacttaacttacttacgtgttacccaagtaaggtacttaacaccggtaccccctgtaacgtccttacgtacgtttcgggacgggtaacgggaccgaagggttcggaatacgtcggaaaacctagttcggttcgcgttaacg

SEQ ID NO: 310091 - DNA, 576 bp, Homo sapiens
  misc_feature: GZ8MTXP01DXICR.51.78.H01.1.454.CMB.2.raw
  modified_base (226)..(226): a, c, t, g, unknown or other
  misc_feature (226)..(226): n is a, c, g, or t
  modified_base (284)..(284): a, c, t, g, unknown or other
  misc_feature (284)..(284): n is a, c, g, or t
  modified_base (310)..(310): a, c, t, g, unknown or other
  misc_feature (310)..(310): n is a, c, g, or t
  modified_base (370)..(370): a, c, t, g, unknown or other
  misc_feature (370)..(370): n is a, c, g, or t
tcagcgatcgtatacacgaccggtgctcgatttagtgtgagtagtttgggtttgggcacgaccggtgctcgatttagtgtgagtagtttgggtttgggcacgaccggtgctcgatttagtgtgagtagtttgggtttggggaggagtcagtctcagtcaggacacagcatggacatgagggtccccgctcagctcctggggctcctgctactctggctccgaggtnccagatgtgacatccagatgacccagtcctccatccctcctgtctgcatctgtagganacagagtcaccatcacttggccgganaagtcagagcattagcagtcttaatttaaatgtatcagacagaacgaccaagggaaaccncccctaactctagatctatgatgactatacctaagtttacggaaagttcgggtacccagtaccgtaaagggtttcaaggttggacctaggtggaactcgtaggggaaacctgttaactttcaacttctaacaaccttagtaccaagtcaaggttcgttcgaccgtaacctaggtaagttactttcgacttaaaccgttcgttaacg

SEQ ID NO: 310092 - DNA, 571 bp, Homo sapiens
  misc_feature: GZ8MTXP01BU47Q.51.78.H01.1.454.CMB.2.raw
  modified_base (199)..(199): a, c, t, g, unknown or other
  misc_feature (199)..(199): n is a, c, g, or t
  modified_base (276)..(276): a, c, t, g, unknown or other
  misc_feature (276)..(276): n is a, c, g, or t
  modified_base (388)..(388): a, c, t, g, unknown or other
  misc_feature (388)..(388): n is a, c, g, or t
  modified_base (402)..(402): a, c, t, g, unknown or other
  misc_feature (402)..(402): n is a, c, g, or t
  modified_base (462)..(462): a, c, t, g, unknown or other
  misc_feature (462)..(462): n is a, c, g, or t
tcagcgatcgtatacacgaccggtgctcgatttagtgtgagtagtttgggtttggggaggagtcagtctcagtcaggacacagcatggacatgagggtccccgctcagctcctggggctcctgctactctggctccgaggtgccagatgtgacatccagatgacccagtctccatcctccctgtctgcatctgtagganacagagtcaccatcacttgccgggcaagtcagagcattagcagctaattaaatggtatcagcagagaccaggaaacncccctaactcctgatctatgatgcatcctaagtttggaaagtcgggtacccatacgaagttcaagtgcgagtggatcgtagggactagtattcactctcacatcagcagtgngcacgtagaagttnttttagactaaactttactactacgtacaaacgtaagtacgtttaaccacgtaccccctnaacggtccttacgtaacggtttccgggacgggaacgggttaacccgaaggggttacggaagttaacgtaaccgaaaaaaccggacgtttgggaaccgggttctaaccgg

SEQ ID NO: 310093 - DNA, 577 bp, Homo sapiens
  misc_feature: GZ8MTXP01BOSFG.51.78.H01.1.454.CMB.2.raw
  modified_base (525)..(525): a, c, t, g, unknown or other
  misc_feature (525)..(525): n is a, c, g, or t
  modified_base (551)..(551): a, c, t, g, unknown or other
  misc_feature (551)..(551): n is a, c, g, or t
tcagcgatcgtatacacgaccggtgctcgatttagtgtgagtagtttgggtttggggggagaggagccccagccctgagattcccaggtgtttccattcagtgatcagcactgaacacagaggactcaccatggagttgggactgagctggattttccttttggctattttaaaaggtgtccagtgtgaagtgctactggtggagtcgtgggggaggcctggtacagcctggcaggtccctgagactctcctgtgcagcctctggattcacctttgatgattatgccatgcactgggtccgcaagctccgaggggaaggcctgggagtggtctacacgttattaggttggaataggtggtagtatagcctaatggcgtactgtggtaggaacggggcccgtattccaacctatctaccaaggacgaacaaacgaccaaagaaacctccctagtactctacggactaaaatgaaactagtcctagagaagccgtaggaaggtaccacgggtccttgttacttacgngacgacaaaagcccgaaaggccaacngtctaggttactccgttaattaacgg

SEQ ID NO: 310094 - DNA, 669 bp, Homo sapiens
  misc_feature: GZ8MTXP01BYMOB.51.78.H01.1.454.CMB.2.raw
  modified_base (509)..(509): a, c, t, g, unknown or other
  misc_feature (509)..(509): n is a, c, g, or t
tcagcgatcgtatacacgaccggtgctcgatttagtgtgagtagtttgggtttgggcacgaccggtgctcgatttagtgtgagtagtttgggtttggggaggagtcagtctcagtcaggacacagcatggacatgagggtccccgctcagctcctggggctcctgctactctggctccgaggtgccagatgtgacatccagatcgacccagtcctccactcctcctgtctgcatctgtaggagacagagtccactatcctacgtcggccggacaagtcagacgctaagttagactagtactttaaatttaaagttggtaactacgagacaaggaacgaaccgaaacgggaaaccctacccctaaacccttccgtagtactactatagaactcgctaactaccgttaaagtttacggggaaacgggttccggggtaccctagttacggtaaacgttcgaggtggacgtagggtagtacttcggaggactagtacttacacttcactactnacgacgcgtaggttgaccgtacgtaaccgtaagggtaaacgttttctttaacgaaacctttaaccgtttaacgttacgttaacgtaacgttaaacgttacgttaaccgtaacctacccgtaaccctacgtaccgttccttaaccgttaacgggtaacggg

SEQ ID NO: 310095 - DNA, 593 bp, Homo sapiens
  misc_feature: GZ8MTXP01DDHTV.51.78.H01.1.454.CMB.2.raw
  modified_base (328)..(328): a, c, t, g, unknown or other
  misc_feature (328)..(328): n is a, c, g, or t
  modified_base (493)..(493): a, c, t, g, unknown or other
  misc_feature (493)..(493): n is a, c, g, or t
tcagcgatcgtatacacgaccggtgctcgatttagtgtgagtagtttgggtttgggcacgaccggtgctcgatttagtgtgagtagtttgggtttggggaggagtcagtctcagtcaggacacagcatggacatgagggtccccgctcagctcctggggctcctgctactctggctccgaggtgccagatgtgacatccagatgacccagtcctccatccctccctgtctgcatctagtaggagacagagtcacatcactgccgggcaagtcagagcattagcagtacttaatttaaattggtatcagcaagagaccgaagggaaacncccctaacctcccctgatctaatcgaattcgctaataccctaaagtttacgggaaaagtcgggggtacccaatacgtaagttcaggtggacaggtgatcgtgggacagtactttacaccttctacacctatacacgtacaggtgtacgcgtaacctagtaacgtnttttaacgaaccttaaacttacttacgtagtacaaacgttacgttaacgttaacaaccgtaacccttacgacgttacctcgttaacggtttaacccgggg

SEQ ID NO: 310096 - DNA, 574 bp, Homo sapiens
  misc_feature: GZ8MTXP01A6AKS.51.78.H01.1.454.CMB.2.raw
  modified_base (306)..(306): a, c, t, g, unknown or other
  misc_feature (306)..(306): n is a, c, g, or t
tcagcgatcgtatacacgaccggtgctcgatttagtgtgagtagtttgggtttggggctctgggagaggagccccagccctgagattcccaggtgtttccattcagtgatcagcactgaacacagaggactcaccatggagttgggactgagctggtattttccttttggctattttaaaaggtgtccagtgtgaagtgctactggtggagtcgtgggggagcctggtacagcctggcaggtccctgagactctcctgtgcagcctctggattcactttgatgattatgccatgcacgtggtccgnaagctccgaggggacgggcctgggagtgggtctcgacgttattaggttaggaataggtggtaaagtatggcctaagtcggcggtacttcgtggtaggaacgggccctattccacatctaccagacgacaacgccaaagacctcccgtggtactcgtagactaaatgaaactagtctaggagagtctggaacggacttacgggtcctttaggtacttacgcgcgaaacgaaaacgccgaaagggcccaaagcggtcgttaagggtaacc

SEQ ID NO: 310097 - DNA, 631 bp, Homo sapiens
  misc_feature: GZ8MTXP01B9CFX.51.78.H01.1.454.CMB.2.raw
  modified_base (325)..(325): a, c, t, g, unknown or other
  misc_feature (325)..(325): n is a, c, g, or t
tcagcgatcgtatacacgaccggtgctcgatttagtgtgagtagtttgggtttgggcacgaccggtgctcgatttagtgtgagtagtttgggtttggggaggagtcagtctcagtcaggacacagcatggacatgagggtccccgctcagctcctgggctcctgctactctggctccgaggtgccagatgtgacatccagatgacccagtctccatccctccctgtctgcatctgtaggagacagagtcacatcactgccggcaagtcagagcattagcagtcttaatttaaattggtaatcagcaagacgaccgaagggaaacncccctaacctccctagatctatgaaatcgctaactaccgtaaagttttacggggaaaaggttccgggggtaccccaaagttaccgtaaaggttcgaagggtggaccgtaaggtgggtaacttcgtagggaacctagtaactttccaacttcgtacaacctataccgagacctagtcgtacgaccgtaccgtagtaaacgttagttttaacgacttaaactttacacgttacgtaacttaaacgttacgttaacgtttaaccaccgttaaccccttcgagttccttaacgttccggtttaaccgggg

SEQ ID NO: 310098 - DNA, 574 bp, Homo sapiens
  misc_feature: GZ8MTXP01CTNXW.51.78.H01.1.454.CMB.2.raw
  modified_base (199)..(199): a, c, t, g, unknown or other
  misc_feature (199)..(199): n is a, c, g, or t
  modified_base (279)..(279): a, c, t, g, unknown or other
  misc_feature (279)..(279): n is a, c, g, or t
  modified_base (379)..(379): a, c, t, g, unknown or other
  misc_feature (379)..(379): n is a, c, g, or t
tcagcgatcgtatacacgaccggtgctcgatttagtgtgagtagtttgggtttggggaggagtcagtctcagtcaggacacagcatggacatgagggtccccgctcagctcctggggctcctgctactctggctccgaggtgccagatgtgacatccagatgacccagtctccatcctccctgtctgcatctgtagganacagagtcaccatcacttgccgggcaagtcagagcattagcagcttattaaattggtatcagcagagaccaagggaaacncccctaacctcctgatctatgatgctatacctaagtttggaaagtcggggtcccatcgaaggttcaaggtgcagtggatcgtgggactagtattcactcnctacatcagctagtgtcgcgacgtagaagttatttgacttaacttactactcgtacaaacgtacgtaacgttaaccaccgtacccctgaacgtccttacgttaacgtttcggggaccgggtaacgggttaacccgttaaaggggttggaaacgaagtaaccgtaaaacggtaacgttcggtaacgttcgtaaccg

SEQ ID NO: 310099 - DNA, 515 bp, Homo sapiens
  misc_feature: GZ8MTXP01CA8IK.51.78.H01.1.454.CMB.2.raw
  modified_base (443)..(443): a, c, t, g, unknown or other
  misc_feature (443)..(443): n is a, c, g, or t
tcagcgatcgtatacacgaccggtgctcgatttagtgtgagtagtttgggtttggggaggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctattaaatggtatcagcagagaccagggaaacgcccctaacctctgatctatgatgcatccaatttggaaagtcgggtccatcaaggttcaagtggcagtggatcgtgggacagtactttcactctcaccatcagcagtgtgcgactgaagtattttgactaacttactactgtacaacagtacgttacacgtacccctnaacgtcttctacgtttcgggacggagggaccgagggttcggaagataacgaaacgacgttggtaaggcgtcg

SEQ ID NO: 310100 - DNA, 533 bp, Homo sapiens
  misc_feature: GZ8MTXP01DA3HA.51.78.H01.1.454.CMB.2.raw
  modified_base (275)..(275): a, c, t, g, unknown or other
  misc_feature (275)..(275): n is a, c, g, or t
  modified_base (284)..(284): a, c, t, g, unknown or other
  misc_feature (284)..(284): n is a, c, g, or t
  modified_base (458)..(458): a, c, t, g, unknown or other
  misc_feature (458)..(458): n is a, c, g, or t
tcagcgatcgtatacacgaccggtgctcgatttagtgtgagtagtttgggtttggggaggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctaattaaatggtatcagcagagacaggaaacncccctaacnctgatctatgatgacatacctaaagtttggaaagttcggggtcccatcgaaggttcaaaggtgcagtggatcgtaggggacagtattcactctcacatcagcagtgtcgacgacctagtaaagtattttcgaactaactttaactactgtacaacaagtacttacacgtacccnaacgcttcgtacgttcggacgggaaggttaccgaagggttcgaagaacgtaacgaaacgacgttggtgcgtaacg

SEQ ID NO: 310101 - DNA, 743 bp, Homo sapiens
  misc_feature: GZ8MTXP01ARB5B.51.78.H01.1.454.CMB.2.raw
  modified_base (226)..(226): a, c, t, g, unknown or other
  misc_feature (226)..(226): n is a, c, g, or t
  modified_base (313)..(313): a, c, t, g, unknown or other
  misc_feature (313)..(313): n is a, c, g, or t
tcagcgatcgtatacacgaccggtgctcgatttagtgtgagtagtttgggtttgggcacgaccggtgctcgatttagtgtgagtagtttgggtttgggcacgaccggtgctcgatttagtgtgagtagtttgggtttggggaggagtcagtctcagtcaggacacagcatggacatgagggtccccgctcagctcctggggctcctgctactctggctccgaggtnccagatgtgacatccagatcgaccagtcctccatcctcctgtctgcatctagagagacagagtacaccatcctacgttcggccgganaacggtcaaggaacgactaatttaggacctagtacctttaattttaaagtggtaatccaagacaaggaacgtaaccgaaacggggtaaaccctcccccgttaaaccgtcctagtacttaccttaagtcggtaatcggtactaaacgttaacccgttaaaggtttacggggtaaaacgggttcccggggttaacccctaaaggttaccgttaaacggggtttaccgtaaacggggttacggtacccgtaagggttaacggtaacggttacccgttaaggggggtaaccttaacgggttaacctttttacccgaacgttaccccttaacccgaaccttacgtaccgttaacggtaccgtaagggttacgttacggacccgtaaccgttaggtaaagtttacgtttaggaaccctttaacgttaaccgtaacg

SEQ ID NO: 310102 - DNA, 563 bp, Homo sapiens
  misc_feature: GZ8MTXP01A380Y.51.78.H01.1.454.CMB.2.raw
  modified_base (278)..(278): a, c, t, g, unknown or other
  misc_feature (278)..(278): n is a, c, g, or t
  modified_base (473)..(473): a, c, t, g, unknown or other
  misc_feature (473)..(473): n is a, c, g, or t
tcagcgatcgtatacacgaccggtgctcgatttagtgtgagtagtttgggtttggggaggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctattaaatggtatcagcagacgaccgagggaaacncccctaaactcctagatctatgatgctatctaagtttggaaacgttccggggtaccctagtcgaaaggttcaaaggttggcgaggtggatcgtagggacagtatttcatctcaccatcagctagtgtgcgtactagaaagtttgtttacactaacttactactcgtacaagtagtactaaccgtaccgtcccctntaacgtccttacgtaccggttccgggacgggtaacgggttaccggaagggttaggaacgtataaccgaaacggtacgttaggtcgcgtcg

SEQ ID NO: 310103 - DNA, 583 bp, Homo sapiens
  misc_feature: GZ8MTXP01C7X0A.51.78.H01.1.454.CMB.2.raw
  modified_base (200)..(200): a, c, t, g, unknown or other
  misc_feature (200)..(200): n is a, c, g, or t
  modified_base (284)..(284): a, c, t, g, unknown or other
  misc_feature (284)..(284): n is a, c, g, or t
tcagcgatcgtatacacgaccggtgctcgatttagtgtgagtagtttgggtttggggaggagtcagtctcagtcaggacacagcatggacatgagggtccccgctcagctcctggggctcctgctactctggctccgaggtgccagatgtgacatccagatgacccagtcctccatcctccctgtctgcatctgtagganacagagtcaccatcacttgccgggacaagtcagagcattagcagtcttaattaaatggtatcagcagacgaccaagggaaaccncccctaactctagatctatgattgactattacctaaagtttggaaacggttccggggtacccagtcgtaaaggttcaagggttgcgtagtggatcgtagggactagtactttcacttcacaccatccgagtcgtagttgcgacgtactagtaagttagttttacaacttaaacttactatcgtaacaacgtagtacttacctacctacccctaatcgtcttacggtcggttacgggaacgggacgggaacgttagggttacgaagtaacgtaaccgaaacgtgttcggtaacgcgtaag

SEQ ID NO: 310104 - DNA, 541 bp, Homo sapiens
  misc_feature: GZ8MTXP01AOCII.51.78.H01.1.454.CMB.2.raw
  modified_base (279)..(279): a, c, t, g, unknown or other
  misc_feature (279)..(279): n is a, c, g, or t
  modified_base (304)..(304): a, c, t, g, unknown or other
  misc_feature (304)..(304): n is a, c, g, or t
  modified_base (361)..(361): a, c, t, g, unknown or other
  misc_feature (361)..(361): n is a, c, g, or t
tcagcgatcgtatacacgaccggtgctcgatttagtgtgagtagtttgggtttgggcacgaccggtgctcgatttagtgtgagtagtttgggtttgggcacgaccggtgctcgatttagtgtgagtagtttgggtttggggaggagtcagtctcagtcaggacacagcatggacatgagggtccccgctcagctcctgggctcctgctactctggctccgaggtgccagatgtgacatccagatgacccagtctccatcctcctgctgcatctgtaganacagagtcaccatcacttcgcgganagtcagagcattagcagcttaattaaatggtatcagaacagcgaacgagggaaaccncccctaatctagatactatggatcgacatacctaagttaggaacgtcgggtacccaagtacgtaaggttcgagtcgacgtagtgatcgtagggactagtacttacactcgaacacgatcgaagctaagttcgttgaccgtaactaggtaacttagtttacgaccttaacgttaactaacg

SEQ ID NO: 310105 - DNA, 628 bp, Homo sapiens
  misc_feature: GZ8MTXP01D8IBM.51.78.H01.1.454.CMB.2.raw
  modified_base (398)..(398): a, c, t, g, unknown or other
  misc_feature (398)..(398): n is a, c, g, or t
tcagcgatcgtatacacgaccggtgctcgatttagtgtgagtagtttgggtttgggcacgaccggtgctcgatttagtgtgagtagtttgggtttgggcacgaccggtgctcgatttagtgtgagtagtttgggtttggggaggagtcagtctcagtcaggacacagcatggacatgagggtccccgctcagctccgtggggctcctgctactctggctccgaggtgccagatgtgacatccagatcgacccagtcctccatccctccctgtcctgcatctagtaggagacagactcaccatcacgttggccggacaagtcaagagactattacgactagtacctttaatttaaagtgtaactcgaagaacaagaacgaaaccgaaacggggaaaccncccctaaactccgtatactactacgtagtatagactacttaaaccgtaacgttaacggtaacggtacggtaccgtacgtacggtaacgttacgtacggtacgtacgtaggtaggtacgtacgtacggtaacgtacgtacttactaactacttacctacacgtacgtacgacgttacgttacgtaacgtacgtaacgtaacgtaacgttacgtttaacgttaacgttaacg

SEQ ID NO: 310106 - DNA, 602 bp, Homo sapiens
  misc_feature: GZ8MTXP01AY59B.51.78.H01.1.454.CMB.2.raw
  modified_base (324)..(324): a, c, t, g, unknown or other
  misc_feature (324)..(324): n is a, c, g, or t
  modified_base (500)..(500): a, c, t, g, unknown or other
  misc_feature (500)..(500): n is a, c, g, or t
tcagcgatcgtatacacgaccggtgctcgatttagtgtgagtagtttgggtttgggcacgaccggtgctcgatttagtgtgagtagtttgggtttggggaggagtcagtctcagtcaggacacagcatggacatgagggtccccgctcagctcctggggctcctgctactctggctccgaggtgccagatgtgacatccagatgacccagtcctccatcctcctgtctgcatctgtaggagacagagtcaccatcacgtgccgggcaagtcagagcattagcagtcttaatttaaatggtatcagcagacgaccgagggaaacncccctaactcctgatctatgaatcgcactaccgtaaagtttagggaaacgggttcggggtaccctaataccgtaaaggttcaaggtggactaggtacggacttcgtaggggactagtactttcaaccttctacacctatccgagcaggtcgtacgacccgtacgtagtaaacgttnttttaacgaccttaaacttacttacgtagtaacaacgttacggttacgttaacaccgttaaccccctagtacgttccttaacgttaaccggtttaaccgggg

SEQ ID NO: 310107 - DNA, 651 bp, Homo sapiens
  misc_feature: GZ8MTXP01EXJFR.51.78.H01.1.454.CMB.2.raw
  modified_base (240)..(240): a, c, t, g, unknown or other
  misc_feature (240)..(240): n is a, c, g, or t
  modified_base (332)..(332): a, c, t, g, unknown or other
  misc_feature (332)..(332): n is a, c, g, or t
  modified_base (524)..(524): a, c, t, g, unknown or other
  misc_feature (524)..(524): n is a, c, g, or t
tcagcgatcgtatacacgaccggtgctcgatttagtgtgagtagtttgggtttgggcacgaccggtgctcgatttagtgtgagtagtttgggtttggggaggagtcagtctcagtcaggacacagcatggacatgagggtccccgctcagctcctggggctcctgctactctggctccgaggtgccagatgtgacatccagatgacccagtctccatcctcctgtctgcatctgtagganacagagtcaccatcactgccggcaagtcagagcattagcagactaatttaaatggtatcagcaagagacaaggaaacgccccctaaactccngatctatgaatgctataccgtaaagtttacgggaaaagttcgggggtacccctaagtacgtaaacggttcaaggtcgggactagggtaggagttccgtaggggtaaccagtaacttttaccaccttccgtaactaaccctattaccgaacgtcctaacggttgtacggtaccgtaccgttagtaaacggttnttttaacgaccttaaactttaaccttaacgttaacgtaacgttaaaacgttacggttaaccgtttaaccctaacgttaacccccttacggaaccgttcctaacccgtttaacggtttaacccggggg

SEQ ID NO: 310108 - DNA, 538 bp, Homo sapiens
  misc_feature: GZ8MTXP01AQILL.51.78.H01.1.454.CMB.2.raw
  modified_base (198)..(198): a, c, t, g, unknown or other
  misc_feature (198)..(198): n is a, c, g, or t
  modified_base (223)..(223): a, c, t, g, unknown or other
  misc_feature (223)..(223): n is a, c, g, or t
  modified_base (232)..(232): a, c, t, g, unknown or other
  misc_feature (232)..(232): n is a, c, g, or t
  modified_base (274)..(274): a, c, t, g, unknown or other
  misc_feature (274)..(274): n is a, c, g, or t
  modified_base (416)..(416): a, c, t, g, unknown or other
  misc_feature (416)..(416): n is a, c, g, or t
  modified_base (466)..(466): a, c, t, g, unknown or other
  misc_feature (466)..(466): n is a, c, g, or t
tcagcgatcgtatacacgaccggtgctcgatttagtgtgagtagtttgggtttggggaggagtcagtctcagtcaggacacagcatggacatgagggtccccgctcagctcctggggctcctgctactctggctccgaggtgccagatgtgacatccagatgacccagtctccatcctcctgtctgcatctgtagganacagagtcaccatcacttgccgggnaagtcagancatagcagctaattaaatggtatcagcagagacgaggaaacncccctaactcctagatctatgatcgacatacctaaagtttaggaaacgtccggggtacccagtcgaaaggttcaagttggcaggtggatcgtgggacagtactttcactctacaccatcagctagtgtcgcgactagaagtntttacgacttaaacttactactgtacaactagtacgttacacgtaccctnaacgcttcgtacgttcggacgggaacggttacgaggttcgaagataaccgaaacgtacttggtcggctaacg

SEQ ID NO: 310109 - DNA, 573 bp, Homo sapiens
  misc_feature: GZ8MTXP01DUTJI.51.78.H01.1.454.CMB.2.raw
  modified_base (236)..(236): a, c, t, g, unknown or other
  misc_feature (236)..(236): n is a, c, g, or t
  modified_base (414)..(414): a, c, t, g, unknown or other
  misc_feature (414)..(414): n is a, c, g, or t
  modified_base (481)..(481): a, c, t, g, unknown or other
  misc_feature (481)..(481): n is a, c, g, or t
  modified_base (512)..(512): a, c, t, g, unknown or other
  misc_feature (512)..(512): n is a, c, g, or t
tcagcgatcgtatacacgaccggtgctcgatttagtgtgagtagtttgggtttgggcacgaccggtgctcgatttagtgtgagtagtttgggtttgggcacgaccggtgctcgatttagtgtgagtagtttgggtttggggaggagtcagtctcagtcaggacacagcatggacatgagggtccccgctcagctccgtggggctcctgctactctggctccgaggtgccagatgtnacatccagatcgacccagtcctcactccctcctgtctgcatctagtaggagacaggactcaaccatctaacgttcggaccggtacaagtcagagctattagacagtactttaaatttaaagttgtactcagaacaagaacgaaccgaaagggaaaccctacccctaaactctagactntatgatgactatactaaagtttggaaacgtcggtaccagtcaaaggttcaagtcgatagtgacttgnggaactagtattcctaactctaaccaacttntcgaagccgtaagttgttcgaccgtaactagtaagttactttacaacttaacttcgtaacg

SEQ ID NO: 310110 - DNA, 612 bp, Homo sapiens
  misc_feature: GZ8MTXP01A7Y5P.51.78.H01.1.454.CMB.2.raw
  modified_base (201)..(201): a, c, t, g, unknown or other
  misc_feature (201)..(201): n is a, c, g, or t
  modified_base (226)..(226): a, c, t, g, unknown or other
  misc_feature (226)..(226): n is a, c, g, or t
tcagcgatcgtatacacgaccggtgctcgatttagtgtgagtagtttgggtttggggaggagtcagtctcagtcaggacacagcatggacatgagggtccccgctcagctcctggggctcctgctactctggctccgaggtgccagatgtgacatccagatgacccagtcctccatccctccctgtctgcatctgtagganacagagtcaccatcacttgccgggnaagtcagagcattagcagtacttaattaaatggtatcagcgagagaccgaaggaaacgcccctaacctcctagatctatgatgacattacctaaagtttaggaaacggttccggggtaccctagttacgtaaacgggttcaaagggttcgggcgagggtagggtatccggtaggggaactagttactttccaacttcctacaaccattaccgaagctaaggttgtacgacgtaaccgtagtaaacgttattttacgacttaaactttactaactcgtaacaagtaagtacgttaactaccgtaccctgaacgtcttacgtacgttccgggacggaacgggaacgagggttaggaacgactaacgaaaccgtagttggtcgctaacg

SEQ ID NO: 310111 - DNA, 596 bp, Homo sapiens
  misc_feature: GZ8MTXP01AE1Y1.51.78.H01.1.454.CMB.2.raw
  modified_base (284)..(284): a, c, t, g, unknown or other
  misc_feature (284)..(284): n is a, c, g, or t
  modified_base (546)..(546): a, c, t, g, unknown or other
  misc_feature (546)..(546): n is a, c, g, or t
tcagcgatcgtatacacgaccggtgctcgatttagtgtgagtagtttgggtttgggggggagaggagccccagccctgagattcccaggtgtttccattcagtgatcagcactgaacacagaggactcaccatggagttgggactgagctggattttcctttggctattttaaaaggtgtccagtgtgaagtgctactggtggagtcgtgggggagcctggtacagcctggcaggtccctgagactctcctgtgcagcctcgtggtattcactttgatgattancgcatgcacgtgggtccgcaagctccgaaggggacggcctgggagtggtctcgacgttattagtggaataggtggtaagtatacgcctagtggcgggacttcgtagggtaggaacggggcccgtattcccgaaccattccgacccgaaggaccgaaacaaaccggaccaaaacggtaacccttcccgtagtaactctaggaactaaagtgaaacctgtctggaagacgcgtaggaaggtaccacggtctttaggttactacngaccgaacaaacgccaaggccaagcgctaggttactaacgttaagtaacg

SEQ ID NO: 310112 - DNA, 558 bp, Homo sapiens
  misc_feature: GZ8MTXP01CF71Y.51.78.H01.1.454.CMB.2.raw
  modified_base (199)..(199): a, c, t, g, unknown or other
  misc_feature (199)..(199): n is a, c, g, or t
  modified_base (422)..(422): a, c, t, g, unknown or other
  misc_feature (422)..(422): n is a, c, g, or t
  modified_base (473)..(473): a, c, t, g, unknown or other
  misc_feature (473)..(473): n is a, c, g, or t
  modified_base (523)..(523): a, c, t, g, unknown or other
  misc_feature (523)..(523): n is a, c, g, or t
tcagcgatcgtatacacgaccggtgctcgatttagtgtgagtagtttgggtttggggaggagtcagtctcagtcaggacacagcatggacatgagggtccccgctcagctcctggggctcctgctactctggctccgaggtgccagatgtgacatccagatgacccagtctccatcctccctgtctgcatctgtagganacagagtcaccatcacttgccgggcaagtcagagcattagcagctattaaattggtatcagcagagaccaggaaacgcccctaactcctgatctatgatgactatcctaaagtttggaaagttccgggggtacccatcgaaaggttcaaagggttcggcaggtcgggattcgtaggggacagtactttcactctcaccatcagcagtgtcgcgactgaacgtnttttgactaacttactatcgtacaaactagacgttaaccacgtaacccctnaacgtcttcgtacgtttcggggacggtgggaccgttaagggttcgggaanacgtaacgaaaacggtacgttggtcggcgtaacgg

SEQ ID NO: 310113 - DNA, 505 bp, Homo sapiens
  misc_feature: GZ8MTXP01B37SA.51.78.H01.1.454.CMB.2.raw
  modified_base (426)..(426): a, c, t, g, unknown or other
  misc_feature (426)..(426): n is a, c, g, or t
  modified_base (440)..(440): a, c, t, g, unknown or other
  misc_feature (440)..(440): n is a, c, g, or t
  modified_base (469)..(469): a, c, t, g, unknown or other
  misc_feature (469)..(469): n is a, c, g, or t
  modified_base (488)..(488): a, c, t, g, unknown or other
  misc_feature (488)..(488): n is a, c, g, or t
tcagcgatcgtatacacgaccggtgctcgatttagtgtgagtagtttgggtttgggcacgaccggtgctcgatttagtgtgagtagtttgggtttggggaggagtcagtctcagtcaggacacagcatggacatgagggtccccgctcagctcctggggctcctgctactctggctccgaggtgccagatgtgacatccagatgacccagtctccatcctcctgtctgcatctgtaggagacagagtcaccatcactgccgggcaagtcagagcattagcagctatttaaatggtatcagcagagaccagggaaacgcccctaacctccctgatctatgaatgcatccaatttggaaagtggggtcccatcaagttcagtggcagtggatcgtgggacagtacttcactctcaccatcagcagtgngcgtacctgaactnttttgacttaacttacacgtgtacaacgngattaacacgtaacccctnagcctcgaacgttcggg

SEQ ID NO: 310114 - DNA, 647 bp, Homo sapiens
  misc_feature: GZ8MTXP01ARANB.51.78.H01.1.454.CMB.2.raw
  modified_base (268)..(268): a, c, t, g, unknown or other
  misc_feature (268)..(268): n is a, c, g, or t
  modified_base (317)..(317): a, c, t, g, unknown or other
  misc_feature (317)..(317): n is a, c, g, or t
  modified_base (618)..(618): a, c, t, g, unknown or other
  misc_feature (618)..(618): n is a, c, g, or t
tcagcgatcgtatacacgaccggtgctcgatttagtgtgagtagtttgggtttgggcacgaccggtgctcgatttagtgtgagtagtttgggtttggggaggagtcagtctcagtcaggacacagcatggacatgagggtccccgctcagctcctggggctcctgctactctggctccgaggtgccagatgtgacatccagatgacccagtctccatcctccctgtctgcatctgtagagacagatcacatcactgcggcaagtcagngcattagcagtcttaatttaaattggtatcagcagagaccagggaaacnccctaactccctgatctatgaatgcataccgaaagttttcggggaaaagttcgggggtacccctaagtaccgtaaaggtttccgaaggttcgggacgtaaggttcgggtaagttccggttagggggaacctaacgtagtttttaccaacccttccgttaccctaaccccaaagttcccaagcccgtaaggtttgcggtaccgtaaccccgttaggtaaacggttatttttaacggaaccttaaactttaacgttaacctaggttaacaaacgttagttacggttaaccacggttaaccccncgtacgcctaacgttaacgtttccggggg

SEQ ID NO: 310115 - DNA, 726 bp, Homo sapiens
  misc_feature: GZ8MTXP01B66IH.51.78.H01.1.454.CMB.2.raw
  modified_base (201)..(201): a, c, t, g, unknown or other
  misc_feature (201)..(201): n is a, c, g, or t
  modified_base (229)..(229): a, c, t, g, unknown or other
  misc_feature (229)..(229): n is a, c, g, or t
  modified_base (596)..(596): a, c, t, g, unknown or other
  misc_feature (596)..(596): n is a, c, g, or t
tcagcgatcgtatacacgaccggtgctcgatttagtgtgagtagtttgggtttggggaggagtcagtctcagtcaggacacagcatggacatgagggtccccgctcagctcctggggctcctgctactctggctccgaggtgccagatgtgacatccagatgacccagtcctccatccctccctgtctgcatctgtagganacagagtccaccatcacgttggccgggnaagtcagacgcattagcagtacttaattaaagttggtatcgagacgaaggaacggaacccgaaggggaaaccctacccccgtaaacctccgtagtacttacctagtagatcgactactaccttaaaggtttacgggaaacggttcccggggtacccagtacgtaaaggtttccaaagggttcggcgtagggtaggtacgttcggtaggggtaactagttactttccaacttcctaccacctatcgaagtccgtaaggtcggtacgaccgtaacgttaggtaaacgtttacgttttacggaacctttaaacctttacctaacttacgtaacctaaacgtaacggtactttaaccgaccttaccccctntaaccggtcttcccggttaaccggttccgggggaacgggtaaccgggggttaaaccgttagggggttacgggtaacgtaaacgttaaccgtaaaaacccggtggttacggtaacgggttcgttaacccgg

SEQ ID NO: 310116 - DNA, 729 bp, Homo sapiens
  misc_feature: GZ8MTXP01CWK44.51.78.H01.1.454.CMB.2.raw
  modified_base (205)..(205): a, c, t, g, unknown or other
  misc_feature (205)..(205): n is a, c, g, or t
tcagcgatcgtatacacgaccggtgctcgatttagtgtgagtagtttgggtttggggaggagtcagtctcagtcaggacacagcatggacatgacgggtccccgctcagctccgtggggcctcctgctactctggctccgaggtgccagatgtgacatccagatcgacccagtctccatcctccctgtctgctatctggtagganacagagtcaccatcacgttggccgggacaagtcaaggagactagttacgctagtacttaaattaaagtggtaatcgaagaccaaggaacgaaccgaaacggggaaaccctccccccttaaacctccgtagtaacttactaaagtggtaattcggactaacgttaccgtaaaaggttttacggggaaaacggttcccggggtacccaagttccgtaaagggtttcaaagggttcgaacgtagtagggacttacggagggactagtactttacaactcctacacctagtcaagtctagtcgtacgacgtaacttaggtaacttattttacgaaaccttaacttactacgttcgaacctaagtaaacgttacgttaaaccctacccgtacccccttaagtaaccgttccgttaccggttaaccgggttaccggggaaaccgggtaacgggttaaacggttaacggggttaacgtaaaccgtaacgttaaaccgaaaaccgggtcgttcgggtaaccgaaccgtaacg

SEQ ID NO: 310117 - DNA, 592 bp, Homo sapiens
  misc_feature: GZ8MTXP01BLUNT.51.78.H01.1.454.CMB.2.raw
  modified_base (266)..(266): a, c, t, g, unknown or other
  misc_feature (266)..(266): n is a, c, g, or t
  modified_base (319)..(319): a, c, t, g, unknown or other
  misc_feature (319)..(319): n is a, c, g, or t
tcagcgatcgtatacacgaccggtgctcgatttagtgtgagtagtttgggtttgggcacgaccggtgctcgatttagtgtgagtagtttgggtttggggaggagtcagtctcagtcaggacacagcatggacatgagggtccccgctcagctcctggggctcctgctactctggctccgaggtgccagatgtgacatccagatcgacccagtcctccactcctccctgtctgcatctgtagagacagagtcacatcactggccggnaagtcagagcatagcagtctaatttaaatgtatcagcagagaccgaaggaacncccctaactccctgatctatgaatcgctatacctaaagtttgggaaacggtcggggtaccctagtacgtaaggttcaggtggacgaggtggtacgtcggtaggggaactagtactttaccgacttctaaccacctatcgaacgcgagttgacgtaccgtaacgtagtaacgttacgttttaacgaacttaaacttacttacgtcgtaaccaaacgttacggttacttaacccacgtaaccccttcgacgttcctaacgttcggttaaccgggg

SEQ ID NO: 310118 - DNA, 573 bp, Homo sapiens
  misc_feature: GZ8MTXP01AS31N.51.78.H01.1.454.CMB.2.raw
  modified_base (240)..(240): a, c, t, g, unknown or other
  misc_feature (240)..(240): n is a, c, g, or t
  modified_base (264)..(264): a, c, t, g, unknown or other
  misc_feature (264)..(264): n is a, c, g, or t
  modified_base (319)..(319): a, c, t, g, unknown or other
  misc_feature (319)..(319): n is a, c, g, or t
  modified_base (506)..(506): a, c, t, g, unknown or other
  misc_feature (506)..(506): n is a, c, g, or t
  modified_base (532)..(532): a, c, t, g, unknown or other
  misc_feature (532)..(532): n is a, c, g, or t
  modified_base (553)..(553): a, c, t, g, unknown or other
  misc_feature (553)..(553): n is a, c, g, or t
tcagcgatcgtatacacgaccggtgctcgatttagtgtgagtagtttgggtttgggcacgaccggtgctcgatttagtgtgagtagtttgggtttggggaggagtcagtctcagtcaggacacagcatggacatgagggtccccgctcagctcctggggctcctgctactctggctccgaggtgccagatgtgacatccagatgacccagtctccatcctcctgtctgcatctgtagganacagagtcaccatcactgccgggnaagtcagagcattagcagcttaatttaaatggatcagcaagagaccaaggaaacncccctaactccctagatctaatgaaattgctatacctaaagtttcgggaaaaggttcggggtacccaagtccgtaaaggttcgaaggtgggacaggttaggactcggtagggaactagtactttacacctttcaccaaccgtataccgaagcctaggttgtacgaccgtactagtaagttatttaanacttaaacttacacgtagtacaacgngttacgttaacactaaccctnacttctcgttaacgttcggg

SEQ ID NO: 310119 - DNA, 572 bp, Homo sapiens
  misc_feature: GZ8MTXP01AFCRS.51.78.H01.1.454.CMB.2.raw
  modified_base (276)..(276): a, c, t, g, unknown or other
  misc_feature (276)..(276): n is a, c, g, or t
  modified_base (338)..(338): a, c, t, g, unknown or other
  misc_feature (338)..(338): n is a, c, g, or t
tcagcgatcgtatacacgaccggtgctcgatttagtgtgagtagtttgggtttggggaggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctattaatggtatcagcagagaccgaaggaaacncccctaacctcctagatctatgatgcatcctaagtttaggaaagtcggggtaccatcaagtnttacgagtgcaggtggatcgtgggactagtacttcaacttctacaccataccgagctagtgtcgtaccgacctagaagggtattttacggactaaacctttactaacgtcgtaacctaaacgtacgtaacgttaccaaccggttacccctcgacgttctaccgttaccgtttcgggaccggggaaggttaccgaagggtcggagaactaacgaaacgttacgtcgttggaaccg

SEQ ID NO: 310120 - DNA, 680 bp, Homo sapiens
  misc_feature: GZ8MTXP01DXUK0.51.78.H01.1.454.CMB.2.raw
  modified_base (235)..(235): a, c, t, g, unknown or other
  misc_feature (235)..(235): n is a, c, g, or t
  modified_base (300)..(300): a, c, t, g, unknown or other
  misc_feature (300)..(300): n is a, c, g, or t
tcagcgatcgtatacacgaccggtgctcgatttagtgtgagtagtttgggtttgggggctctgggagaggagccccagccctgagattcccaggtgtttccattcagtgatcagcactgaacacagaggactcaccatggagttgggactgagctggtattttccttttggcttaattttaaaaggtgtccagtgtgaagtgctacgtggtggagtcgtgggggagcctggtacngcctggcaggtccctgagactctcctgtcgcacgtcctcgtggtacttcactttgattgtattancgcctatcgacctacggtcggggtcccgacaaacggtccgtaccggaagggggaacgggtccgtaggggtaggttcgggtctacgtaacggtttagttaggttaggtaagtaggttagggttaaatatcggccttaagtcggacggtactcgtagggtacggaacgggtctacttccacctacttacctaccgaagaaccgaaccgaaaccgacccgtaaacgtaacccttccccgttaggtaacttcgtaacgaactaaagtacgaactagtacgtaggagacgtcgtggaaacggtccgttaccggttcctttagttaacgttaacgacggaccgaaacgaaacggacgaacggacaacggagtccgttaaggtaacc

SEQ ID NO: 310121 - DNA, 540 bp, Homo sapiens
  misc_feature: GZ8MTXP01C9Y90.51.78.H01.1.454.CMB.2.raw
  modified_base (277)..(277): a, c, t, g, unknown or other
  misc_feature (277)..(277): n is a, c, g, or t
  modified_base (377)..(377): a, c, t, g, unknown or other
  misc_feature (377)..(377): n is a, c, g, or t
  modified_base (463)..(463): a, c, t, g, unknown or other
  misc_feature (463)..(463): n is a, c, g, or t
tcagcgatcgtatacacgaccggtgctcgatttagtgtgagtagtttgggtttggggaggagtcagtctcagtcaggacacagcatggacatgagggtccccgctcagctcctggggctcctgctactctggctccgaggtgccagatgtgacatccagatgacccagtcctccatcctcctgtctgcatctgtaggagacagagtcaccatcacttgccgggcaagtcagagcattagcagacttaattaaatggtatcagcagagacaggaaacncccctaactctgatctatgatgcatcctaagtttggaaagtcgggacccatcgaaaggttcaaggtgctagtggatcgtgggacagtattccatctcacntcagctagtgtgacgacgtagtaacgttattttacgacctaaactttactactagtacaacgtaagtacgttaacacgtacccctnaacgtcttactacgttcgggacggtagggaaccgagggttggaagactaacgaaacggtacgttggtaacgctaacg

SEQ ID NO: 310122 - DNA, 647 bp, Homo sapiens
  misc_feature: GZ8MTXP01CY2QS.51.78.H01.1.454.CMB.2.raw
  modified_base (264)..(264): a, c, t, g, unknown or other
  misc_feature (264)..(264): n is a, c, g, or t
  modified_base (295)..(295): a, c, t, g, unknown or other
  misc_feature (295)..(295): n is a, c, g, or t
tcagcgatcgtatacacgaccggtgctcgatttagtgtgagtagtttgggtttgggggctctgggagaggagccccagccctgagattcccaggtgtttccattcagtgatcagcactgaacacagaggactcaccatggagttgggactgagctggtattttccttttggcttaattttaaaaggtgtccagtgtgaagtgctacgtggtggagtcgtgggggagcctggtacagcctggcaggtccctgagactctcctgtncagcctctggtacttcactttgatgtattancgccatcgccacggtcgggtcccgacaagccgtaccggagggggaacgggtccgtagggtaggtcgggtactcgtaacggtttagttaggttaggaagttaggttagggttaaagttagtaacgtccgtaagtcgggacggtactcgtggtagggacgggtccctattccaaccgtattcccgtaccgaagaacgaacccgaaaccgacccaaagtaacccttccccgtaggttactcgtacgaactaaagtcgaaactgttacgagagagcgtggaacgcgttaccggtcttaggtaacttagcgaccgaacgaaaacgaccgaaggaccaacgacgtcgttaaggtaacc

SEQ ID NO: 310123 - DNA, 576 bp, Homo sapiens
  misc_feature: GZ8MTXP01DQ8K9.51.78.H01.1.454.CMB.2.raw
  modified_base (224)..(224): a, c, t, g, unknown or other
  misc_feature (224)..(224): n is a, c, g, or t
  modified_base (279)..(279): a, c, t, g, unknown or other
  misc_feature (279)..(279): n is a, c, g, or t
  modified_base (497)..(497): a, c, t, g, unknown or other
  misc_feature (497)..(497): n is a, c, g, or t
tcagcgatcgtatacacgaccggtgctcgatttagtgtgagtagtttgggtttggggaggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggnaagtcagagcattagcagcttaattaaatggtatcagcagagaccaagggaaacncccctaactcctgatctatgatgactatacctaaagtttagggaaacggttccggggtaccctagtacgtaaggttcaaaggttggcgtaggtggacttcggtagggacagtacttcacttcacacatcagcgtagtcgtcggacacgtagtaacgtttagtttcgaacttaaacttactactacgtacaaacgtagtacgttaccaccgttaccctnaacgtccttacgtacggtttcggacgggtaacggaccgagggttcgaagactaacgaaacggtacttggtccgctaacg

SEQ ID NO: 310124 - DNA, 795 bp, Homo sapiens
  misc_feature: GZ8MTXP01ED9I2.51.78.H01.1.454.CMB.2.raw
tcagcgatcgtatacacgaccggtgctcgatttagtgtgagtagtttgggtttgggggggagaggagccccagccctgagattcccaggtgtttccattcagtgatcagcactgaacacagaggactcaccatggagttgggactgagctggtattttcctttggctattttaaaaggtgtccagtgtgaagtgctactggtggagtcgtgggggagcctggtacagcctggcaggtccctgagactctcctgtgcagcctctggattcactttgatgattatgccatgcacgtggggtcccgacaagcctaccgaagggggaacgggccgttaggggaggttgggggttcctacgtaacggttaagtttaggttagggtaaacttagggttagggttaagttaatacggtaccccttaagtcgggaccggggtaaccttcggttagggttagggtaaacggggggttccgttaaacttttacccaaccgtaactttccctaacccgaaaggtaaacgggaaacccaaaacccgggtacccaaaacggtaaacccttcccccttaggttaacttcccgttaggggaaacctaaaaagttacggaaaacctaggttaccgtaggaacggaaaggtccgttaggggaaacgggaacccgtaaccgggggttaacccttttaagggttaaaccttttaaccgttacggaaccgtaaaacgaaaaaacggacccgaaaacgggaaccaaaacgaacggtaccgttaagggttaacctaaccgttaaaagtttaaccggg

SEQ ID NO: 310125 - DNA, 580 bp, Homo sapiens
  misc_feature: GZ8MTXP01CCCMN.51.78.H01.1.454.CMB.2.raw
  modified_base (263)..(263): a, c, t, g, unknown or other
  misc_feature (263)..(263): n is a, c, g, or t
tcagcgatcgtatacacgaccggtgctcgatttagtgtgagtagtttgggtttgggcacgaccggtgctcgatttagtgtgagtagtttgggtttggggaggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcacatcactgccggnaagtcagagcattagcagcttaatttaatggtatcagcagacgaccgaaggaaacgcccctaaactcccctagatcgtatcgaaatcgcatacctaaagttttaggaaacggttcggggtacccatacgtaaggttcgaggtggactaggtgatcgtagggactagtatttcgacttcgtcaacatccagtccaggtcgtcgacgtaccgtagtaagttatttcgaacttaaacttacttactacgttacaaaacgttgttaacgtttaaccgacgttaacccctcgacgttcctaacgttaacgtttaaccggggg

SEQ ID NO: 310126 - DNA, 537 bp, Homo sapiens
  misc_feature: GZ8MTXP01C95EK.51.78.H01.1.454.CMB.2.raw
  modified_base (365)..(365): a, c, t, g, unknown or other
  misc_feature (365)..(365): n is a, c, g, or t
  modified_base (466)..(466): a, c, t, g, unknown or other
  misc_feature (466)..(466): n is a, c, g, or t
  modified_base (485)..(485): a, c, t, g, unknown or other
  misc_feature (485)..(485): n is a, c, g, or t
tcagcgatcgtatacacgaccggtgctcgatttagtgtgagtagtttgggtttgggcacgaccggtgctcgatttagtgtgagtagtttgggtttgggcacgaccggtgctcgatttagtgtgagtagtttgggtttggggaggagtcagtctcagtcaggacacagcatggacatgagggtccccgctcagctcctggggctcctgctactctggctccgaggtgccagatgtgacatccagatgacccagtctccatcctcctgtctgcatctgtaggagacagatcaccatcacttgccggcaagtcagagcattagcagcttaatttaaattggtatcagcaagcgaaccaaggggaaacnccccctaaactcctagatctatgatgacatactaagtttggaaagtcgggtacccagtactaaaggttcgaaggttggactaaggtgagtcgtggggaacngtaattcactctaacaccntcagctgttgttcacgtaactaggtaactatttcgacttaacttaactaacg

SEQ ID NO: 310127 - DNA, 565 bp, Homo sapiens
  misc_feature: GZ8MTXP01CWH0L.51.78.H01.1.454.CMB.2.raw
  modified_base (226)..(226): a, c, t, g, unknown or other
  misc_feature (226)..(226): n is a, c, g, or t
  modified_base (286)..(286): a, c, t, g, unknown or other
  misc_feature (286)..(286): n is a, c, g, or t
  modified_base (315)..(315): a, c, t, g, unknown or other
  misc_feature (315)..(315): n is a, c, g, or t
  modified_base (509)..(509): a, c, t, g, unknown or other
  misc_feature (509)..(509): n is a, c, g, or t
  modified_base (541)..(541): a, c, t, g, unknown or other
  misc_feature (541)..(541): n is a, c, g, or t
tcagcgatcgtatacacgaccggtgctcgatttagtgtgagtagtttgggtttgggcacgaccggtgctcgatttagtgtgagtagtttgggtttgggcacgaccggtgctcgatttagtgtgagtagtttgggtttggggaggagtcagtctcagtcaggacacagcatggacatgagggtccccgctcagctcctggggctcctgctactctggctccgaggtnccagatgtgacatccagatcgacccagtctccactccctccctgtctgcatctgtagganacagagtccacatcacgttcggaccgganaagtcagagctattacgcagtacttaaactttaaagtgtatcaagacaagaacgaaaccgaaagggaaacctaccccctaaactccgtatactactatgatgacactacctaagtttaggaaaggttcggtaccagttacgtaagttgagtgacaggtgatcgtaggaactagtactttccactctaacaaccntcagccagttcgcgactaaccgtgtaacgttntttcgaccttaacgttaactaacg

SEQ ID NO: 310128 - DNA, 597 bp, Homo sapiens
  misc_feature: GZ8MTXP01BQC4N.51.78.H01.1.454.CMB.2.raw
  modified_base (241)..(241): a, c, t, g, unknown or other
  misc_feature (241)..(241): n is a, c, g, or t
  modified_base (323)..(323): a, c, t, g, unknown or other
  misc_feature (323)..(323): n is a, c, g, or t
  modified_base (497)..(497): a, c, t, g, unknown or other
  misc_feature (497)..(497): n is a, c, g, or t
tcagcgatcgtatacacgaccggtgctcgatttagtgtgagtagtttgggtttgggcacgaccggtgctcgatttagtgtgagtagtttgggtttggggaggagtcagtctcagtcaggacacagcatggacatgagggtccccgctcagctcctggggctcctgctactctggctccgaggtgccagatgtgacatccagatgacccagtctccatccctcctgtctgcatctgtagganacagagtcacatcactgccggcaagtcagagcattagcagtacttaatttaaatggtaatcagcaagagaccgaaggaaacncccctaactccctagatctatcgaatcgctaataccgtaaagttttacgggaaaacggttcgggggtacccctaagtaccgtaaggtttacgaaggtggacgtaggtaggtatcgtagggaactagtatttcacctctacacctatcagctagtgtcgcgtacctagtaagttntttcgacttaaacttacttacttacgtaacttaacgacgttaaccggttaacccggtaccctcgtaacgtccttacgttaaccggtttcgggaaccgggg

SEQ ID NO: 310129 - DNA, 619 bp, Homo sapiens
  misc_feature: GZ8MTXP01DIEUV.51.78.H01.1.454.CMB.2.raw
  modified_base (299)..(299): a, c, t, g, unknown or other
  misc_feature (299)..(299): n is a, c, g, or t
  modified_base (476)..(476): a, c, t, g, unknown or other
  misc_feature (476)..(476): n is a, c, g, or t
tcagcgatcgtatacacgaccggtgctcgatttagtgtgagtagtttgggtttgggcacgaccggtgctcgatttagtgtgagtagtttgggtttgggcacgaccggtgctcgatttagtgtgagtagtttgggtttgggaggagtcagtctcagtcaggacacagcatggacatgagggtccccgctcagctccgtgggctcctgctactctggctccgaggtgccagatgtgacatccagatcgacccagtcctccatccctcctgtctgcatctagtaggagacagacgtcacctntacacgttcgaccggaacaacgtcaagagactagttacgctagtactttaatttaaagtggtatacgagtaacaagaacgaaccgaaaggggaaaccctccccctaaactcgtagacttactagtagatcgacttaactaaccgtaaagtttacgggaaacgggttccgggaacccngttaacgtaacggttcgtaaggtcggacgtaggtcgtaagtcgtagggactagtcttaccgcttcaacacatacgagtccgtaggttcgcgttaccgtaaccgttagtaacggtttacttacgacttaacgttaacgttaacg

SEQ ID NO: 310130 - DNA, 530 bp, Homo sapiens
  misc_feature: GZ8MTXP01AM7M4.51.78.H01.1.454.CMB.2.raw
  modified_base (316)..(316): a, c, t, g, unknown or other
  misc_feature (316)..(316): n is a, c, g, or t
tcagcgatcgtatacacgaccggtgctcgatttagtgtgagtagtttgggtttgggcacgaccggtgctcgatttagtgtgagtagtttgggtttgggaggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcacatcactgccgggcaagtcagagcattagcagctatttaaatggtatcagcagagaccagggaaacncccctaactccctgatctatgaatgcatacctaaatttgggaaagtcggggtacccatcaaggttcagtggcagtggatcgtgggacagattcactctcaccatcagcagtgtgcgtacctagaacgtgttttaagacttaaacttacttacgttacgtaccaaacttgttacgttaaccacgtaacccctacacgttcctcgttccgttcggg

SEQ ID NO: 310131 - DNA, 630 bp, Homo sapiens
  misc_feature: GZ8MTXP01EQSUH.51.78.H01.1.454.CMB.2.raw
tcagcgatcgtatacacgaccggtgctcgatttagtgtgagtagtttgggtttggggggctctgggagaggagccccagccctgagattcccaggtgtttccattcagtgatcagcactgaacacagaggactcaccatggagttgggactgagctggtattttcctttggcttaattttaaaaggtgtccagtgtgaagtgctagtggtggagtcgtgggggagccgtggtacagcctggcacggtccctgagtactctcctgtgcagtcctcgtggtacttcactttgatgtaattatcgccagtcgaccgtaccggttggggtacccggacaaacggtccgtacccgggaagggggtaaccgggtccgtagggaggttcgggtactacgtaacgttagttaggttaggaagtaggtggtaagtaactgctagcgacgtactcgtggtcggaacggtcctagtcactatccgtacagacgaacaaccgacaaacgtaacctcctaggtactcgtagaacaaagtgaaactgtactggaagagcgtggaaacggcgacgggtcctttaggaacttccgagacgaaacaaaacgggcccaaagggtccaaggttactaaccgttggtaac

SEQ ID NO: 310132 - DNA, 668 bp, Homo sapiens
  misc_feature: GZ8MTXP01BSLMY.51.78.H01.1.454.CMB.2.raw
  modified_base (241)..(241): a, c, t, g, unknown or other
  misc_feature (241)..(241): n is a, c, g, or t
  modified_base (264)..(264): a, c, t, g, unknown or other
  misc_feature (264)..(264): n is a, c, g, or t
  modified_base (322)..(322): a, c, t, g, unknown or other
  misc_feature (322)..(322): n is a, c, g, or t
tcagcgatcgtatacacgaccggtgctcgatttagtgtgagtagtttgggtttgggcacgaccggtgctcgatttagtgtgagtagtttgggtttggggaggagtcagtctcagtcaggacacagcatggacatgagggtccccgctcagctcctggggctcctgctactctggctccgaggtgccagatgtgacatccagatgacccagtctccatcctccctgtctgcatctgtagganacagagtcaccatcactgccggnaagtcagagcattagcagtcttaatttaaatggtatcagcagagaccgaagggaaacncccctaactcccctagactctaatgaaacttgcctattacccgtaaagtttacggggaaaacggttcgggggtacccctaaagttaccgtaaagggttcaaggttggcgtaaggttacgggattccggtagggaacctaggtactttaccaaccttccgttacaacctataccgacgcctaggttcgtacggtaccgtaaccgtaggtaaagttacgttttaacggaacctttaaacctttaccttacgttaacggtaacccttaaaagttacggttaaccggtttaaccctaccggttaaccccctagtacggttacccttaacccgttaacggtttcccggggg

SEQ ID NO: 310133 - DNA, 583 bp, Homo sapiens
  misc_feature: GZ8MTXP01C8NE7.51.78.H01.1.454.CMB.2.raw
  modified_base (243)..(243): a, c, t, g, unknown or other
  misc_feature (243)..(243): n is a, c, g, or t
  modified_base (264)..(264): a, c, t, g, unknown or other
  misc_feature (264)..(264): n is a, c, g, or t
  modified_base (327)..(327): a, c, t, g, unknown or other
  misc_feature (327)..(327): n is a, c, g, or t
  modified_base (486)..(486): a, c, t, g, unknown or other
  misc_feature (486)..(486): n is a, c, g, or t
tcagcgatcgtatacacgaccggtgctcgatttagtgtgagtagtttgggtttgggcacgaccggtgctcgatttagtgtgagtagtttgggtttggggaggagtcagtctcagtcaggacacagcatggacatgagggtccccgctcagctcctggggctcctgctactctggctccgaggtgccagatgtgacatccagatgacccagtcctccatccctccctgtctgcatctgtagganacagatcacatcactgccggnaagtcagagcattagcagtacttaatttaaatggtatcagcaagacgaaccgaagggaaaccncccctaacctccctagatctatgaattgctataccgtaaagtttagggaaagtcgggtacccagtacgtaaggttcaggtggactaggtagattcgtagggactagtactttaccacttctactacctaatcagctagtcgtacgcgtactagaagttntttaacgacttaaacttacttacgttacgtacaaacgttgttaacgttaaccaaccgttaacccctcacgttacctccgttaacggttaaccggggg

SEQ ID NO: 310134 - DNA, 538 bp, Homo sapiens
  misc_feature: GZ8MTXP01ATF2X.51.78.H01.1.454.CMB.2.raw
  modified_base (224)..(224): a, c, t, g, unknown or other
  misc_feature (224)..(224): n is a, c, g, or t
  modified_base (404)..(404): a, c, t, g, unknown or other
  misc_feature (404)..(404): n is a, c, g, or t
  modified_base (467)..(467): a, c, t, g, unknown or other
  misc_feature (467)..(467): n is a, c, g, or t
  modified_base (510)..(510): a, c, t, g, unknown or other
  misc_feature (510)..(510): n is a, c, g, or t
tcagcgatcgtatacacgaccggtgctcgatttagtgtgagtagtttgggtttggggaggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggnaagtcagagcattagcagcttaattaaattggtatcagacagagaccgaagggaaacgcccctaactcctgatctatgatgacatacctaaagtttggaaagtccggggtacccagtacgaaggttcaaggtggctaggtgatcgtagggacagtactttcactctcacatcagcagtgngcgactagaagtatttcgacttaacttactactgtacaacgtagtacttaaccacgtaccccnaacgtcttctacgttcggcggtaagggaccgaggttacggaanacgtaacgaaacgtcgttagtcgcgtcg

SEQ ID NO: 310135 - DNA, 580 bp, Homo sapiens
  misc_feature: GZ8MTXP01A7VJX.51.78.H01.1.454.CMB.2.raw
  modified_base (270)..(270): a, c, t, g, unknown or other
  misc_feature (270)..(270): n is a, c, g, or t
  modified_base (309)..(309): a, c, t, g, unknown or other
  misc_feature (309)..(309): n is a, c, g, or t
tcagcgatcgtatacacgaccggtgctcgatttagtgtgagtagtttgggtttgggcacgaccggtgctcgatttagtgtgagtagtttgggtttggggaggagtcagtctcagtcaggacacagcatggacatgagggtccccgctcagctcctggggctcctgctactctggctccgaggtgccagatgtgacatccagatcgacccagtcctccactccctccctgtctgcatctgtaggagacagagtcacatcactggccggganagtcagagcattagcagacttaatttaaagtgtatcgancagacgaccgaagggaacctcccctaacctcccctagatctatgaatgctatacctaagtttacgggaaagttcggggaccctatacgtaaggttcaagggtgacgtaggtaggtatcggtagggactagtacttacacctctacactatacgagcgtagtgtacgcgtacgtagtaagttatttaacgacttaaacttacttcgtagtaacaacgttagttacgttaaccacgttaacccctagcgttacctcgttaacggtaaccgggg

SEQ ID NO: 310136 - DNA, 758 bp, Homo sapiens
  misc_feature: GZ8MTXP01AP68S.51.78.H01.1.454.CMB.2.raw
tcagcgatcgtatacacgaccggtgctcgatttagtgtgagtagtttgggtttgggggctctgggagaggagccccagccctgagattcccaggtgtttccattcagtgatcagcactgaacacagaggactcacatggagttgggactgagctggtattttcctttggcttattttaaaaggtgtccagtgtgaagtgctacgtggtggagtcgtgggggagcctggtacagcctggcaggtccctgagactctcctgtgcagcctcgtggacttcacctttgattgattatcgcctatgctacgtcggggtacccggacaacggccgtaccgggaaggggggtaacggggtcccgttagggggtacgggttcgggggttcctacgtaacggtttaagttttacgggttaggggaaagtttagggttagggttaaaacgttaagttaacggacccgtttaaagggtcgggaccgggtacgtttacggtagggttacgggaaacggggtcccgtaactttaccgacccgtaatcccgtaaccgaacggtaacgaacccgaaaccgacccgaaaacggtacccttacccgttagggttaactcgtaacgaactaaaacgttcgaaacgtacggttaccgttaggaacgacgggtaccgtaagggtaacggaccggttaccgggttacctttagggtaaacttacgttacggacgaacgaaaacggcccgaaaggacaacgacggtcgttaaggttaacc

SEQ ID NO: 310137 - DNA, 652 bp, Homo sapiens
  misc_feature: GZ8MTXP01BP71G.51.78.H01.1.454.CMB.2.raw
  modified_base (184)..(184): a, c, t, g, unknown or other
  misc_feature (184)..(184): n is a, c, g, or t
  modified_base (244)..(244): a, c, t, g, unknown or other
  misc_feature (244)..(244): n is a, c, g, or t
  modified_base (272)..(272): a, c, t, g, unknown or other
  misc_feature (272)..(272): n is a, c, g, or t
tcagcgatcgtatacacgaccggtgctcgatttagtgtgagtagtttgggtttgggcacgaccggtgctcgatttagtgtgagtagtttgggtttggggaggagtcagtctcagtcaggacacagcatggacatgagggtccccgctcagctcctggggctcctgctactctggctccgaggtnccagatgtgacatccagatcgacccagtcctccatccctcctgtctgcatctagtagganacagacgtcaccatctacgtggccgganaagtcagagcattagcagtacttaatttaaattggtaatcagacagaacgaccgaagggaaacctcccctacctccgtagtactactatgtaatcgctaactaccgtaaaggttaggaaacggtccggggtacctagtacgtaaggtcgaggtcgacgtaggtacggtactcggtacgggactacgttacttacgtaccttaccgtactaaccctattaccgaagtaccgtaaggttcggtacgtaccggtaccgttaagtaaaccggtttatttaactaacctttaaacgttacttacgtaacgtaacttaaacgttacggttaaacttaaccgaccttaacccactacgttacctaaccgtttaacggttaaccgggg

SEQ ID NO: 310138 - DNA, 601 bp, Homo sapiens
  misc_feature: GZ8MTXP01B0DM9.51.78.H01.1.454.CMB.2.raw
  modified_base (282)..(282): a, c, t, g, unknown or other
  misc_feature (282)..(282): n is a, c, g, or t
  modified_base (306)..(306): a, c, t, g, unknown or other
  misc_feature (306)..(306): n is a, c, g, or t
tcagcgatcgtatacacgaccggtgctcgatttagtgtgagtagtttgggtttgggcacgaccggtgctcgatttagtgtgagtagtttgggtttgggcacgaccggtgctcgatttagtgtgagtagtttgggtttggggaggagtcagtctcagtcaggacacagcatggacatgagggtccccgctcagctccgtggggctcctgctactctggctccgaggtgccagatgtgacatccagatgacccagtctccatcctcctgtctgcatctgtaganacagatcaccatcacttgccgganaaagtcaagagctaattacgcagtacttaatttaaatggtatccgagacaagcgaaccaaaggggaaacctccccctaactcagactctaatgatcgactatacctaaagtttggaaaggttcgggaccctaagtaccgtaaagggtttcaaggttcggaccaggttacggaatcgtaggggaacctaggtactttcaacttcaaccaaccttatccaggtacctaagttcggttacgaccggtaaccttaggtaaacgttagttttacgaaccttaaaccgtttaactaaccgg

SEQ ID NO: 310139 - DNA, 579 bp, Homo sapiens
  misc_feature: GZ8MTXP01EZG99.51.78.H01.1.454.CMB.2.raw
  modified_base (267)..(267): a, c, t, g, unknown or other
  misc_feature (267)..(267): n is a, c, g, or t
  modified_base (333)..(333): a, c, t, g, unknown or other
  misc_feature (333)..(333): n is a, c, g, or t
  modified_base (493)..(493): a, c, t, g, unknown or other
  misc_feature (493)..(493): n is a, c, g, or t
  modified_base (551)..(551): a, c, t, g, unknown or other
  misc_feature (551)..(551): n is a, c, g, or t
tcagcgatcgtatacacgaccggtgctcgatttagtgtgagtagtttgggtttgggcacgaccggtgctcgatttagtgtgagtagtttgggtttggggaggagtcagtctcagtcaggacacagcatggacatgagggtccccgctcagctcctggggctcctgctactctggctccgaggtgccagatgtgacatccagatcgacccagtcctccatccctccctgtctgcatctgtaggagacagagtccacatcactgccggnaagtcagagcattagcagtactttaatttaaagttggtaatcagcaagacgaccgaagggaaaccncccctaactccctagatctatgaatcgctactacctaaagtttagggaaacggttcgggtaccctagtacgtaaggttcaggtggactaggtaggattcgagggacagtattacacttctacacctatcagctagtgtacgaccgtactagtaaacgttntttcgaacttaaacttacttacgtcgtaacaacgttagacgttaacaccgtaaccccntacgttcctaacgttcggttaaccgggg

SEQ ID NO: 310140 - DNA, 750 bp, Homo sapiens
  misc_feature: GZ8MTXP01EX2OH.51.78.H01.1.454.CMB.2.raw
tcagcgatcgtatacacgaccggtgctcgatttagtgtgagtagtttgggtttgggcacgaccggtgctcgatttagtgtgagtagtttgggtttgggcacgaccggtgctcgatttagtgtgagtagtttgggttgggaggagtcagtctcagtcaggacacagcatggacatgacgggtccccgctcagctccgtggggcctcctgctactctggctccgaggtgccagatgtgacatccagatgacccagtcctccatccctcctgtctgcatcgtagtaaggagacagacgtccaaccatcctacgttggcccgggataaaggtccaaggagtacctaagtttacggacctaaaggttacctttaaaagttttaaaagttggtaactacgaacggaacaaacgggaacgaaacccgaaacgggggaaaaaccctccccccttaaaaccgtccgtagtaaacttacttaaagtggtaatacggacctaaagttaacccgttaaaaggttttacgggaaaacgggttcggggtacccctaaagttaccggtaaacgggtttccgaaagggttcgggactaagggttgggaacttccggtaggggtaaacctaggttaaaccttttcaaaccttcctaacctaaacccttagttaccgaaaggtccgtaaagggttcgttacgggaccccgtaaacttaggtaaaaccggtttacgtttaccgaaacctttaaacgtttaaccgtaacg

SEQ ID NO: 310141 - DNA, 557 bp, Homo sapiens
  misc_feature: GZ8MTXP01AQI9K.51.78.H01.1.454.CMB.2.raw
  modified_base (241)..(241): a, c, t, g, unknown or other
  misc_feature (241)..(241): n is a, c, g, or t
  modified_base (264)..(264): a, c, t, g, unknown or other
  misc_feature (264)..(264): n is a, c, g, or t
  modified_base (319)..(319): a, c, t, g, unknown or other
  misc_feature (319)..(319): n is a, c, g, or t
  modified_base (464)..(464): a, c, t, g, unknown or other
  misc_feature (464)..(464): n is a, c, g, or t
  modified_base (527)..(527): a, c, t, g, unknown or other
  misc_feature (527)..(527): n is a, c, g, or t
tcagcgatcgtatacacgaccggtgctcgatttagtgtgagtagtttgggtttgggcacgaccggtgctcgatttagtgtgagtagtttgggtttggggaggagtcagtctcagtcaggacacagcatggacatgagggtccccgctcagctcctggggctcctgctactctggctccgaggtgccagatgtgacatccagatgacccagtcctccatcctcctgtctgcatctgtagganacagacgtcacatcactgccggnaagtcagagcattagcagtcttaattaaatgtatcagcagacgacgaagggaacncccctaactcctagatctatgaatgctataccgaaatttagggaaagtcggggtacccagtacgtaaggttacaggtggacaggtagacgtgtagggacagtacttcactctacacatacgagcagtgcgacgtactgtaacgtntttcgacttaaacttacttacgttacgtaacaacgttaggttaacttaaccacgtaacccctnacgttccttaacgttaacgtttaaccgggg

SEQ ID NO: 310142 - DNA, 613 bp, Homo sapiens
  misc_feature: GZ8MTXP01DXORJ.51.78.H01.1.454.CMB.2.raw
  modified_base (202)..(202): a, c, t, g, unknown or other
  misc_feature (202)..(202): n is a, c, g, or t
tcagcgatcgtatacacgaccggtgctcgatttagtgtgagtagtttgggtttggggaggagtcagtctcagtcaggacacagcatggacatgagggtccccgctcagctcctggggctcctgctactctggctccgaggtgccagatgtgacatcctgatcgacccagtcctccactcctccctgtctgcatctgtagganacagagtcaccatcacgttgccgggcaagtcagagcattagcagtacttaattaaatggtatcagcagacgaccgaaggaaaccgcccctaactcctagactctatgatgactattacctaaagtttagggaaaacggttccggggtaccctagtacgtaaggttccaaagggtggcgtaggtggtacttcgtagggactagtactttcactctacacctatacagctagtcgtcgaccgtactagtaacgttagttttacgacttaaacctttactacttacgtacaacgtaagtacgttaccaccgttacccctgtaactccttcgtacgtttcggggacgggtacgggaaccgttagggttacggaacgtaacgtaaccgaaaacggtacgttcgggtcgcgtaaccg

SEQ ID NO: 310143 - DNA, 763 bp, Homo sapiens
  misc_feature: GZ8MTXP01AY9PA.51.78.H01.1.454.CMB.2.raw
tcagcgatcgtatacacgaccggtgctcgatttagtgtgagtagtttgggtttgggggctctgggagaggagccccagccctgagattcccaggtgtttccattcagtgatcagcactgaacacagaggactcaccatggagttgggactgagctggattttccttttggctattttaaaaggtgtccagtgtgaagtgctactggtggagtcgtgggggagcctggtacagcctggcaggtccctgagactctcctgtgcagcctctggattcactttgatgattatgccatcgcacgtcggggtcccgacaacgccgtaccggagggggaaacggggcccgttagggggacggttcgggggttacctacgtaacggtttaagtttaaggttaggggaaagttagggttacgggttaaagttaacgttaacggcccttaaaggtcgggtcccggggtaacttcggtagggttacgggaaacgggggtccccgtaagtttacccgaaccctaacgttcccgttaaccccgaaaggaaccgaaacccgaaacccggacccctaaaacggtaaaccccttccccgttaaggggttaacttaccgttaagaaccctaaaagtcggaaactacggttacgtaggaacggtaggtaccgtagggaaacggtaaccgttaccggggtcctttaggtaactttaccgcgggaccgaaacgaaaacgccgaaacgggacccaaacgttacggtaaccgttaaggtaaaccc

SEQ ID NO: 310144 - DNA, 566 bp, Homo sapiens
  misc_feature: GZ8MTXP01CDHO9.51.78.H01.1.454.CMB.2.raw
  modified_base (284)..(284): a, c, t, g, unknown or other
  misc_feature (284)..(284): n is a, c, g, or t
  modified_base (307)..(307): a, c, t, g, unknown or other
  misc_feature (307)..(307): n is a, c, g, or t
tcagcgatcgtatacacgaccggtgctcgatttagtgtgagtagtttgggtttgggcacgaccggtgctcgatttagtgtgagtagtttgggtttgggcacgaccggtgctcgatttagtgtgagtagtttgggtttggggaggagtcagtctcagtcaggacacagcatggacatgagggtccccgctcagctcctggggctcctgctactctggctccgaggtgccagatgtgacatccagatgacccagtcctccatccctcctgtctgcatctgtagganacagatcacatcactcgccgganaagtcagagctattagcagtcttaatttaaatggtatcagacaagaacgaaccgaagggaaacctcccctaactcctagactctatgatcgactatacctaagttagggaaacgtcgggtaccagtacgtaaaggttcgaggtggctaggtgatcgaggactagtactttcactctaaccacttataccgagtacgtaggttcgttcgaccgtaaccgtgtaaaagtttcgtttacgaccttaaccgtttaactaaccg

SEQ ID NO: 310145 - DNA, 605 bp, Homo sapiens
  misc_feature: GZ8MTXP01C18TC.51.78.H01.1.454.CMB.2.raw
  modified_base (271)..(271): a, c, t, g, unknown or other
  misc_feature (271)..(271): n is a, c, g, or t
  modified_base (337)..(337): a, c, t, g, unknown or other
  misc_feature (337)..(337): n is a, c, g, or t
  modified_base (556)..(556): a, c, t, g, unknown or other
  misc_feature (556)..(556): n is a, c, g, or t
  modified_base (578)..(578): a, c, t, g, unknown or other
  misc_feature (578)..(578): n is a, c, g, or t
tcagcgatcgtatacacgaccggtgctcgatttagtgtgagtagtttgggtttgggcacgaccggtgctcgatttagtgtgagtagtttgggtttggggaggagtcagtctcagtcaggacacagcatggacatgagggtccccgctcagctcctggggctcctgctactctggctccgaggtgccagatgtgacatccagatcgacccagtcctccatccctccctgtctgcatcgtagtaggagacagagtcacatcacgtggaccggnaagtcaagagcattagactagtactttaatttaaagtggtatcagacagaacgacgaacggaaacncccctaacctccagtactctagtgaatacgctaactaccgtaaaggtttagggaaacggttcgggacctagtacgtaaagttcgaaggtgactaggagtatcggtagggactagttcttacacttactaccaccgtatacgagcgtagtcggtacgtacgtacgtaggtaactttgtttaacgaacttaacgtttaacacgttagtaacttaaacgttnttaacgttaacaccgtccctancgttacctcgttaacggttaaccgggg

SEQ ID NO: 310146 - DNA, 584 bp, Homo sapiens
  misc_feature: GZ8MTXP01A46JF.51.78.H01.1.454.CMB.2.raw
  modified_base (288)..(288): a, c, t, g, unknown or other
  misc_feature (288)..(288): n is a, c, g, or t
  modified_base (318)..(318): a, c, t, g, unknown or other
  misc_feature (318)..(318): n is a, c, g, or t
  modified_base (374)..(374): a, c, t, g, unknown or other
  misc_feature (374)..(374): n is a, c, g, or t
  modified_base (403)..(403): a, c, t, g, unknown or other
  misc_feature (403)..(403): n is a, c, g, or t
  modified_base (473)..(473): a, c, t, g, unknown or other
  misc_feature (473)..(473): n is a, c, g, or t
  modified_base (513)..(513): a, c, t, g, unknown or other
  misc_feature (513)..(513): n is a, c, g, or t
tcagcgatcgtatacacgaccggtgctcgatttagtgtgagtagtttgggtttgggcacgaccggtgctcgatttagtgtgagtagtttgggtttgggcacgaccggtgctcgatttagtgtgagtagtttgggtttggggaggagtcagtctcagtcaggacacagcatggacatgagggtccccgctcagctcctggggctcctgctactctggctccgaggtgccagatgtgacatccagatgacccagtctccatccctccctgtctgcatctgtagagacagngtcaccatcacttcgccggacaagtcaagngctattagcagacttaatttaaatggtatccagacaagcgaaccgacggggaaacnccccctaaacgtcctagtacttcgttaangtatcgactacgtacgtaagttacggaacggtcggtacctagtacgtaagtcgaggtcggactaggtagngtcggtaggactacgtacttaccactcctaacaacgttancgacgtcgtacgttcgttcgttacgtaacgtagtaacgttacgttacgttaccttaaccgttaacgtaacg

SEQ ID NO: 310147 - DNA, 635 bp, Homo sapiens
  misc_feature: GZ8MTXP01BI0CW.51.78.H01.1.454.CMB.2.raw
  modified_base (242)..(242): a, c, t, g, unknown or other
  misc_feature (242)..(242): n is a, c, g, or t
tcagcgatcgtatacacgaccggtgctcgatttagtgtgagtagtttgggtttgggggggagaggagccccagccctgagattcccaggtgtttccattcagtgatcagcactgaacacagaggactcaccatggagttgggactgagctggattttcctttggcttattttaaaaggtgtccagtgtgaagtgctacgtggtggagtcgtgggggagcctggtacagcctggcaggtcccngagactctcctgtgcagcccttacgtggacttccaccgtttgatgtattatgcccatgaccacgttgggcccgacaacgtccgtccggaaggggaacgggtcctagggacggtggggtcctacggtacgttagttaggttaggaagttaggtaggtagtatacggaaccttagtggtccgggtattcggtgtacgggaacggggcctatttccactatccgaccagacgaaccaacgaccaaacgtaaccctcctagtactcgtacggggaactaaagtcgaactagtcgagagagtctagggacgtacgtaccggtctttacgattaccgttgaccgaacgaaaacgccgaaacggccagaacgcgttagactaaccgttaaagttaaccgg

SEQ ID NO: 310148 - DNA, 624 bp, Homo sapiens
  misc_feature: GZ8MTXP01AWBS9.51.78.H01.1.454.CMB.2.raw
  modified_base (240)..(240): a, c, t, g, unknown or other
  misc_feature (240)..(240): n is a, c, g, or t
  modified_base (336)..(336): a, c, t, g, unknown or other
  misc_feature (336)..(336): n is a, c, g, or t
  modified_base (359)..(359): a, c, t, g, unknown or other
  misc_feature (359)..(359): n is a, c, g, or t
  modified_base (525)..(525): a, c, t, g, unknown or other
  misc_feature (525)..(525): n is a, c, g, or t
tcagcgatcgtatacacgaccggtgctcgatttagtgtgagtagtttgggtttgggcacgaccggtgctcgatttagtgtgagtagtttgggtttggggaggagtcagtctcagtcaggacacagcatggacatgagggtccccgctcagctcctggggctcctgctactctggctccgaggtgccagatgtgacatccagatcgacccagtctccatcctcctgtctgcatctgtaganacagagtcacatctactcggccggacaagtcagagctattagcagtacttaatttaaattggtaatcgagacaagaacgaaccgaacgggaaaccnccccctaaacgtcctagatctangaatcgctactaccgtaaagtttacgggaaaggtccggggtaccaagttacgtaaggttcgaggtcggagtagggttaggtacgtccggtaggggaactacgttactttaccaacttctacgacctagtaccaagcctaggtcgtacgccgtaacgtagtaacttntttaacgacttaaacgttacttacgtacgtaacgaaacgttcgttaacgttaactacccgtaaccctacgacgttactccggttaacggttaaccgggg

SEQ ID NO: 310149 - DNA, 585 bp, Homo sapiens
  misc_feature: GZ8MTXP01B4AD8.51.78.H01.1.454.CMB.2.raw
  modified_base (282)..(282): a, c, t, g, unknown or other
  misc_feature (282)..(282): n is a, c, g, or t
  modified_base (381)..(381): a, c, t, g, unknown or other
  misc_feature (381)..(381): n is a, c, g, or t
  modified_base (401)..(401): a, c, t, g, unknown or other
  misc_feature (401)..(401): n is a, c, g, or t
tcagcgatcgtatacacgaccggtgctcgatttagtgtgagtagtttgggtttgggcacgaccggtgctcgatttagtgtgagtagtttgggtttgggcacgaccggtgctcgatttagtgtgagtagtttgggtttggggaggagtcagtctcagtcaggacacagcatggacatgagggtccccgctcagctcctggggctcctgctactctggctccgaggtgccagatgtgacatccagatgacccagtctccatccctcctgtctgcatctgtaganacagagtcacatcacgttcgccggacaagtcaagagacattacgctagtactttaatttaaagtggtatcgagaccaagaacgaaccgaagggaaaccncccctaactctagatactangatcgacataccgttaaagtttacgggaaacggtcgggtacccagttacgtaaaggttcaaggttggactaggtggacttcggagggactagtactttccaacgttctaacaaccgttatccgagaccgtaggttcgttcgaccgtaactagaaattcgtttacgacttaaccgttaactaacg

SEQ ID NO: 310150 - DNA, 730 bp, Homo sapiens
  misc_feature: GZ8MTXP01DT203.51.78.H01.1.454.CMB.2.raw
  modified_base (289)..(289): a, c, t, g, unknown or other
  misc_feature (289)..(289): n is a, c, g, or t
tcagcgatcgtatacacgaccggtgctcgatttagtgtgagtagtttgggtttgggggggagaggagccccagccctgagattcccaggtgtttaccattcagtgatcagcactgaacacagaggactcaccatggagttgggactgagctggtattttccttttggcttattttaaaaggtgtccagtgtgaagtgctactggtggagtcgtgggggagcctggtacagcctggcaggtccctgagctctctgtgcagcctctggtacttcactttgatgattagtcncctatcgcctacggtcggggtaccccgactaacggccgtaccccggaagggggtaacgggtcccgttaggggagggtttcggggttacctacggttaacggtttagtttaagggttagggtaaacgttagggttaggttaagtttaagtaccggtaacccgttaaggtcgggaccgggtaacctttcggttaggggtacgggtaacgggggtcccgtaactttcccaaccgttactccgtaccgaaggaacgaaaccaaccggtaccctaaacggtacccttacccgtaggttactacccgttagggaaacctaaagttacgaaacgtcgtcgtgaaccgtagcgttaggacggtaccgtccggtaacttgttacttcgagtacgaacgaaacgccaacggcaaaagtcgtactacggttactaacgttaacgttaaccgg

SEQ ID NO: 310151 - DNA, 586 bp, Homo sapiens
  misc_feature: GZ8MTXP01EE2QR.51.78.H01.1.454.CMB.2.raw
  modified_base (242)..(242): a, c, t, g, unknown or other
  misc_feature (242)..(242): n is a, c, g, or t
  modified_base (328)..(328): a, c, t, g, unknown or other
  misc_feature (328)..(328): n is a, c, g, or t
  modified_base (559)..(559): a, c, t, g, unknown or other
  misc_feature (559)..(559): n is a, c, g, or t
tcagcgatcgtatacacgaccggtgctcgatttagtgtgagtagtttgggtttgggcacgaccggtgctcgatttagtgtgagtagtttgggtttggggaggagtcagtctcagtcaggacacagcatggacatgagggtccccgctcagctcctggggctcctgctactctggctccgaggtgccagatgtgacatccagatgacccagtctccatccctccctgtctgcatctgtagganacagagtcacatcactggccggacaagtcagagcaattagcagtcttaatttaaatggtaatcagcaagacgaccgaagggaaacncccctaactccctagatctatgaatgctactacctaaagtttagggaaacggttcggggtaccctattacgaaaggttcaagggtggacgtaggtggattcgagggacagtatttcacttcacacctatcgagctaggttcgtacgacgtaccgtagtaacgttattttaacgaacttaaacttaccttacgtacgtaacaaacgttgttaacgttaaccactaacccctnacgttcttccgttaacgttaaccgggg

SEQ ID NO: 310152 - DNA, 582 bp, Homo sapiens
  misc_feature: GZ8MTXP01BFLQK.51.78.H01.1.454.CMB.2.raw
  modified_base (228)..(228): a, c, t, g, unknown or other
  misc_feature (228)..(228): n is a, c, g, or t
  modified_base (289)..(289): a, c, t, g, unknown or other
  misc_feature (289)..(289): n is a, c, g, or t
  modified_base (322)..(322): a, c, t, g, unknown or other
  misc_feature (322)..(322): n is a, c, g, or t
  modified_base (498)..(498): a, c, t, g, unknown or other
  misc_feature (498)..(498): n is a, c, g, or t
  modified_base (517)..(517): a, c, t, g, unknown or other
  misc_feature (517)..(517): n is a, c, g, or t
tcagcgatcgtatacacgaccggtgctcgatttagtgtgagtagtttgggtttgggcacgaccggtgctcgatttagtgtgagtagtttgggtttgggcacgaccggtgctcgatttagtgtgagtagtttgggtttggggaggagtcagtctcagtcaggacacagcatggacatgacgggtccccgctcagctccgtggggctcctgctactctggctccgaggtnccagatgtgacatccagatcgacccagtcctccatccctcctgtctgcatctaggtagganacagacgtccaccatcctacgttcggccggganaagtcagacgactattagactagtactttaatttaaacgtggtaatcgagacaagaacgaaccgaaacggggaaacctccccctaaactcctagtactctatgatcgactataccgtaagtttacgggaacggtcggacctagtacgtaaggttcgaggtcgacaggtcgatcggnggaactgtacttcacttcncaacttatcagtacgtagttcgcgacgtaactaggtaacttactttcgacttaacgttcgtaacg

SEQ ID NO: 310153 - DNA, 631 bp, Homo sapiens
  misc_feature: GZ8MTXP01DBDY0.51.78.H01.1.454.CMB.2.raw
  modified_base (200)..(200): a, c, t, g, unknown or other
  misc_feature (200)..(200): n is a, c, g, or t
  modified_base (284)..(284): a, c, t, g, unknown or other
  misc_feature (284)..(284): n is a, c, g, or t
tcagcgatcgtatacacgaccggtgctcgatttagtgtgagtagtttgggtttggggaggagtcagtctcagtcaggacacagcatggacatgagggtccccgctcagctcctggggctcctgctactctggctccgaggtgccagatgtgacatccagatgacccagtcctccatccctcctgtctgcatctgtagganacagagtcaccatcacttgccgggcaagtcaagagacattagcagtacttaattaaatggtatcagcagacgacgaaggaaacncccctaactctagatctatgatgctataccgtaaagtttaggaaacggtccgggtaccctagtcgtaaacggttcaagggttcgcgtaggtcggaactcggtagggactagtactttaccacttccacactatacgagtcgtaaggtcgtacgaccgtaactaagtaaacgtttgttttaacgaacctttaaacctttactacttacgtaacaaacgtaaacgttacgttaacctaccgttacccctgaacctccgttacgttacggttcggggaaaccgggtacgggaaccggttagggttacggaataaacgtaacgtaaaacggcggttacggtcgccgtaacg

SEQ ID NO: 310154 - DNA, 662 bp, Homo sapiens
  misc_feature: GZ8MTXP01ADQN1.51.78.H01.1.454.CMB.2.raw
  modified_base (200)..(200): a, c, t, g, unknown or other
  misc_feature (200)..(200): n is a, c, g, or t
  modified_base (232)..(232): a, c, t, g, unknown or other
  misc_feature (232)..(232): n is a, c, g, or t
  modified_base (278)..(278): a, c, t, g, unknown or other
  misc_feature (278)..(278): n is a, c, g, or t
  modified_base (289)..(289): a, c, t, g, unknown or other
  misc_feature (289)..(289): n is a, c, g, or t
  modified_base (570)..(570): a, c, t, g, unknown or other
  misc_feature (570)..(570): n is a, c, g, or t
tcagcgatcgtatacacgaccggtgctcgatttagtgtgagtagtttgggtttggggaggagtcagtctcagtcaggacacagcatggacatgagggtccccgctcagctcctggggctcctgctactctggctccgaggtgccagatgtgacatccagatgacccagtctccatccctccctgtctgcatctgtagganacagatcacatcacttgccgggcaagtcagancattagcagtcttaattaaatggtatcagcagagaccagggaaacncccctaactcngactctatcgatgactattacctaaagtttagggaaaggtccgggggtacccagttaccgtaaagggttcaaagggttcggaacgtagggtcgggtaaacttcggtaggggacaggttactttaccaacttccttacaaccctattacccgaaaggtcctaagggtcgttacggccgtaaccgtagtaaacggtttagtttttacgaacttaaacctttaccttaacgttcggtaaccaaaccgttaaggtaaccgttttaccaaaccggtttaccccccntaacggtcccttacgtaccggtttcggggaccgggtaacgggaccgttaagggttacgggaagtcgaacgaaacgtacgttgtcgcgtaacg

SEQ ID NO: 310155 - DNA, 677 bp, Homo sapiens
  misc_feature: GZ8MTXP01A9PPO.51.78.H01.1.454.CMB.2.raw
  modified_base (244)..(244): a, c, t, g, unknown or other
  misc_feature (244)..(244): n is a, c, g, or t
  modified_base (647)..(647): a, c, t, g, unknown or other
  misc_feature (647)..(647): n is a, c, g, or t
tcagcgatcgtatacacgaccggtgctcgatttagtgtgagtagtttgggtttgggcacgaccggtgctcgatttagtgtgagtagtttgggtttggggaggagtcagtctcagtcaggacacagcatggacatgagggtccccgctcagctcctggggctcctgctactctggctccgaggtgccagatgtgacatccagatcgacccagtcctccatccctccctgtctgcatctgtagganacagagtcacatcactcggccggtacaagtcagagactattacgctacgtactttaaatttaaagttggtaactacgtaggacaaggaacgaaaccggaaacgggtaaaaccgtaccccccttaaacctcccccgtagtaacttcctaagtcgtaaacgtcgaactacgttaacccgtaaaggttttacgggaaaacgggtttccggggtacccctaagttacgtaaaggttccgtaaagggtcggacgtaagggtacggtaacgtccggtagggaacctagttacttactacctcgtacctactactcgagtactaggtagtacgacgtacgtagtacgttatttaacgaacttacttacttcgtacgtaacaagttcgttaactaaccgtaccgtaacccngaccgttacgtccggttaacgtaaccgggg

SEQ ID NO: 310156 - DNA, 637 bp, Homo sapiens
  misc_feature: GZ8MTXP01CAX5C.51.78.H01.1.454.CMB.2.raw
  modified_base (268)..(268): a, c, t, g, unknown or other
  misc_feature (268)..(268): n is a, c, g, or t
  modified_base (309)..(309): a, c, t, g, unknown or other
  misc_feature (309)..(309): n is a, c, g, or t
  modified_base (383)..(383): a, c, t, g, unknown or other
  misc_feature (383)..(383): n is a, c, g, or t
tcagcgatcgtatacacgaccggtgctcgatttagtgtgagtagtttgggtttgggcacgaccggtgctcgatttagtgtgagtagtttgggtttgggcacgaccggtgctcgatttagtgtgagtagtttgggtttgggaggagtcagtctcagtcaggacacagcatggacatgagggtccccgctcagctcctgggctcctgctactctggctccgaggtgccagatgtgacatccagatcgacccagtctccatcctcctgtcngcatcgtagtagagacagagtcaccatcacttcggccgganaagtcaagacgcaattacgacacgtctttaaatttaaacgtggtatacagacagaacgtaccaaaggggaaacncccctaaactctagatctatagatcgactaataccgtaaagtttgggaaacggttcgggtaccctaagttaccgaaagggtttcgaacggttgggtacctaaacggtggtaaaccgttccggtaggggtaaaccctaggttaaacttttccaaaccgttcctaacaaacccgttaattccgaagtaccgtaaggttcggttcgaccggtaaccctagggtaactttacgtttcgaaccttaaacgttctaaccg

SEQ ID NO: 310157 - DNA, 575 bp, Homo sapiens
  misc_feature: GZ8MTXP01CN8A3.51.78.H01.1.454.CMB.2.raw
tcagcgatcgtatacacgaccggtgctcgatttagtgtgagtagtttgggtttgggggggagaggagccccagccctgagattcccaggtgtttccattcagtgatcagcactgaacacagaggactcaccatggagttgggactgagctggattttccttttggctattttaaaaggtgtccagtgtgaagtgctactggtggagtcgtgggggagcctggtacagcctggcaggtccctgagactctcctgtgcagcctctggacttcacctttgatgattatcgccatgcacgtcgggtccgcaagctccgagggaacggccgtggagtcggtctacacgttagttagttggaattaggtggtagtatgcctagtgcggactcgtgtgaagggccattcacatctacagagacaacgcaacgacctcctgtactctacggacaaagtgaactgtctaggagtacggcctggaacgggtaccgacgggtcccttagttacgttacgttgaccggaacaaaacggaccaacgggaacaacgcgtacttgggttaacctaacgttaacgttaacg

SEQ ID NO: 310158 - DNA, 604 bp, Homo sapiens
  misc_feature: GZ8MTXP01C4Q80.51.78.H01.1.454.CMB.2.raw
  modified_base (290)..(290): a, c, t, g, unknown or other
  misc_feature (290)..(290): n is a, c, g, or t
  modified_base (321)..(321): a, c, t, g, unknown or other
  misc_feature (321)..(321): n is a, c, g, or t
tcagcgatcgtatacacgaccggtgctcgatttagtgtgagtagtttgggtttgggcacgaccggtgctcgatttagtgtgagtagtttgggtttgggcacgaccggtgctcgatttagtgtgagtagtttgggttggggaggagtcagtctcagtcaggacacagcatggacatgagggtccccgctcagctccgtggggctcctgctactctggctccgaggtgccagatgtgacatccagactcgacccagtcctccactccctcctgtctagctatctggtaaggngacagagtaccacatcacgttcgccgggtanaagtcgagacgctaagttacgcgtaatctttaaagtttaaagtcggtaataccaagaacaaagaacggaaacccgaaaggggaaaccctacccccttaactccgtagtaatctatcgaatcgactactaccgtaagtttaggaaacgtcgggtaccaatcgaaacgttgacgtggctaaggcgtagtcgtaggaacctgtaactttccactttcaacacttatacaggtactaaggttcgttagcccgtaataggtaattacttcgaacttaacttgtaaccg

SEQ ID NO: 310159 - DNA, 713 bp, Homo sapiens
  misc_feature: GZ8MTXP01EU1OI.51.78.H01.1.454.CMB.2.raw
tcagcgatcgtatacacgaccggtgctcgatttagtgtgagtagtttgggtttgggggggagaggagccccagccctgagattcccaggtgtttccattcagtgatcagcactgaacacagaggactcaccatggagttgggactgagctggatttttcctttggcttattttaaaaggtgtccagtgtgaagtgctacgtggtggagtcgtgggggagcctggtacagcctggcacggtccctgagactctcctgtgcagtccctctggtacttctactttgatgattatcgcctagtcgccgtacgtcggggtacccgacgaacgccgttacccggagggggaacgggtcccgttagggggacggtttcgggggttacctacgtaacggtttaagtttagggttaggtaaagttagggttaggttaagttagtaacgtaacccgttaagtcggtacggtaacttcgttagggtacgggaaacggggtccctaatttcccaactacttccgaccgaagaacgaacaaccggaccaaacgtaacctcccgtagtacttcacggaactaaaagtcgaactacgtgtaggacgacgtcgtagggaaccggaacgtcccgggttctttaggttaacttacgcgaaccgaaacgaaaacggccgaaagaacccaagtaacgtaccggtaggttaacctccgttaaagttaacccggg

SEQ ID NO: 310160 - DNA, 518 bp, Homo sapiens
  misc_feature: GZ8MTXP01AWQIJ.51.78.H01.1.454.CMB.2.raw
  modified_base (316)..(316): a, c, t, g, unknown or other
  misc_feature (316)..(316): n is a, c, g, or t
  modified_base (443)..(443): a, c, t, g, unknown or other
  misc_feature (443)..(443): n is a, c, g, or t
  modified_base (495)..(495): a, c, t, g, unknown or other
  misc_feature (495)..(495): n is a, c, g, or t
tcagcgatcgtatacacgaccggtgctcgatttagtgtgagtagtttgggtttgggcacgaccggtgctcgatttagtgtgagtagtttgggtttggggaggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcactgccggcaagtcagagcattagcagctatttaaatggtatcagcagagacagggaaacncccctaactccctgatctatgaatgcatcctaaatttgggaaagtggggtacccatacgaagttcagtggcagtggatcgtgggacagtattcactctcaccatcagcagtgtagcgtactgaagtntttcgcttaacttacacgtagtaccaagttgacgtttaaccacgtaaccctnacgcctcgttaacgtttccgggg

SEQ ID NO: 310161 - DNA, 581 bp, Homo sapiens
  misc_feature: GZ8MTXP01BLB5E.51.78.H01.1.454.CMB.2.raw
  modified_base (242)..(242): a, c, t, g, unknown or other
  misc_feature (242)..(242): n is a, c, g, or t
  modified_base (274)..(274): a, c, t, g, unknown or other
  misc_feature (274)..(274): n is a, c, g, or t
  modified_base (327)..(327): a, c, t, g, unknown or other
  misc_feature (327)..(327): n is a, c, g, or t
  modified_base (435)..(435): a, c, t, g, unknown or other
  misc_feature (435)..(435): n is a, c, g, or t
tcagcgatcgtatacacgaccggtgctcgatttagtgtgagtagtttgggtttgggcacgaccggtgctcgatttagtgtgagtagtttgggtttggggaggagtcagtctcagtcaggacacagcatggacatgagggtccccgctcagctcctggggctcctgctactctggctccgaggtgccagatgtgacatccagatgacccagtctccatccctccctgtctgcatctgtagganacagagtcaccatcactgccgggcaagtcagngcattagcagtcttaatttaaatggtatcagcaggacgaccgaagggaaaccncccctaacctccctagactctatgaatgcataccagtttacggaagtcgggtaccatcaagttcagtgcagtgatcgtagggacagtactttacgactcgtacactancgtaagccgtagtcgtacgaccgtaaccttaggtaacgttacttttaacgaacttaaactttacttacgtcgttaacaaacgttcgttaacgttaaccgaccgtaaccccttacggacttaccttccgttaacgtttaacccgggg

SEQ ID NO: 310162 - DNA, 565 bp, Homo sapiens
  misc_feature: GZ8MTXP01DG0SD.51.78.H01.1.454.CMB.2.raw
  modified_base (197)..(197): a, c, t, g, unknown or other
  misc_feature (197)..(197): n is a, c, g, or t
  modified_base (278)..(278): a, c, t, g, unknown or other
  misc_feature (278)..(278): n is a, c, g, or t
tcagcgatcgtatacacgaccggtgctcgatttagtgtgagtagtttgggtttggggaggagtcagtctcagtcaggacacagcatggacatgagggtccccgctcagctcctggggctcctgctactctggctccgaggtgccagatgtgacatccagatgacccagtctccatcctcctgtctgcatctgtaganacagagtcacatcacttgccgggcaagtcagagcattagcagctaattaaattggtatcaagcagacgaccagggaaaccncccctaactctagatactatgatgactattacctaagtttaggaacggttccgggtacccatacgtaaggttcaagtggcgtagtgatcgtaggactagtattcactctacactatacagtctagtgcgacgtactagtaagttagtttacgtacttaacttactactagtaactaacgtaagtaacgttaacctacgtaccctataacgtccttacgtacgtttcgggacgggtaacgggacgagggttacggaagtataacgaaacgtacgttggtcgttcgtcg

SEQ ID NO: 310163 - DNA, 706 bp, Homo sapiens
  misc_feature: GZ8MTXP01BJ5SO.51.78.H01.1.454.CMB.2.raw
  modified_base (199)..(199): a, c, t, g, unknown or other
  misc_feature (199)..(199): n is a, c, g, or t
  modified_base (223)..(223): a, c, t, g, unknown or other
  misc_feature (223)..(223): n is a, c, g, or t
tcagcgatcgtatacacgaccggtgctcgatttagtgtgagtagtttgggtttggggaggagtcagtctcagtcaggacacagcatggacatgagggtccccgctcagctcctggggctcctgctactctggctccgaggtgccagatgtgacatccagatgacccagtctccatcctccctgtctgcatctgtagganacagagtcacatcacttgccgggnaagtcagagcattagcagcttaattaaattggtatcagcagacgaccgaagggaaaccgcccctaacctcctagattactatgatgactacttacctaagtttagggaaacgttccggggtacccagtacgtaaggttccgaaggttcgggcgtagggtacgggtagttacggtacggggtaacaggtttactttccacttcctaccaacctactacgaacgacgtaggtacggtacgaccgtaaccgttaggtaaacgtttacggtttttacgaacctttaaaccgtttaacgttaaccttcggttaaacccaaagtaaacgggttaaccttaaaccgtacccggttaacccctcgtaacggtccccttacggttacccggtttaccggggaccggggtaacgggttaacccggttagggggttacggtaacgtaacgtaaacccgtaaaacggtaccggttagggtcggttcgttaacccg

SEQ ID NO: 310164 - DNA, 564 bp, Homo sapiens
  misc_feature: GZ8MTXP01CSHK3.51.78.H01.1.454.CMB.2.raw
  modified_base (254)..(254): a, c, t, g, unknown or other
  misc_feature (254)..(254): n is a, c, g, or t
  modified_base (282)..(282): a, c, t, g, unknown or other
  misc_feature (282)..(282): n is a, c, g, or t
  modified_base (285)..(285): a, c, t, g, unknown or other
  misc_feature (285)..(285): n is a, c, g, or t
  modified_base (352)..(352): a, c, t, g, unknown or other
  misc_feature (352)..(352): n is a, c, g, or t
  modified_base (366)..(366): a, c, t, g, unknown or other
  misc_feature (366)..(366): n is a, c, g, or t
  modified_base (514)..(514): a, c, t, g, unknown or other
  misc_feature (514)..(514): n is a, c, g, or t
tcagcgatcgtatacacgaccggtgctcgatttagtgtgagtagtttgggtttgggcacgaccggtgctcgatttagtgtgagtagtttgggtttgggcacgaccggtgctcgatttagtgtgagtagtttgggtttgggaggagtcagtctcagtcaggacacagcatggacatgagggtccccgctcagctccgtgggctcctgctactctggctccgagtgccagatgtgacatccagatgacccagtccnccatccctcctgtctgcatctgtagganacngatcaaccatcacttggccggacaagtcagagctattagcagtcttaatttaaatgatcagacaagngaaccagggaaacnccccctaaacgtctagactactatcgatgactaactacgtaaagtttagggaaaacgtcggggaccctaatacgtaaaggttccgtaaggttgacgtagggtacgtagtcgtagggaaacctagtactttacacttctaacaccatcngtactgttgcgacgaaccgtagtaagttctttacgactaaccttcgtaac

SEQ ID NO: 310165 - DNA, 719 bp, Homo sapiens
  misc_feature: GZ8MTXP01DZOXW.51.78.H01.1.454.CMB.2.raw
tcagcgatcgtatacacgaccggtgctcgatttagtgtgagtagtttgggtttgggggggagaggagccccagccctgagattcccaggtgtttccattcagtgatcagcactgaacacagaggactcaccatggagttgggactgagctggattttcctttggcttaattttaaaaggtgtccagtgtgaagtgctactggtggagtcgtgggggagcctggtacagcctggcaggtccctgagactctcctgtgcagcctctggattcactttgatgattatgacctatcgcacgtcgggtcccgacaagcctaccgaagggggaacgggccgtaggggaggttcggggtctacgtaacggttaagtttaggttaggtaaagtaggttaggttagtagtacgacccttaagtgggcgtacgtcgtaggtacgggtaacgggggccctaattcccaacctacgttaccaccgaaacggaaacgaaacccgaaaccgacccctaaaacggtaacccctccccttaaggttactaccggttaacgaaactaaagtacgaaacgtacgtacgtagaacgacgtacgtaggaacggtaccgtaaccggttctttaagttacgttaaccgttacgaaaccgtaaacgaaaaaccggcccgttaaacgaaccgtaaacgtaacggtaccggttacgttaaccgttaacgttaaacgttaaccgg

SEQ ID NO: 310166 - DNA, 535 bp, Homo sapiens
  misc_feature: GZ8MTXP01BWT9K.51.78.H01.1.454.CMB.2.raw
  modified_base (224)..(224): a, c, t, g, unknown or other
  misc_feature (224)..(224): n is a, c, g, or t
  modified_base (278)..(278): a, c, t, g, unknown or other
  misc_feature (278)..(278): n is a, c, g, or t
  modified_base (465)..(465): a, c, t, g, unknown or other
  misc_feature (465)..(465): n is a, c, g, or t
tcagcgatcgtatacacgaccggtgctcgatttagtgtgagtagtttgggtttggggaggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggnaagtcagagcattagcagcttaattaaatggtatcagcagagaccagggaaacncccctaactcctagatctatgatgacatacctaagtttgggaaagtcggggtacccagtacgaaggttcaaggtcgcaggtggatcgtgggacagtatttcactcacacatcagcagtgcgcgactagaagtatttgactaacttactactagtacaaacgtagtacgttaaccaccgtacccctanaacgtcttacgtacgttcggacgggtaacggacgttaggagaagtacaacgaacgtcgttggtcgcgtcg

SEQ ID NO: 310167 - DNA, 608 bp, Homo sapiens
  misc_feature: GZ8MTXP01BST74.51.78.H01.1.454.CMB.2.raw
  modified_base (270)..(270): a, c, t, g, unknown or other
  misc_feature (270)..(270): n is a, c, g, or t
  modified_base (285)..(285): a, c, t, g, unknown or other
  misc_feature (285)..(285): n is a, c, g, or t
  modified_base (313)..(313): a, c, t, g, unknown or other
  misc_feature (313)..(313): n is a, c, g, or t
  modified_base (391)..(391): a, c, t, g, unknown or other
  misc_feature (391)..(391): n is a, c, g, or t
  modified_base (497)..(497): a, c, t, g, unknown or other
  misc_feature (497)..(497): n is a, c, g, or t
  modified_base (546)..(546): a, c, t, g, unknown or other
  misc_feature (546)..(546): n is a, c, g, or t
tcagcgatcgtatacacgaccggtgctcgatttagtgtgagtagtttgggtttgggcacgaccggtgctcgatttagtgtgagtagtttgggtttgggcacgaccggtgctcgatttagtgtgagtagtttgggtttggggaggagtcagtctcagtcaggacacagcatggacatgagggtcccgctcagctccgtggggctcctgctactctggctccgaggtgccagatgtgacatccagactcgaccagtcctacactccctcctntctgcatctagaganacagatcaccatctacgttcgaccgganaagtcagacgactatacgactagtactttaaactttaagtgtatcagtaacaaggaacgaaccgaaagggtaaacccnccccgttaaactccgtagtactacttagtgtaacgtcgacttaactaccgttaaaggtttacgggaaagggtcggtacccaagttacgtaaggttcgaggtacggngtaggtgactacgggtgaacttacgtactttccaaccttcaacctaacngtacgcgtacgcgttagcggttaactccgtagtaacttagttacgaccttaacttcgtaacg

SEQ ID NO: 310168 - DNA, 730 bp, Homo sapiens
  misc_feature: GZ8MTXP01DCXET.51.78.H01.1.454.CMB.2.raw
  modified_base (204)..(204): a, c, t, g, unknown or other
  misc_feature (204)..(204): n is a, c, g, or t
  modified_base (314)..(314): a, c, t, g, unknown or other
  misc_feature (314)..(314): n is a, c, g, or t
  modified_base (594)..(594): a, c, t, g, unknown or other
  misc_feature (594)..(594): n is a, c, g, or t
tcagcgatcgtatacacgaccggtgctcgatttagtgtgagtagtttgggtttggggaggagtcagtctcagtcaggacacagcatggacatgagggtccccgctcagctcctggggctcctgctactctggctccgaggtgccagatgtgacatccagatcgacccagtcctccatccctcctgtctgctatctaggtagganacagagtcaccatcacgttcggccgggacaagtcaagagactaagtttagctaagtactttaaattaaagttggtatcgaagacaaaggacgaaccgaaggggaaacccnccccttaacctctagacttctatgtatcgactacttacgtaaagtttacgggaaacggttcccgggtaccctaagttacgtaaaggttcaaagggttcggaacgtagggtaggtacttcgggtacggaactagttactttacacttacctacacctattacgagtactagtcgtacggactaaccgtagtaaacgttattttacgaacctttaaacgttaccttacgtacggtaacccaaagttaacgggtaaccttaaaccgtaccccgtttaaccccngtaaccggttccttacccgggtttaacggttccggggaaaccgggggtaacggttaaacccggaaggggttacgtaaacttaaacggttaaacccgaaaaacgggttccgttggggtaaccggttaactaacccgg

SEQ ID NO: 310169 - DNA, 730 bp, Homo sapiens
  misc_feature: GZ8MTXP01C741O.51.78.H01.1.454.CMB.2.raw
  modified_base (300)..(300): a, c, t, g, unknown or other
  misc_feature (300)..(300): n is a, c, g, or t
  modified_base (630)..(630): a, c, t, g, unknown or other
  misc_feature (630)..(630): n is a, c, g, or t
tcagcgatcgtatacacgaccggtgctcgatttagtgtgagtagtttgggtttggggaggagtcagtctcagtcaggacacagcatggacatgagggtccccgctcagctcctggggctcctgctactctggctccgaggtgccagatgtgacatccagatcgacccagtcctccatccctccctgtctgcatctggtaggagacagagtccaccatcacgttcggccgggactaagtcaagagcaattagctagtacttaattaaagttggtatcaagcaagacgacgaagggaaaccncccctaactcatactctatagtatcgactaattaccgtaaaggtttaggaaacggttcccgggggtacccctagttacgtaaagggttccgtaaagggttcgggcgtaaggggttcggtaacgttacgggtacgggtaactacggtttaactttacccaacttaccctaaccaaccttaacgttaccgaaacggtcgtaagggttcggttacggaaccgttaaccgttaaggttaaaaccggtttatttttttaacgaaacctttaaaactttaccgtaacttaacgtaactaaacgtaacgtaaccggttaacctaccgttaacccctntaaaccgtccttacggttaccggttcgggaaccgggtacggaaaccggttagggttacgaagtaacgtaacgtaaaccggtagtttcggcgttcgtaacc

SEQ ID NO: 310170 - DNA, 626 bp, Homo sapiens
  misc_feature: GZ8MTXP01AQ4Y4.51.78.H01.1.454.CMB.2.raw
  modified_base (318)..(318): a, c, t, g, unknown or other
  misc_feature (318)..(318): n is a, c, g, or t
tcagcgatcgtatacacgaccggtgctcgatttagtgtgagtagtttgggtttgggcacgaccggtgctcgatttagtgtgagtagtttgggtttgggcacgaccggtgctcgatttagtgtgagtagtttgggtttggggaggagtcagtctcagtcaggacacagcatggacatgagggtccccgctcagctcctggggctcctgctactctggcctccgaggtgccagatgtgacatccagatcgacccagtcctccactccctccctgtctgctatctagaggagacagtacgtccaccatcacttggccgganaagtcagagctatagcagtcttaatttaaagtgtatcagacaagaacgaaccgaagggtaaacctccccgtaaactcctagtactactatacgatacgactaagtaccgtaaaggtttacgggaaacggttcggggtaccctaagtacgttaacggttacgaaggtcggacgtaggtagacgtacggtagggaacctagttaccttaccaacctttcaaccctaaccttacgttacgaacgtccgtaaggttcgcgttacggtaaccgtaggtaacttcgtttacgaccttaaaccgttaacttaacg

SEQ ID NO: 310171 - DNA, 712 bp, Homo sapiens
  misc_feature: GZ8MTXP01DHK4E.51.78.H01.1.454.CMB.2.raw
  modified_base (287)..(287): a, c, t, g, unknown or other
  misc_feature (287)..(287): n is a, c, g, or t
  modified_base (649)..(649): a, c, t, g, unknown or other
  misc_feature (649)..(649): n is a, c, g, or t
  modified_base (680)..(680): a, c, t, g, unknown or other
  misc_feature (680)..(680): n is a, c, g, or t
tcagcgatcgtatacacgaccggtgctcgatttagtgtgagtagtttgggtttgggggggagaggagccccagccctgagattcccaggtgtttccattcagtgatcagcactgaacacagaggactcaccatggagttgggactgagctggtatttttccttttggcttaattttaaaaggtgtccagtgtgaagtgctactggtggagtcgtgggggaggcctggtacagcctggcaggtccctgagactctctgtgcagcctctggattcactttgatgattangcatcgctacgtggggtcccgacgaacgtccgtacccggaagggggaacgggggtcccgttgggggaacgggtttcgggggtcctaccgtaacggtttaagtttaagggtttagggtaaatttagggttagggttaagttagtaacgtacccgttaagtcgggccgggtaacttcgtgggtacgggaaacggggtccgtattaccgaacctacttccgaccaaggacgaaaccgaaaccggacctaaaacggaaaccccttcccgttagtaacttccgtaggtaaccgtaaaagtaccgaaacgtagtccgtaggaagaacggtctaggaacgaccgtacggtaacctttggttacttacgngaccgaacaaaacggcaaacggaacaaacgngactacggttactaaccgttaaagttaaccgg

SEQ ID NO: 310172 - DNA, 693 bp, Homo sapiens
  misc_feature: GZ8MTXP01CYTAV.51.78.H01.1.454.CMB.2.raw
  modified_base (224)..(224): a, c, t, g, unknown or other
  misc_feature (224)..(224): n is a, c, g, or t
  modified_base (287)..(287): a, c, t, g, unknown or other
  misc_feature (287)..(287): n is a, c, g, or t
tcagcgatcgtatacacgaccggtgctcgatttagtgtgagtagtttgggtttggggaggagtcagtctcagtcaggacacagcatggacatgagggtccccgctcagctcctggggctcctgctactctggctccgaggtgccggatgtgacatccagatcgacccagtctccatccctcctgtctgcatctgtagagacagatcaccatcacttggccgganaagtcagagctaattagctagtacttaatttaaagtggtatcagacagacgaccgaaggaacncccctactctgatctaatgatcgacacttaccgtaaagtttacggaaacggtcggggtaccccctaagtacgtaacggttcgaggtacgggaacgtaaggtacgggtaacgtacggtaggggaactaacggttacttttaccaaccctttacctacccaacctattacccgaaggaccgttaaggtcgtacgggacctaaccgttaggtaaactttacgttttacgaacccttaaacttttacgtaacgttacgtaaacctaaacgtacggttaaacttaaccgtacccgttaaccccctgtaccgtccgttaccgttaacgggtttcgggaacgggtaaacgggtacgttaaagggttggaaactaacggttaaacgaaccgtaacgtggacgaacgttcgaacc

SEQ ID NO: 310173 - DNA, 597 bp, Homo sapiens
  misc_feature: GZ8MTXP01AXLOX.51.78.H01.1.454.CMB.2.raw
  modified_base (200)..(200): a, c, t, g, unknown or other
  misc_feature (200)..(200): n is a, c, g, or t
  modified_base (225)..(225): a, c, t, g, unknown or other
  misc_feature (225)..(225): n is a, c, g, or t
tcagcgatcgtatacacgaccggtgctcgatttagtgtgagtagtttgggtttggggaggagtcagtctcagtcaggacacagcatggacatgagggtccccgctcagctcctggggctcctgctactctggctccgaggtgccagatgtgacatccagatgacccagtctccatccctccctgtctgcatctgtagganacagagtcaccatcacttgccgggnaagtcagagcattagcagcttaattaaatggtatcagcagagaccgaggaaacgcccctaacctctgatctatgatgcatccaattggaagtcggccatcgaagtcaagtgctagtgatcgagggacagtatttcatcctcacatcaagtcagtgacgcgtaactagtaaacgtacttttagaaccttaaactttaccgtaactcgttaccaaacgtacgtaacgtttaaccgaaccgttaccccctacgtaacgtcccttacgtacccgggtttacgggccggggtaaacgggttacccggttaaagggttcggaaacgtaacgtttaacgaaaaacccgggtagttcggggttaacggcccgttaaccgg

SEQ ID NO: 310174 - DNA, 916 bp, Homo sapiens
  misc_feature: GZ8MTXP01DCKVX.51.78.H01.1.454.CMB.2.raw
tcagcgatcgtatacacgaccggtgctcgatttagtgtgagtagtttgggtttgggggggagaggagccccagccctgagattcccaggtgtttccattcagtgatcagcactgaacacagaggactcaccatggagttgggactgagctggtatttttccttttggcttaattttaaaaggtgtccagtgtgaagtgctactggtggagtcgtgggggagcctggtacagcctggcaggtccctgagactctcctgtgcagcctctggattctacctttgatgtattatcgaccagtcgccgtacggttcgggggtccccggacgaaacggtccgttaccccgggaaggggggtaacgggcccggttagggggacggtttcgggggtccttacggtaacggtttaagtttaagggttaggtaaaacgttagggttagggtaagttatacggtacccttaagttcgggacggtaacttcgtagggttacgggaaacggggggtccctaaactttacccaacccgtactttacccgtaacccgaaacggaaacccggaaacccgtaaaacccggtacccaaaaaccgggtaaacccccttccccgttaagttaaccgttaccgttaacggggaaaacccttaaaaagttaacgggaaaaccctaagggtttacccgtacgggtaaaggtaaccggacgttaacggggaaaccggggtaacccgtaaccgggggtttaacccctttttaagggttaaaccgtttttaaaccggttaaccgggtaaacccggtaaaaacccgaaaaaaccggggaaccccgttaaaaacgggggaacccttaaaaacccgggaaccgggttaaccggtttaacggggtttaaaccctaaacccggttaaaaagttttaaaaccccgggg

SEQ ID NO: 310175 - DNA, 727 bp, Homo sapiens
  misc_feature: GZ8MTXP01DIA66.51.78.H01.1.454.CMB.2.raw
  modified_base (270)..(270): a, c, t, g, unknown or other
  misc_feature (270)..(270): n is a, c, g, or t
  modified_base (290)..(290): a, c, t, g, unknown or other
  misc_feature (290)..(290): n is a, c, g, or t
tcagcgatcgtatacacgaccggtgctcgatttagtgtgagtagtttgggtttgggggctctgggagaggagccccagccctgagattcccaggtgtttccattcagtgatcagcactgaacacagaggactcaccatggagttgggactgagctggtattttccttttggcttaattttaaaaggtgtccagtgtgaagtgctactggtggagtcgtgggggagcctggtacagcctggcaggtccctgagactctcctgtgcagcctntggattcacttgatgattancgcctatgccacgtcgggtccgacaagccgtaccggagggggaacgggtccgtaggggagttcgggtactcgtacggtttagttaggttaggtaagttaggtaggttaaagttagtaacgtcccttaagtcgggaccggtacttcggtagggtacgggtaaccgggtccgtaacgtttacccaaccctaacgttcccgtaaccgaaggaacgaaacccgaaaccggaacccaaaacggtacccttaccccgttagtttaaccgttccgttaacgaaaccgtaaaagttaccggaaacgttacggttaccgtaagaacggtacggacgtacggaaacgggtaaccgttaccgggttacccttagttaacgttccgacgttccgaaacgaaaacgaccgaaagggtaccaaacgttacggtaacgttaacggttaaccg

SEQ ID NO: 310176 - DNA, 599 bp, Homo sapiens
  misc_feature: GZ8MTXP01EIKC8.51.78.H01.1.454.CMB.2.raw
  modified_base (269)..(269): a, c, t, g, unknown or other
  misc_feature (269)..(269): n is a, c, g, or t
  modified_base (278)..(278): a, c, t, g, unknown or other
  misc_feature (278)..(278): n is a, c, g, or t
  modified_base (333)..(333): a, c, t, g, unknown or other
  misc_feature (333)..(333): n is a, c, g, or t
  modified_base (517)..(517): a, c, t, g, unknown or other
  misc_feature (517)..(517): n is a, c, g, or t
  modified_base (574)..(574): a, c, t, g, unknown or other
  misc_feature (574)..(574): n is a, c, g, or t
tcagcgatcgtatacacgaccggtgctcgatttagtgtgagtagtttgggtttgggcacgaccggtgctcgatttagtgtgagtagtttgggtttgggggaggagtcagtctcagtcaggacacagcatggacatgagggtccccgctcagctcctggggctcctgctactctggctccgaggtgccagatgtgacatccagatcgacccagtctccactcctcctgtctgcatctgtaggagacagagtcacatcacgtggccggganaagtcaganctattagcagtacttaatttaatggtatcagacaagacgaaccgaagggaaaccncccctaactccctagatctatgaatgctataccgtaaagttagggaacggtcggggtaccatacgtaaggttcaggtcgcgtaggtaggacttcggtacgggaactacttactttacaccttacgtaccaacctaacgtccgaagtccgtaaggtcgtacgtccgtaaccgtagtaaacggttntttaacgaacttaactttcttactagtaacaacgttgttacgttaacactaaccctncgttactccgttaacgtaaccgggg

SEQ ID NO: 310177 - DNA, 646 bp, Homo sapiens
  misc_feature: GZ8MTXP01COLVM.51.78.H01.1.454.CMB.2.raw
  modified_base (302)..(302): a, c, t, g, unknown or other
  misc_feature (302)..(302): n is a, c, g, or t
  modified_base (319)..(319): a, c, t, g, unknown or other
  misc_feature (319)..(319): n is a, c, g, or t
tcagcgatcgtatacacgaccggtgctcgatttagtgtgagtagtttgggtttgggcacgaccggtgctcgatttagtgtgagtagtttgggtttggggaggagtcagtctcagtcaggacacagcatggacatgagggtccccgctcagctcctggggctcctgctactctggctccgaggtgccagatgtgacatccagatcgacccagtctccatcctccctgtcctgcatctgtaggagacagagtcacatcactgccgggacaagtcagagcattagcagtctaatttaaatgtatnagcagagacaggaaacncccctaactccagatctatgaaattgctaatacctaaagttttacggggaaaacgttcgggggtacccctaaagttaccgtaaacggtttacgaagggttacgggacgtaaagggttgggtaaacgttcggtacgggggtaactaaggttaacttttacctaaaccgtttccgttaacctaaacccctaagttacctaaacgccgtaaggttcgtacgtaccggtacctaagtaaagttattttaacgaacttaacctttacttacgtatacgaaacttggttaaccttaacacgtaaccctcacgaccttcgaacgttaaccgggg

SEQ ID NO: 310178 - DNA, 636 bp, Homo sapiens
  misc_feature: GZ8MTXP01AS0HE.51.78.H01.1.454.CMB.2.raw
  modified_base (447)..(447): a, c, t, g, unknown or other
  misc_feature (447)..(447): n is a, c, g, or t
  modified_base (452)..(452): a, c, t, g, unknown or other
  misc_feature (452)..(452): n is a, c, g, or t
  modified_base (507)..(507): a, c, t, g, unknown or other
  misc_feature (507)..(507): n is a, c, g, or t
tcagcgatcgtatacacgaccggtgctcgatttagtgtgagtagtttgggtttggggaggagtcagtctcagtcaggacacagcatggacatgagggtccccgctcagctcctggggctcctgctactctggctccgaggtgccagatgtgacatccagatcgacccagtcctccatccctccctgtctgctatcgtaggtaggagacagacgtccaccatcacgttcggccgggacaagtcaagacgactagttagactagtacttaaattaaagttggtatcgaagacgaaggaccgaaccggaaacgggtaaacccctaccccctaacctcgtagtacttactagtgtatcgtactacttaacgtaaggttacggaacggtccggtacctagtacgtagtgaagtgcaggtgtactgaggactagttacttcactctaccactnacgancgtaggtcgtacgaccgtacgtagtaacttatttacgaaccttaacttaccgtanccgtaaactaacgacgttaactaccctaacgttacccagtaacgtccttcggttaccgggttcgggaacgggttaaccggacgttaagggcggtaaataccgaagtaaacggtgcgttcggaactaacg

SEQ ID NO: 310179 - DNA, 664 bp, Homo sapiens
  misc_feature: GZ8MTXP01C2WRI.51.78.H01.1.454.CMB.2.raw
  modified_base (204)..(204): a, c, t, g, unknown or other
  misc_feature (204)..(204): n is a, c, g, or t
  modified_base (256)..(256): a, c, t, g, unknown or other
  misc_feature (256)..(256): n is a, c, g, or t
  modified_base (281)..(281): a, c, t, g, unknown or other
  misc_feature (281)..(281): n is a, c, g, or t
  modified_base (573)..(573): a, c, t, g, unknown or other
  misc_feature (573)..(573): n is a, c, g, or t
  modified_base (596)..(596): a, c, t, g, unknown or other
  misc_feature (596)..(596): n is a, c, g, or t
  modified_base (632)..(632): a, c, t, g, unknown or other
  misc_feature (632)..(632): n is a, c, g, or t
  modified_base (636)..(636): a, c, t, g, unknown or other
  misc_feature (636)..(636): n is a, c, g, or t
  modified_base (650)..(650): a, c, t, g, unknown or other
  misc_feature (650)..(650): n is a, c, g, or t
tcagcgatcgtatacacgaccggtgctcgatttagtgtgagtagtttgggtttggggaggagtcagtctcagtcaggacacagcatggacatgagggtccccgctcagctcctggggctcctgctactctggctccgaggtgccagatgtgacatccagatcgaccagtctccatccctccctgtctgctatcgtaggtagganacgagactaccactatactacgtcgccgtacaagtcaagagactaagtacgntaacgttattaaattaagtggtacncgaagacgaaggaacgaaccggaacgggaaacccctaccccttaaccgtgtagtaaccttatagtaggtactaaccgacgttaaacgttaacgttaaaaggggttaggtaaaccggggtttccccccggacctaaggtaacggtttaagggtaccaaagggtaccgaagttagggtagtacccgttagggacggtaactaatttcctacctacttccgaactacctgtaccgagtacgtggttcacgaactagtaggtaaatttggttaactacctaaattctatacgtaanaacgtagtaacctacacccttcngtaactcttacgtacggttggaacggaaggttacgngggntaaagactaacgangttacgcttaagcc

SEQ ID NO: 310180 - DNA, 587 bp, Homo sapiens
  misc_feature: GZ8MTXP01EGDCA.51.78.H01.1.454.CMB.2.raw
  modified_base (269)..(269): a, c, t, g, unknown or other
  misc_feature (269)..(269): n is a, c, g, or t
  modified_base (291)..(291): a, c, t, g, unknown or other
  misc_feature (291)..(291): n is a, c, g, or t
  modified_base (312)..(312): a, c, t, g, unknown or other
  misc_feature (312)..(312): n is a, c, g, or t
tcagcgatcgtatacacgaccggtgctcgatttagtgtgagtagtttgggtttgggggctctgggagaggagccccagccctgagattcccaggtgtttccattcagtgatcagcactgaacacagaggactcacatggagttgggactgagctggtattttcctttggcttattttaaaaggtgtccagtgtgaagtgctacgtggtggagtcgtgggggagcctggtacagcctggctaggtcctgagactcgtcctgtgcagcctntggtattcactttgatgattancgccatgcacgtgggtccganaacgctacgagggacggcgtggagtcggtctcgtagttattaggttagaagttaggtggttaaatagtaacgccttaagtggcggtactacgtggtacgggacgggtcattccactcgtctaccgagaacgacaaacgccaaagtacctcctagggtactctagaacaaatcgaactagtactgagagtcgagaaggcgaacggtcttagtaacgttacgcgggacaaaacgaaacgcccgaaaggaccaaagttcgtaacgttaacggtaaacc

SEQ ID NO: 310181 - DNA, 592 bp, Homo sapiens
  misc_feature: GZ8MTXP01AT72Z.51.78.H01.1.454.CMB.2.raw
  modified_base (238)..(238): a, c, t, g, unknown or other
  misc_feature (238)..(238): n is a, c, g, or t
  modified_base (240)..(240): a, c, t, g, unknown or other
  misc_feature (240)..(240): n is a, c, g, or t
  modified_base (253)..(253): a, c, t, g, unknown or other
  misc_feature (253)..(253): n is a, c, g, or t
  modified_base (255)..(255): a, c, t, g, unknown or other
  misc_feature (255)..(255): n is a, c, g, or t
  modified_base (257)..(257): a, c, t, g, unknown or other
  misc_feature (257)..(257): n is a, c, g, or t
  modified_base (286)..(286): a, c, t, g, unknown or other
  misc_feature (286)..(286): n is a, c, g, or t
  modified_base (296)..(296): a, c, t, g, unknown or other
  misc_feature (296)..(296): n is a, c, g, or t
tcagcgatcgtatacacgaccggtgctcgatttagtgtgagtagtttgggtttggggaggagtcagtctcagtcaggacacagcatggacatgagggtccccgctcagctcctggggctcctgctactctggctccgaggtgccgagatgtgacatccagatgaccagtctccatcctcctgtctgcatctgtaggagacagagtcaccatcattgcgggcaagtcagagcattagananatataatagtatnananagagacgaaggaaacgaccctacctactntatactatanatgacatactaagttaggtaacggtaccggtacctatacgtaacgtacgtaagtaggtcgtagtagtagtcgtaggtacgtagtacttactactactacactactacacgacgtagtagtacgacgtaacgtagtaagtagtttacgtactaaacttaacttaactacgtactaacgtaaagtaacgttaacgtaaccgtaccctacctaacgtcttactacgttacggtacgggtaacgggaacggaacggttacggtaagaacgtaacgaaacgtaacgttacgtcgttcgtcg

SEQ ID NO: 310182 - DNA, 666 bp, Homo sapiens
  misc_feature: GZ8MTXP01D0Z9M.51.78.H01.1.454.CMB.2.raw
  modified_base (279)..(279): a, c, t, g, unknown or other
  misc_feature (279)..(279): n is a, c, g, or t
  modified_base (351)..(351): a, c, t, g, unknown or other
  misc_feature (351)..(351): n is a, c, g, or t
tcagcgatcgtatacacgaccggtgctcgatttagtgtgagtagtttgggtttgggcacgaccggtgctcgatttagtgtgagtagtttgggtttggggaggagtcagtctcagtcaggacacagcatggacatgagggtccccgctcagctcctggggctcctgctactctggctccgaggtgccagatgtgacatccagatcgacccagtcctccatccctcctgtctgcatctagtaggagacagagtccacatctacgtggccggacaagtcagngctattagacagtacttaatttaaatggttaatcgacgcgaaagacggtaaccgaaacgggggtaaaacccncccccgtaaaccttccccgtaggtactacgtaatggaaactcgctaaacttacccgtaaagtttacgggaaacgggttcggggtaccctaatacgtaaaggttcgaggtcggagtaggttaggtagttcggtagggaactagttactttaccacttccgacctaacctaactacgaacggtacctaggtcggtaccgtacgtaacccgtaagttaagttatttaacgacttaaacgttacttaccgtagtaacaaacgttagaacttaacgaaccgttaaccctcgtacgttactccgttaacggttaaccgggg

SEQ ID NO: 310183 - DNA, 737 bp, Homo sapiens
  misc_feature: GZ8MTXP01DX9R6.51.78.H01.1.454.CMB.2.raw
  modified_base (243)..(243): a, c, t, g, unknown or other
  misc_feature (243)..(243): n is a, c, g, or t
tcagcgatcgtatacacgaccggtgctcgatttagtgtgagtagtttgggtttgggcacgaccggtgctcgatttagtgtgagtagtttgggtttggggaggagtcagtctcagtcaggacacagcatggacatgagggtccccgctcagctcctggggctcctgctactctggctccgaggtgccagatgtgacatccagatcgacccagtctccatccctcctgtctgcatctagtagganacagatccacatcacgtcgccggacaagtcagacgactaagttacgctaagtactttaaatttaaagttggtatacgagacgaaaggaacgaaccggaaacgggaaaccctacccccgtaaacctcccctagtaacttcgtaatcgtaaacttagaacctagttaacccgttaaaggtttacgggaaacgggttcggggtaccctaagttaccgtaaaggtttcaggtaggacgtaggttaggacttcggtacggggaactacggtttaactttaccgaaccgtttccgtaacctaaaccgtacttaccggaagtaccggttaggtcggttaacggtaccgtaaccggttaagttaaacgttttgtttaaccgtaaccttaaactttaaccggttacttaacgggtaaacttaaacggttacgttaaaccgttaacccgtaacccctaacccttacgacgtttacctaaccggttaacccgggttaaccggggg

SEQ ID NO: 310184 - DNA, 610 bp, Homo sapiens
  misc_feature: GZ8MTXP01B1IGA.51.78.H01.1.454.CMB.2.raw
  modified_base (289)..(289): a, c, t, g, unknown or other
  misc_feature (289)..(289): n is a, c, g, or t
  modified_base (499)..(499): a, c, t, g, unknown or other
  misc_feature (499)..(499): n is a, c, g, or t
tcagcgatcgtatacacgaccggtgctcgatttagtgtgagtagtttgggtttgggcacgaccggtgctcgatttagtgtgagtagtttgggtttgggcacgaccggtgctcgatttagtgtgagtagtttgggttggggaggagtcagtctcagtcaggacacagcatggacatgagggtccccgctcagctccgtggggcctcctgctactctggctccgaggtgccagatgtgacatccagatcgacccagtcctccactccctccctgtctgcatctgtaagganacagacgtaccaaccataccacgttcggacccgggacaaggtcaagacgactaattagcaagtacttaaatttaaattggtaatcagaacaagaacgaaccgaaaggggaaaccctaccccctaaactcctagacttacgtatagactgactaagtactaagttacggaaacggtcggtaccagttacgtaaaggttcaagggtcggtanaggtgagtcggtagggactagttcttaccacttcaacaaccttataccgagtcgtagttcgttcgaccgtaattggtaaatttcgtttagacctttaacgttaactaaccg

SEQ ID NO: 310185 - DNA, 610 bp, Homo sapiens
  misc_feature: GZ8MTXP01ENABY.51.78.H01.1.454.CMB.2.raw
  modified_base (582)..(582): a, c, t, g, unknown or other
  misc_feature (582)..(582): n is a, c, g, or t
tcagcgatcgtatacacgaccggtgctcgatttagtgtgagtagtttgggtttggggggagaggagccccagccctgagattcccaggtgtttccattcagtgatcagcactgaacacagaggactcaccatggagttgggactgagctggtatttttcctttggcttattttaaaaggtgtccagtgtgaagtgctactggtggagtcgtgggggagcctggtacagcctggcaggtcctgagactctcctgtgcagcctctggattcactttgatgatatgccatgcacgtgggtcccgacaacgctaccgagggggaacgggtcctagggagttcggggtctcgtaacgttagttagtggtaaatggtaggttagtatacggtacctagtcggcggtactcgtgtaggaacggggtcctattccacagttcacagagaaccaaccgctaaactaacctccctagtaatccgtaagaacaaagtcgaacagtcgtagacgtacgcgtaaggacgtaccgtacgggttaacttagttaacttacgagaaccgaaacgaaaacgcgttaaacgaactaacgngtaccgtagttacctaacgaagttaacg

SEQ ID NO: 310186 - DNA, 713 bp, Homo sapiens
  misc_feature: GZ8MTXP01ERO09.51.78.H01.1.454.CMB.2.raw
  modified_base (267)..(267): a, c, t, g, unknown or other
  misc_feature (267)..(267): n is a, c, g, or t
tcagcgatcgtatacacgaccggtgctcgatttagtgtgagtagtttgggtttgggggggagaggagccccagccctgagattcccaggtgtttccattcagtgatcagcactgaacacagaggactcaccatggagttgggactgagctggtatttttccttttggcttaattttaaaaggtgtccagtgtgaagtgctactggtggagtcgtgggggagcctggtacagcctggcaggtccctgacgactctcctgtgcagcctntggtacttctacctttgatgattatcgccatcgcacgtgggtcccgacgaacgccgtcggaaggggaacgggccgtagggacgggttgggtcctacgtaacgttagtttaggttaggtaaacgttaggttagggtaagttaagttacgtacccgttaagtcggtccgggtaaacttccgttagggtaacgggtaacggggtccgttaacgttacccaacctaacttccgtaccgaagacgaaaccgaaaccgtacccgaaacgtaacccttccctacgttaacttccgtacgggaactaaaacgttacgaaacgtacgttaccgtaggaaggacgccgtagggtaaaccggacgtaccggtccgtttaagttacttacgttacgacgaaacgaaaacgcgaaacgaacaacgcgtactacggttactaacgttaaacgttaaccgg

SEQ ID NO: 310187 - DNA, 740 bp, Homo sapiens
  misc_feature: GZ8MTXP01E1OAM.51.78.H01.1.454.CMB.2.raw
  modified_base (239)..(239): a, c, t, g, unknown or other
  misc_feature (239)..(239): n is a, c, g, or t
tcagcgatcgtatacacgaccggtgctcgatttagtgtgagtagtttgggtttgggcacgaccggtgctcgatttagtgtgagtagtttgggtttgggcacgaccggtgctcgatttagtgtgagtagtttggggtttggggaggagtcagtctcagtcaggacacagcatggacatgagggtccccgctcagctccgtggggctcctgctactcgtggcctccgaggtgccagatgtnacatccagatcgaccagtcctaccactccctctgtctgctatcgtagtagacgacagacgtccaacctatccgtacgttcggacccggtactaacggtcaaggagtacctaaagttacgacgtaacgttaacctttaaacttttaaagtggttacacgaggaaaccgaaggaacccggtaaacccggaaaccggggtaaaccctaccccccttaaacgtccgtaagtacttactatacggtactacgaacgtacgttaaacccgttaaagggtttaaacgggtaaaccgggttccggggtaacctaacggttaacgttaaaggtaccggtaaggggttacggacgttagggtacgtacgttaccggtaggtaacgtactaacgtttaccaccgttcctaaccgaacttacgtacgttcggtaccgtagggttcgttacgggacccttaagtaagggttaatttacgtttacgttaaacccttaaacgtttccgttaaaccg

SEQ ID NO: 310188 - DNA, 638 bp, Homo sapiens
  misc_feature: GZ8MTXP01BHAJQ.51.78.H01.1.454.CMB.2.raw
  modified_base (320)..(320): a, c, t, g, unknown or other
  misc_feature (320)..(320): n is a, c, g, or t
tcagcgatcgtatacacgaccggtgctcgatttagtgtgagtagtttgggtttgggcacgaccggtgctcgatttagtgtgagtagtttgggtttgggcacgaccggtgctcgatttagtgtgagtagtttgggtttggggaggagtcagtctcagtcaggacacagcatggacatgagggtccccgctcagctccgtggggctcctgctactctggctccgaggtgccagactgtgacatccagatcgacccagtcctcactccctccctgtctgcatctaggtaggacgacagagtccacatctacgttcggccgganacgtcagagactagttacgactagtacttaatttaagttgtatcagaacagaacgaaccgaaggggtaaaccctacccctaacgtcctatacgttactatagactacgctaacgttaaccgtaagtttacgggaacggtcgggaccctagtacgttaaacggttcggaacggttcggacgtagtaggtacgtacggttaggaactacgttaacttccctaaacttccctaacgtaaccttacgtaccgagtacgtacggttggaccgttacgtaacgtagttaacggttctttacgaccttaacgtttaaccgtaacg

SEQ ID NO: 310189 - DNA, 582 bp, Homo sapiens
  misc_feature: GZ8MTXP01EZOE8.51.78.H01.1.454.CMB.2.raw
  modified_base (284)..(284): a, c, t, g, unknown or other
  misc_feature (284)..(284): n is a, c, g, or t
  modified_base (308)..(308): a, c, t, g, unknown or other
  misc_feature (308)..(308): n is a, c, g, or t
tcagcgatcgtatacacgaccggtgctcgatttagtgtgagtagtttgggtttgggcacgaccggtgctcgatttagtgtgagtagtttgggtttgggcacgaccggtgctcgatttagtgtgagtagtttgggtttggggaggagtcagtctcagtcaggacacagcatggacatgagggtccccgctcagctcctggggctcctgctactctggctccgaggtgccagatgtgacatccagatgacccagtctccatccctcctgtctgcatctgtaagganacagagtcacatcacttgccgganaagtcagagcattagcagtacttaatttaaatggtaatcgagacagaacgaccgaaagggaaactccccctaaactccagtatactatcgatcgacaattacctaaaggttttaggaaacggttcggggtaccctaagtacgtaagggttacgaggttacggactaggtagtagtcgttagggaactagtaactttccattcctcaaccttatcgagcgtaaggttcgttcgaccgtaacgtagtaagttattcgacttaacgtttaactaacg

SEQ ID NO: 310190 - DNA, 770 bp, Homo sapiens
  misc_feature: GZ8MTXP01EFT2X.51.78.H01.1.454.CMB.2.raw
  modified_base (184)..(184): a, c, t, g, unknown or other
  misc_feature (184)..(184): n is a, c, g, or t
  modified_base (241)..(241): a, c, t, g, unknown or other
  misc_feature (241)..(241): n is a, c, g, or t
  modified_base (265)..(265): a, c, t, g, unknown or other
  misc_feature (265)..(265): n is a, c, g, or t
  modified_base (274)..(274): a, c, t, g, unknown or other
  misc_feature (274)..(274): n is a, c, g, or t
tcagcgatcgtatacacgaccggtgctcgatttagtgtgagtagtttgggtttgggcacgaccggtgctcgatttagtgtgagtagtttgggtttggggaggagtcagtctcagtcaggacacagcatggacatgagggtccccgctcagctcctggggctcctgctactctggctccgaggtnccagatgtgacatccagatcgacccagtctccatccctcctgtctgcatctgtaganacagagtcacatcacgtgccgganaagtcaagngactattagactagtactttaagtttaattggtaatcgagacaaggaacgaccgaacgggaaacctaccccctaaacctcccgtagattacgtaatagtaactacgtaactaacttacccgtaaagtttacggggaaacgggttcgggggtaacccctaagttaacccggtaaaggttccgtaagggtaccggtacgaagggttagggtaacgttaccggttaagggggaaccttaaggtttaaccttttaaaccacccgtttacccgttaacccgaaccgtaacttacccgaaaggtacgttaccggttggtaaccgggtaccccgtaaacgttacggggttaaagttactttttaacggtaaacccttaaacttttaaaccgttaacccgttaagggttaaaccccaaaaggttaccgttaaccggtttaaacccgaccgttaacccccttaggaacccttcgttaacccggttaacggtttaaccccgggggg

SEQ ID NO: 310191 - DNA, 646 bp, Homo sapiens
  misc_feature: GZ8MTXP01ENE01.51.78.H01.1.454.CMB.2.raw
  modified_base (332)..(332): a, c, t, g, unknown or other
  misc_feature (332)..(332): n is a, c, g, or t
  modified_base (519)..(519): a, c, t, g, unknown or other
  misc_feature (519)..(519): n is a, c, g, or t
  modified_base (580)..(580): a, c, t, g, unknown or other
  misc_feature (580)..(580): n is a, c, g, or t
tcagcgatcgtatacacgaccggtgctcgatttagtgtgagtagtttgggtttgggcacgaccggtgctcgatttagtgtgagtagtttgggtttgggcacgaccggtgctcgatttagtgtgagtaggtttggggtttggggaggagtcagtctcagtcaggacacagcatggacatgacgggtcccccgctcagctccgtggggcctcctgctactctggctccgaggtgccagatgtgacatccagactcgacccagtcctccatccctcctgtctgcatcgtagtaaggagacagactccaacctatacctacgttcggccgggtaanaaacgtcaacggagactaaagttacgactaacgtactttaaactttaaagttcgtaatcgaagaacaagaacgaaaccgaaacgggaaaccctccccctaactccgtagtaactctaagtcgaattcgaactacttaaaccgttaaggtttacggaaacgggttcggtaccagttacgtaggtacgnggtcggacgtaggtagtactcggtagggaaacctgttacttaccacctctaactaacttanccgaagtcgtaaggttgttccgcgtaaacgtgtaattcgttacaactttaaccgtttaacgtaacg

SEQ ID NO: 310192 - DNA, 843 bp, Homo sapiens
  misc_feature: GZ8MTXP01BTBUI.51.78.H01.1.454.CMB.2.raw
tcagcgatcgtatacacgaccggtgctcgatttagtgtgagtagtttgggtttgggcacgaccggtgctcgatttagtgtgagtagtttgggtttgggcacgaccggtgctcgatttagtgtgagtagtttgggtttggggaggagtcagtctcagtcaggacacagcatggacatgacgggtccccgctcagctcctggggcctcctgctactctggctccggagtgccagtatgtgacatccagatcgacccagtcctccactccctccgtgtctgctatctaggtaaggacgacagtacgtaccaacctagttacctaaccgttcgggacccggggtaactaacggtccgaagaaggtacctaaagtttacgaacccgttaagttaacctttaaaagttttaaacgtttcggtaaactacccgaagaaccgaaacgggaacggaaacccgaaaccgggggtaaaacccttaccccccgtaaacccgttccgtacggtaaacttaccgttaatagggaacttcggaaccttaacgttaaacccggttaaaagggttttacgggggaaaacggtttcccgggggtaaacccctaaaggtttacccgtaaaaggggtttcccgggaaagggttcgggggtaaaccaagggggtttaccgaagtttacccgggtaaggttaaacccgtaggttttaaacccttaccttaacccgttacgtaaccccttaacccggttaactaacggttccccgaacggtttaagggaccggtttcgaccccggttaaacggttataaacggttttcctttaacggaacctttaaccccgttttaacgtaaccgg

SEQ ID NO: 310193 - DNA, 580 bp, Homo sapiens
  misc_feature: GZ8MTXP01B7ODN.51.78.H01.1.454.CMB.2.raw
  modified_base (241)..(241): a, c, t, g, unknown or other
  misc_feature (241)..(241): n is a, c, g, or t
  modified_base (273)..(273): a, c, t, g, unknown or other
  misc_feature (273)..(273): n is a, c, g, or t
  modified_base (501)..(501): a, c, t, g, unknown or other
  misc_feature (501)..(501): n is a, c, g, or t
  modified_base (554)..(554): a, c, t, g, unknown or other
  misc_feature (554)..(554): n is a, c, g, or t
tcagcgatcgtatacacgaccggtgctcgatttagtgtgagtagtttgggtttgggcacgaccggtgctcgatttagtgtgagtagtttgggtttggggaggagtcagtctcagtcaggacacagcatggacatgagggtccccgctcagctcctggggctcctgctactctggctccgaggtgccagatgtgacatccagatgacccagtctccatcctccctgtctgcatctgtagganacagagtcaccatcactgccggcaagtcagancattagcagtacttaatttaaattggtatcagcaagacgaccgaagggaaacgcccctaaactcccctagatctatgaatgctatccctaaagtttacgggaaacggttcgggggtaccctagtacgaaaggttcaaggtggacaggttggaacttcgtagggacagtactttacgaaccttcgtacaaccgtactacgagctagtcgtgaccgtaccgtagaagttntttgacttaacttacttacgtgtacaagacgacttaaccaccgtaaccccttnacgttctccgttaacgttaaccgggg

SEQ ID NO: 310194 - DNA, 573 bp, Homo sapiens
  misc_feature: GZ8MTXP01EXOGB.51.78.H01.1.454.CMB.2.raw
  modified_base (200)..(200): a, c, t, g, unknown or other
  misc_feature (200)..(200): n is a, c, g, or t
  modified_base (225)..(225): a, c, t, g, unknown or other
  misc_feature (225)..(225): n is a, c, g, or t
  modified_base (284)..(284): a, c, t, g, unknown or other
  misc_feature (284)..(284): n is a, c, g, or t
  modified_base (444)..(444): a, c, t, g, unknown or other
  misc_feature (444)..(444): n is a, c, g, or t
  modified_base (495)..(495): a, c, t, g, unknown or other
  misc_feature (495)..(495): n is a, c, g, or t
  modified_base (542)..(542): a, c, t, g, unknown or other
  misc_feature (542)..(542): n is a, c, g, or t
tcagcgatcgtatacacgaccggtgctcgatttagtgtgagtagtttgggtttggggaggagtcagtctcagtcaggacacagcatggacatgagggtccccgctcagctcctggggctcctgctactctggctccgaggtgccagatgtgacatccagatgacccagtctccatccctccctgtctgcatctgtagganacagagtcaccatcacttgccgggnaagtcagagcattagcagtacttaattaaagtggtatcagcagacgaccgagggaaacncccctaactctagactctatgatgactataccaagtttcgggaaaggttccggggtaccctagtcgtaaaggttcgaaggttggctagggtcggtattcgtagggactagtactttcactctacaccatcgagcgtagtgtcgacgtactagtaacgttntttacgactaacgttactactcgtacaagtacgtagtaccacgttaccccnaacgtccttacgtcgttacgggcgggtaacggacgagggttaggaanacgtaacgaaacgtcgttgtcggttctaacg

SEQ ID NO: 310195 - DNA, 710 bp, Homo sapiens
  misc_feature: GZ8MTXP01ANAI2.51.78.H01.1.454.CMB.2.raw
  modified_base (245)..(245): a, c, t, g, unknown or other
  misc_feature (245)..(245): n is a, c, g, or t
  modified_base (277)..(277): a, c, t, g, unknown or other
  misc_feature (277)..(277): n is a, c, g, or t
  modified_base (481)..(481): a, c, t, g, unknown or other
  misc_feature (481)..(481): n is a, c, g, or t
tcagcgatcgtatacacgaccggtgctcgatttagtgtgagtagtttgggtttgggcacgaccggtgctcgatttagtgtgagtagtttgggtttggggaggagtcagtctcagtcaggacacagcatggacatgagggtccccgctcagctcctggggctcctgctactctggctccgaggtgccagatgtgacatccagatcgaccctagtcctccactccctcctgtctgcatcgtgtaganacagacgtccacctatcacgtcggaccggganaagtcagacgactaattagactagtactttaaagttttaaacgttggtaacttcgaagtccgaaaggaccggtaaacccggaaacggggtaaacccctacccccttaaccgtccccttaggacttactagtcgaacgttcgaacctacttaccgtaaaggtttaacgggaaacgggtcggggtacccaacgtagttaaccggtntaagggtcggtacgaggtcgggtatacgggtaggtaactagttaaccttcacctacgttccaaacgtctacgagtcctaaggttcgtcgaaccgttccgtaagttaacttctttaacggtaccttaaacgtttacgttactaacggtaacccttaagttaaacgttaccgttaaacctacccggtaacccttcgcgttaccgttaaccgttaacgggttaaccccgggg

SEQ ID NO: 310196 - DNA, 634 bp, Homo sapiens
  misc_feature: GZ8MTXP01EA654.51.78.H01.1.454.CMB.2.raw
  modified_base (265)..(265): a, c, t, g, unknown or other
  misc_feature (265)..(265): n is a, c, g, or t
  modified_base (284)..(284): a, c, t, g, unknown or other
  misc_feature (284)..(284): n is a, c, g, or t
  modified_base (301)..(301): a, c, t, g, unknown or other
  misc_feature (301)..(301): n is a, c, g, or t
  modified_base (521)..(521): a, c, t, g, unknown or other
  misc_feature (521)..(521): n is a, c, g, or t
  modified_base (526)..(526): a, c, t, g, unknown or other
  misc_feature (526)..(526): n is a, c, g, or t
tcagcgatcgtatacacgaccggtgctcgatttagtgtgagtagtttgggtttgggggctctgggagaggagccccagccctgagattcccaggtgtttccattcagtgatcagcactgaacacagaggactcaccatggagttgggactgagctggattttcctttggctattttaaaggtgtccagtgtgaagtgctactggtggagtcgtgggggagcctggtacagcctggctaggtccctgagactctctgtgcagcctntgattcacttgatgattancgcatgcacgtggccgnaagctcgagggacggtctggacgtggtacctcgacgttattacggttaggaattagggtagggttaaacgtattcggaccttaagtcgggacggtaccttcgtagggtacgggaacggggtcctattcgaacctatcctaccgagacaccgtaaaccgcccaaagtacccttcccgttaggtactctagaaccaaagttcggaactaggtactaggaagngtccngggaaccggtacttaccggggtcctttaggaactttaaccggcggaacgaaacccgaaaacggttccgaaacgggacccaaaaccgttggtaacttaaccgggtaacc

SEQ ID NO: 310197 - DNA, 603 bp, Homo sapiens
  misc_feature: GZ8MTXP01A5XI0.51.78.H01.1.454.CMB.2.raw
  modified_base (393)..(393): a, c, t, g, unknown or other
  misc_feature (393)..(393): n is a, c, g, or t
  modified_base (433)..(433): a, c, t, g, unknown or other
  misc_feature (433)..(433): n is a, c, g, or t
  modified_base (495)..(495): a, c, t, g, unknown or other
  misc_feature (495)..(495): n is a, c, g, or t
  modified_base (530)..(530): a, c, t, g, unknown or other
  misc_feature (530)..(530): n is a, c, g, or t
tcagcgatcgtatacacgaccggtgctcgatttagtgtgagtagtttggggtttggggaggagtcagtctcagtcaggacacagcatggacatggacgggtccccgctcagctccgtggggctcctgctactctggctccggaggtgccagatgtgacatccagatcgacccagtcctccactccctccctgtctgctatcgtggtaggagacagacgtcaccatcacgttggccgggacaagtcagagactagttgacagtacttaaattaagtggtatcgagacagacgacgaaggaaacctcccctaactctagtactctatgatcgactattaccgtaagtttagggaacggtccgggtacctagtacgtaagggttcaaagggttcgngtagggtgagtcggtagggactgtaccttcactctacacntacagactagtcgacgactacgtagtaacgttactttacgaaccttaacttacgtaccgtanaccgaaagtacgtaacgttaccctaccgtaccccngaacgtcgttacgtccggttggaccggtaggacgaggttagaacgagtaacgaaacgtgttacgtcgaactcg

SEQ ID NO: 310198 - DNA, 669 bp, Homo sapiens
  misc_feature: GZ8MTXP01D0XB3.51.78.H01.1.454.CMB.2.raw
  modified_base (250)..(250): a, c, t, g, unknown or other
  misc_feature (250)..(250): n is a, c, g, or t
  modified_base (291)..(291): a, c, t, g, unknown or other
  misc_feature (291)..(291): n is a, c, g, or t
  modified_base (374)..(374): a, c, t, g, unknown or other
  misc_feature (374)..(374): n is a, c, g, or t
  modified_base (386)..(387): a, c, t, g, unknown or other
  misc_feature (386)..(387): n is a, c, g, or t
tcagcgatcgtatacacgaccggtgctcgatttagtgtgagtagtttgggtttgggcacgaccggtgctcgatttagtgtgagtagtttgggtttgggggaggagtcagtctcagtcaggacacagcatggacatgagggtccccgctcagctcctggggctcctgctactctggctccgaggtgccagatgtgacatccagatcgaccctagtcctccactccctccctgtcctgcatctggtaagganacagagtccaaccatcacgtcggaccggactaagtcaaganactaattaggactaagtactttaaattttaaagttggtaatacgagcaaggacgaacgaacggaaactacccctaactcccanatcgtatgaacnnctactacgtaaagttacggaaacgggttccgggtacctagtacgtaaggttcgaggtggtacaggtgactggtacgggaactacgttacttcgacccttactaccgtaactaacgtccgaagtcgtaggttcggtacgacgtaccgttaagtaaacgtttcttaacgtaaccttaactttacgttactacgtaacccgaaaagttcgtttaaacccgttaaccgtaaaccccgttccccgtataccgttacccttaaccgtttaaccggggttaacccgggg

SEQ ID NO: 310199 - DNA, 614 bp, Homo sapiens
  misc_feature: GZ8MTXP01BXQQM.51.78.H01.1.454.CMB.2.raw
  modified_base (266)..(266): a, c, t, g, unknown or other
  misc_feature (266)..(266): n is a, c, g, or t
  modified_base (286)..(286): a, c, t, g, unknown or other
  misc_feature (286)..(286): n is a, c, g, or t
  modified_base (308)..(308): a, c, t, g, unknown or other
  misc_feature (308)..(308): n is a, c, g, or t
  modified_base (436)..(436): a, c, t, g, unknown or other
  misc_feature (436)..(436): n is a, c, g, or t
tcagcgatcgtatacacgaccggtgctcgatttagtgtgagtagtttgggtttgggggggagaggagccccagccctgagattcccaggtgtttccattcagtgatcagcactgaacacagaggactcaccatggagttgggactgagctggtattttccttttggcttattttaaaaggtgtccagtgtagaagtgctactgggtggagtcgtggggggagcctggtacagcctggcaggtccctgagactctctgtgcagcctnggtattcactttgatgattntgccatgcacgtgggtcccganaagctccgaagggggaggcctgggagtcgggtctcgacgtagtttggtacgtaaatggtaggtacgtatcgaccttatggccggtactcgtagtcggaacgggccgtaattcgacctattccacgaanacgaaacgaaccaccgaaagaacctcccgtagtactaccgtagaaactaaagtacgaaacgtagtacgtaggaacgacgcgtagggaaccgtaccgtccggtaacgttagttaactacgacgacgaacgaaacgcgaacgaacacgaacgttactaggttactaacgttaacgtaacg

SEQ ID NO: 310200 - DNA, 666 bp, Homo sapiens
  misc_feature: GZ8MTXP01EQNN7.51.78.H01.1.454.CMB.2.raw
  modified_base (202)..(202): a, c, t, g, unknown or other
  misc_feature (202)..(202): n is a, c, g, or t
  modified_base (229)..(229): a, c, t, g, unknown or other
  misc_feature (229)..(229): n is a, c, g, or t
  modified_base (642)..(642): a, c, t, g, unknown or other
  misc_feature (642)..(642): n is a, c, g, or t
tcagcgatcgtatacacgaccggtgctcgatttagtgtgagtagtttgggtttggggaggagtcagtctcagtcaggacacagcatggacatgagggtccccgctcagctcctggggctcctgctactctggctccgaggtgccagatgtgacatccagatcgacccagtctccatccctccctgtctgcatctggtagganacagatccaccatcacgttgccggganaagtcagagacattagactagtacttaattaaatggtaatcgaagcaaggaacgaaccgaaggggaaacctccccctaactctagactacttatcgactgacaactttaccgtaaaggtttacggggaaacggttcccggggtacccctagtaccggtaaaggttccaaaggggttagggcgtagggttagacgttcggagggtaactagttacctttcacttacctacaacctagtcgaacggtcgtagggtccgtcgtaacccgtacgttaaaggttaacgtttacggttttacgaaccctttaaaccgtttacttaaccgtgtaaacctaagtacggttactaaccggtaccttcccagcgttccttacgtaccggttggggacggtaacggacgttaggttgaacgtanaacggaacgcgttgtgttctaacg

SEQ ID NO: 310201 - DNA, 817 bp, Homo sapiens
  misc_feature: GZ8MTXP01D3631.51.78.H01.1.454.CMB.2.raw
tcagcgatcgtatacacgaccggtgctcgatttagtgtgagtagtttgggtttggggaggagtcagtctcagtcaggacacagcatggacatgagggtccccgctcagctcctggggctcctgctactctggctccgaggtgccagatgtgacatccagatcgacccagtcctccacttccctccctgtctgctatcgtgtaggagacagtacgtccaccatccacgttcggcccggggactaaagtcaaggacgactaagttacgactaggtaactttaaagtttaaagttggtaactcgaaaggacaaaggaaccggaacccggaaacggggtaaaacccctaccccccttaacccttacctaggtaacttaccttaagtgtaacttcgacctaacgttaccttaaggtttaaggggtaaaccggttcccgggggtacccctagttacgtaaacggttcgaaagggttcggcgttagggtcgggtaacgttcggtaggggtaactacggtttaactttacccaccttcctaccaacctaattaccgaacggtaccgttaaggtcggtcgaacccgttaccgttaagggtaaactttacggggttttactaaccgtttaaaccttaccgttaataccgtaacgaaacgttaacgttaacgttaaccctaccgtttacccctggaaccttccgttaccgttaccgggtttaccggggaaccgggggtaacgggttaaacccgttagggggttaaccgtaaaggtaaaccgtaacccggtaaaaaccggtacgttcgggtaaccggttaacgttcccg

SEQ ID NO: 310202 - DNA, 557 bp, Homo sapiens
  misc_feature: GZ8MTXP01BOHOQ.51.78.H01.1.454.CMB.2.raw
  modified_base (224)..(224): a, c, t, g, unknown or other
  misc_feature (224)..(224): n is a, c, g, or t
  modified_base (283)..(283): a, c, t, g, unknown or other
  misc_feature (283)..(283): n is a, c, g, or t
  modified_base (483)..(483): a, c, t, g, unknown or other
  misc_feature (483)..(483): n is a, c, g, or t
tcagcgatcgtatacacgaccggtgctcgatttagtgtgagtagtttgggtttggggaggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggnaagtcagagcattagcagtcttaattaaatggtatcagcaagagaccgaagggaaaccncccctaactcctgatctatgatgacatcctaagtttggaacggtcggtccatcgaagttcaagtgcagtggatcgtagggactagtacttcactccacaccatcgaagtctaggtcgtacgcgtaaccgtagtaacgttattttacgacttaaaccttactactcgtaactaacgacgtaacgttacctacgtacccctnaacgtcttacgtacggttcgggacggtagggaccgagggttgaagacgtaacgaacgagttcggtcggctaacg

SEQ ID NO: 310203 - DNA, 597 bp, Homo sapiens
  misc_feature: GZ8MTXP01CPIUN.51.78.H01.1.454.CMB.2.raw
  modified_base (441)..(441): a, c, t, g, unknown or other
  misc_feature (441)..(441): n is a, c, g, or t
  modified_base (565)..(565): a, c, t, g, unknown or other
  misc_feature (565)..(565): n is a, c, g, or t
tcagcgatcgtatacacgaccggtgctcgatttagtgtgagtagtttgggtttgggcacgaccggtgctcgatttagtgtgagtagtttgggtttggggaggagtcagtctcagtcaggacacagcatggacatgagggtccccgctcagctcctggggctcctgctactctggctccgaggtgccagatgtgacatccagatgacccagtcctccatccctccctgtctgcatctaggtaggagacagacgtcaccagtcaactcggccggacaagtcagagcaattagcagtactttaatttaaagttggatcgagacaagacgaacgaagggaaacctccctaactccctagactctaatgaatcgcactacgtaagttaggaacgtcggtaccatacgtaagtcaggtgacaggtgtatcgtaggactagtacttcnctacgtcaacctctacgacgtcgtacgtcgtacgtaccgtaagtaagttaacttcttaacgaacttaaacttacttacgtaacgtaacttaaacggttacgttacgttaaccaccgttaacccngtacgttccgttaacggttaacgggtaacggg

SEQ ID NO: 310204 - DNA, 694 bp, Homo sapiens
  misc_feature: GZ8MTXP01DI0E4.51.78.H01.1.454.CMB.2.raw
tcagcgatcgtatacacgaccggtgctcgatttagtgtgagtagtttgggtttgggggctctgggagaggagccccagccctgagattcccaggtgtttccattcagtgatcagcactgaacacagaggactcaccatggagttgggactgagctggtattttcctttggcttaattttaaaaggtgtccagtgtgaagtgctacgtggtggagtcgtgggggagcctggtacatccgtggcaggtccctgacgactctccgtgtgcagcctgtggattcactttgatgtaattagcgacctagtcgacctacggtcgggtacccgacaacggtccgtacggaagggggaacggtccgtagggtaggttcggtctacgacggtttagttaggttaggaagttaggtagggttaaagtaactaacggtcccttaaagttccgggacggtaaccttcggtagggtaacgggaaccggggtaccttaacttccaaccgtactacccgtaacgacgtaacgaaacccgaaaccgaccgtaaaacgtacccttaccccgttagggtacctacgtaaacgaactaaacgttacggaaactacggttacacggagtacgcgtagggaaccgtacgaccggttcttaggttaacttcgacgttcgaaacaacggaccaaggaccagttactcgttcgtaacc

SEQ ID NO: 310205 - DNA, 715 bp, Homo sapiens
  misc_feature: GZ8MTXP01B387C.51.78.H01.1.454.CMB.2.raw
  modified_base (146)..(146): a, c, t, g, unknown or other
  misc_feature (146)..(146): n is a, c, g, or t
  modified_base (252)..(252): a, c, t, g, unknown or other
  misc_feature (252)..(252): n is a, c, g, or t
tcagcgatcgtatacacgaccggtgctcgatttagtgtgagtagtttgggtttgggcacgaccggtgctcgatttagtgtgagtagtttgggtttggggaggagtcagtctcagtcaggacacagcatggacatgagggtccccgntcagctccgtggggctcctgctactctggctccgaggtgccagatgtgacatccagatcgacccagtctccatccctcctgtactgctatcgtagtagacacgagngtaccaccatccaacgtcggaccgggtacaagtcaaggacaccgtaattagacctagtactttaaagtttaaagttggtaactccggaagacgtaaggaacgtaccgaaacgggggtaaaccctcccccgttaaacctcccgtagtacttacgtaacgtagtaaacttagaaccctaatttaaccgaaaagggtttcggaaaacgggttcggggtaccctaagttaccgtaaaggttccgaaagggtcgaattaggtacgggaatttcgggtaacgggaacttacggttactttacaacccttcgttaacccaacctattacccgagttcgaagttcggactaccgtaccttaaggtagttactttaagaaccttaattaaaccttgttacgaacttaacgttaacgttacgttaacgcccgttaacctaggacttacccgtcgttaaccggggttaaccggg

SEQ ID NO: 310206 - DNA, 491 bp, Homo sapiens
  misc_feature: GZ8MTXP02FQ3OP.51.78.H01.1.454.CMB.2.raw
  modified_base (434)..(434): a, c, t, g, unknown or other
  misc_feature (434)..(434): n is a, c, g, or t
tcagcgatcgtatacacgaccggtgctcgatttagtgtgagtagtttgggtttgggaggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctattaaatggtatcagcagagaccagggaaagcccctaaacctcctgatctatgatgcatccaatttggaaatggggtcccatcaaggttcagtggcagtggatctgggacagatttcactctcaccatcagcagtgtgcgacctgaagattttgcaacttactactgtcaacagaagttacagtacccctnaacgctcactttcggcggtacgggaccaaggtggaagatacaaacgaactgtggctg

SEQ ID NO: 310207 - DNA, 498 bp, Homo sapiens
  misc_feature: GZ8MTXP02F4LWB.51.78.H01.1.454.CMB.2.raw
  modified_base (358)..(358): a, c, t, g, unknown or other
  misc_feature (358)..(358): n is a, c, g, or t
tcagcgatcgtatacacgaccggtgctcgatttagtgtgagtagtttgggtttgggcacgaccggtgctcgatttagtgtgagtagtttgggtttgggcacgaccggtgctcgatttagtgtgagtagtttgggtttggggaggagtcagtctcagtcaggacacagcatggacatgagggtccccgctcagctcctggggctcctgctactctggctccgaggtgccagatgtgacatccagatgacccagtctccatcctcctgtctgcatctgtagagacagagtcaccatcacttgccggcaagtcagagcattagcagctatttaaatgtatcagcagagaccaggggaaacnccccctaactcctagatctatgatgcatcaatttggaaagtcgggtaccatacaagttcagtgcagtgatcgtaggacagtattcactctacacatcagcagtgcgtacgaactgaacgtatttcgactaacttactacg

SEQ ID NO: 310208 - DNA, 494 bp, Homo sapiens
  misc_feature: GZ8MTXP02G66J0.51.78.H01.1.454.CMB.2.raw
  modified_base (313)..(313): a, c, t, g, unknown or other
  misc_feature (313)..(313): n is a, c, g, or t
  modified_base (371)..(371): a, c, t, g, unknown or other
  misc_feature (371)..(371): n is a, c, g, or t
tcagcgatcgtatacacgaccggtgctcgatttagtgtgagtagtttgggtttgggcacgaccggtgctcgatttagtgtgagtagtttgggtttgggaggagtcagtctcagtcaggacacagcatggacatgagggtccccgctcagctcctggggctcctgctactctggctccgaggtgccagatgtgacatccagatgacccagtctccatcctcctgtctgcatctgtaggagacagagtcaccatcacttgccgggcaagtcagagcatagcagctattaaatgtatcagcagagaccagggaaancccctaactccctgatctatgatgcatcaaatttggaaagtggggtcccatcaagttnagtgcagtggatcgtgggacagatttcactctcaccatcagcagtgtgcgactgaagattttgctaaacttactaactgtacaaacagaagttaacacgtacccctacacgtctactacgtcg

SEQ ID NO: 310209 - DNA, 490 bp, Homo sapiens
  misc_feature: GZ8MTXP02F19SE.51.78.H01.1.454.CMB.2.raw
  modified_base (346)..(346): a, c, t, g, unknown or other
  misc_feature (346)..(346): n is a, c, g, or t
  modified_base (358)..(358): a, c, t, g, unknown or other
  misc_feature (358)..(358): n is a, c, g, or t
  modified_base (436)..(436): a, c, t, g, unknown or other
  misc_feature (436)..(436): n is a, c, g, or t
tcagcgatcgtatacacgaccggtgctcgatttagtgtgagtagtttgggtttgggcacgaccggtgctcgatttagtgtgagtagtttgggtttgggcacgaccggtgctcgatttagtgtgagtagtttgggtttggggaggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccggcaagtcagagcattagcagctatttaaatgtatcagcagngaccagggaaancccctaactctgatctatgatgcatccaatttggaaagtgggtacccatcaaggttcagtgcagtgatctgggacagnttcactctcacatcagcagtgtgcgaacctgaacgtatttgactaacttactac

SEQ ID NO: 310210 - DNA, 532 bp, Homo sapiens
  misc_feature: GZ8MTXP02FP2U0.51.78.H01.1.454.CMB.2.raw
  modified_base (284)..(284): a, c, t, g, unknown or other
  misc_feature (284)..(284): n is a, c, g, or t
tcagcgatcgtatacacgaccggtgctcgatttagtgtgagtagtttgggtttgggcacgaccggtgctcgatttagtgtgagtagtttgggtttgggcacgaccggtgctcgatttagtgtgagtagtttgggttggggaggagtcagtctcagtcaggacacagcatggacatgagggtccccgctcagctccgtggggctcctgctactctggctccgaggtgccagatgtgacatccagatgacccagtctccatccctccctgtctgcatctgtagganacagagtcaaccatcacttgccggcaagtcagagcattagcagtctaatttaaatgtatcagcagacgaccgaagggaaacgccccctaaacgtcctgatactatgatgactataccaaagtttgggaaaaggtcgggtacccatacgaagttcagtgacagtggatcgtagggactagtatttcacttctacacatcagcagtgacgacgaacctagaacgttatttacgactaaactttactaacg

SEQ ID NO: 310211 - DNA, 515 bp, Homo sapiens
  misc_feature: GZ8MTXP02HU5I0.51.78.H01.1.454.CMB.2.raw
  modified_base (390)..(390): a, c, t, g, unknown or other
  misc_feature (390)..(390): n is a, c, g, or t
  modified_base (449)..(449): a, c, t, g, unknown or other
  misc_feature (449)..(449): n is a, c, g, or t
tcagcgatcgtatacacgaccggtgctcgatttagtgtgagtagtttgggtttggggaggagtcagtctcagtcaggacacagaatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctattaaattggtatcagcagagaccaggaaacgcccctaaactcctgatctatgatgcatccaaatttggaaagtggggtcccccataccaaggttcagtggcagtggatcgtaggggacagatttcactctacaccatcagcagtntgcactgaaagtattttgactaattactactgtacaacagtaattacagtaccccctanacgtctactacgttcggacggacggacgaggtagagtaacgtacgaaacgacgtagtcgactacgc

SEQ ID NO: 310212 - DNA, 604 bp, Homo sapiens
  misc_feature: GZ8MTXP02GWVPL.51.78.H01.1.454.CMB.2.raw
  modified_base (284)..(284): a, c, t, g, unknown or other
  misc_feature (284)..(284): n is a, c, g, or t
  modified_base (308)..(308): a, c, t, g, unknown or other
  misc_feature (308)..(308): n is a, c, g, or t
  modified_base (346)..(346): a, c, t, g, unknown or other
  misc_feature (346)..(346): n is a, c, g, or t
  modified_base (360)..(360): a, c, t, g, unknown or other
  misc_feature (360)..(360): n is a, c, g, or t
tcagcgatcgtatacacgaccggtgctcgatttagtgtgagtagtttgggtttgggcacgaccggtgctcgatttagtgtgagtagtttgggtttgggcacgaccggtgctcgatttagtgtgagtagtttgggtttggggaggagtcagtctcagtcaggacacagcatggacatgagggtccccgctcagctcctggggctcctgctactctggctccgaggtgccagatgtgacatccagatgacccagtctccatccctccctgtctgcatctgtagganacagagtcaccatcacttgccggnaagtcagagcatagcagtctatttaatgtatcagcagngaccaagggaaacnccccctaactctagatctatgatgcatacctaagtttagggaaaacggttcgggggtacccaagttaccgtaaagggtttccaagggttcgggactagggttggaacttccggtaggggaactaggtacttttaccgaacttctaccaaccctattccgaaaggcctaaggttcgttcggaccgaaccgttaggtaaaacgtttacgtttttaggaacctttaaaccgtttaaccgtttaaccg

SEQ ID NO: 310213 - DNA, 518 bp, Homo sapiens
  misc_feature: GZ8MTXP02JELZ3.51.78.H01.1.454.CMB.2.raw
  modified_base (224)..(224): a, c, t, g, unknown or other
  misc_feature (224)..(224): n is a, c, g, or t
  modified_base (275)..(275): a, c, t, g, unknown or other
  misc_feature (275)..(275): n is a, c, g, or t
  modified_base (380)..(380): a, c, t, g, unknown or other
  misc_feature (380)..(380): n is a, c, g, or t
  modified_base (404)..(404): a, c, t, g, unknown or other
  misc_feature (404)..(404): n is a, c, g, or t
  modified_base (454)..(454): a, c, t, g, unknown or other
  misc_feature (454)..(454): n is a, c, g, or t
tcagcgatcgtatacacgaccggtgctcgatttagtgtgagtagtttgggtttggggaggagtcagtctcagtcaggacacagaatggacatgagggtccccgctcagctcctggggctcctgctactctggctccgaggtgccagatgtgacatccagatgacccagtctccatcctccctgtctgcatctgtaggagacagagtcaccatcacttgccgggnaagtcagagcatagcagctattaatggtatcagcagagaccaagggaaacncccctaacctcctgatctatgatgcatccaaatttggaaagtcggggtacccccatcgaaggttcagtggcaggtgatcgtagggacagtatttcactctcaccntcagcagtgtgcgacctgaaagtnttttgacttaacttactactagtaccaaacagaagttacacgtacccctnacgtctctacgttcggacggtacggaccaaggtggagaagtcgaaaacgtactggtagctgacc

SEQ ID NO: 310214 - DNA, 515 bp, Homo sapiens
  misc_feature: GZ8MTXP02IDWV8.51.78.H01.1.454.CMB.2.raw
  modified_base (299)..(299): a, c, t, g, unknown or other
  misc_feature (299)..(299): n is a, c, g, or t
tcagcgatcgtatacacgaccggtgctcgatttagtgtgagtagtttgggtttgggggagaggagccccagccctgagattcccaggtgtttccattcagtgatcagcactgaacacagaggactcaccatggagttgggactgagctggattttcctttggctattttaaaaggtgtccagtgtgaagtgctactggtggagtctgggggaggcctggtacagcctggcaggtccctgagactctcctgtgcagcctctggattcacctttgatgattatgccatgcactgggtccgnaagctccagggaaggcctggagtgggtctcacgtattagttggaatagtggtagtatagcctatgcggactctgtggaagggccgattcaccatctccagagacaacgccaagaactccctgtatctgacaaatgaacagtctagagagctgaggacacggtccttgtattactgcgacaaaacgccaaaggcaacagctaggtacctcaattaag

SEQ ID NO: 310215 - DNA, 542 bp, Homo sapiens
  misc_feature: GZ8MTXP02HKMQQ.51.78.H01.1.454.CMB.2.raw
  modified_base (439)..(439): a, c, t, g, unknown or other
  misc_feature (439)..(439): n is a, c, g, or t
tcagcgatcgtatacacgaccggtgctcgatttagtgtgagtagtttgggtttggggaggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctatttaaatggtatcagcagagaccaagggaaacgcccctaactcctgatctatgatgcatacctaatttaggaaagtcggggtacccatcgtaaaggttcagttggctagtggatcgtggggacagtatttcactctcaccatcagcagtgtgcgactgaagtattttgactaaactttactaactgtaccaaanagtaacgttaccaacgttacccctacaacgtccttcgtaacgtttcgggacgggtacgggaaccaagggtggaagatacgaaaacggacttaggcggtactcg

SEQ ID NO: 310216 - DNA, 540 bp, Homo sapiens
  misc_feature: GZ8MTXP02GTSB8.51.78.H01.1.454.CMB.2.raw
  modified_base (299)..(299): a, c, t, g, unknown or other
  misc_feature (299)..(299): n is a, c, g, or t
  modified_base (490)..(490): a, c, t, g, unknown or other
  misc_feature (490)..(490): n is a, c, g, or t
tcagcgatcgtatacacgaccggtgctcgatttagtgtgagtagtttgggtttgggggagaggagccccagccctgagattcccaggtgtttccattcagtgatcagcactgaacacagaggactcaccatggagttgggactgagctggattttccttttggctattttaaaaggtgtccagtgtgaagtgctactggtggagtctgggggagcctggtacagcctggcaggtccctgagactctcctgtgcagcctctggattcacctttgatgattatgccatgcactgggtccgnaagctccgaggggaaggcctggagtgggtctcgacgtattagttggaatagtggtatatagcctatgcgactcgtgtgaaggggcccattcaccatctccagagacaacgccaaagaacctccctagtaactctagacaaaatgaaacagtacctagagagacgtggaggacgacggtccttgtatttacngacgacaaaacgccaaaggaacaaacgagcgtaggtactacaagttaacg

SEQ ID NO: 310217 - DNA, 522 bp, Homo sapiens
  misc_feature: GZ8MTXP02F8ILG.51.78.H01.1.454.CMB.2.raw
  modified_base (199)..(199): a, c, t, g, unknown or other
  misc_feature (199)..(199): n is a, c, g, or t
  modified_base (275)..(275): a, c, t, g, unknown or other
  misc_feature (275)..(275): n is a, c, g, or t
  modified_base (445)..(445): a, c, t, g, unknown or other
  misc_feature (445)..(445): n is a, c, g, or t
tcagcgatcgtatacacgaccggtgctcgatttagtgtgagtagtttgggtttggggaggagtcagtctcagtcaggacacagcatggacatgagggtccccgctcagctcctggggctcctgctactctggctccgaggtgccagatgtgacatccagatgacccagtctccatcctccctgtctgcatctgtagganacagagtcaccatcacttgccgggcaagtcagagcattagcagctattaaatggtatcagcagagaccaggaaacnccctaactctgatctatgatgctatcaattaggaagtcggggtaccatcaaggttcagtgcagtggatcgtagggacagtatttcactctacacatcagcagtgtgacgacgtagtaagtattttcgactaacttactactcgtacaaacagtacgttacacgtaccctnacgtctactacgtttcggacgggtacggaccgaagggtacggaagtaacacgtaaaacgacgtaggtacggctacgg

SEQ ID NO: 310218 - DNA, 526 bp, Homo sapiens
  misc_feature: GZ8MTXP02I67MR.51.78.H01.1.454.CMB.2.raw
  modified_base (320)..(320): a, c, t, g, unknown or other
  misc_feature (320)..(320): n is a, c, g, or t
tcagcgatcgtatacacgaccggtgctcgatttagtgtgagtagtttgggtttgggcacgaccggtgctcgatttagtgtgagtagtttgggtttggggaggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagtctatttaaatggtatcagcagagaccagggaaacncccctaactccctagatctatgatgcataccaaagtttggaaagtcggggtacccatcgaaggttcagtggcagtggatcgtgggacagtatttcactctcacatcagcagtgtcgacgtacctagaaagtatttacgacttaaacttactactgtacaaactagtaacgttaaccacgtacccctacacgtctacgtacgttcgg

SEQ ID NO: 310219 - DNA, 513 bp, Homo sapiens
  misc_feature: GZ8MTXP02GVBFP.51.78.H01.1.454.CMB.2.raw
  modified_base (376)..(376): a, c, t, g, unknown or other
  misc_feature (376)..(376): n is a, c, g, or t
  modified_base (443)..(443): a, c, t, g, unknown or other
  misc_feature (443)..(443): n is a, c, g, or t
tcagcgatcgtatacacgaccggtgctcgatttagtgtgagtagtttgggtttggggaggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctatttaaattggtatcagcagagaccagggaaacgcccctaacctcctgatctatgatgcatccaattggaaagtgggtcccatcaaggttcagtggcagtggatcgtgggacagatttcactctcacatcancagtgtgcgacctagaagtattttgactaaacttactaactgtacaacagagttacacgtacccctnaacgtctactacgtttcggacggacggaccgaaggtaggaacgaactacgaaaacgactgtacggctacg

SEQ ID NO: 310220 - DNA, 519 bp, Homo sapiens
  misc_feature: GZ8MTXP02IJYYV.51.78.H01.1.454.CMB.2.raw
  modified_base (441)..(441): a, c, t, g, unknown or other
  misc_feature (441)..(441): n is a, c, g, or t
  modified_base (449)..(449): a, c, t, g, unknown or other
  misc_feature (449)..(449): n is a, c, g, or t
tcagcgatcgtatacacgaccggtgctcgatttagtgtgagtagtttgggtttggggaggagtcagtctcagtcaggacacagcatggacatgagggtccccgctcagctcctggggctcctgctactctggctccgaggtgccagatgtgacatccagatgacccagtctccatcctccctgtctgcatctgtaggagacagatcaccatcacttgccgggcaagtcagagcattagcagcttatttaaattggtatcagcagagaccgagggaaacgcccctaaactcctgatctatgatgcatccaatttggaaagtgggtcccatcaaggttcagtgcagtggatctggggacagtatttcatctcaccatcgagcagtgtcgcgacctagaagtattttgactacttactactgtacaacagtattacactacccncaactctntaccgtttacgggacggtacgggaacccgtaagggtagaagtacaacgaaaacgaacgtcggtggactcg

SEQ ID NO: 310221 - DNA, 595 bp, Homo sapiens
  misc_feature: GZ8MTXP02JH9WI.51.78.H01.1.454.CMB.2.raw
  modified_base (308)..(308): a, c, t, g, unknown or other
  misc_feature (308)..(308): n is a, c, g, or t
tcagcgatcgtatacacgaccggtgctcgatttagtgtgagtagtttgggtttgggcacgaccggtgctcgatttagtgtgagtagtttgggtttgggcacgaccggtgctcgatttagtgtgagtagtttgggtttggggaggagtcagtctcagtcaggacacagcatggacatgagggtccccgctcagctcctggggctcctgctactctggctccgaggtgccagatgtgacatccagatgacccagtctccatccctccctgtctgcatctgtaggagacagagtcaccatcacttgccggnaagtcagggcattagcagacttatttaattgtatcagcagagaccgaggaaacgacccctaacctctagactactatgatcgacattaccgtaaatttagggaaacggttcggggtacccagtacgtaaacggttacgaggtcgggtacgaaggtcgggtaagtccgttaggggaactagtacttttaccaccttacctacaaccctattaccgagaccgtaaggtcgttacggacctaaccgtaaggtaagttaactttcgtaacctaactttaacctacgttacg

SEQ ID NO: 310222 - DNA, 516 bp, Homo sapiens
  misc_feature: GZ8MTXP02HZONS.51.78.H01.1.454.CMB.2.raw
  modified_base (446)..(446): a, c, t, g, unknown or other
  misc_feature (446)..(446): n is a, c, g, or t
tcagcgatcgtatacacgaccggtgctcgatttagtgtgagtagtttgggtttggggaggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctatttaaatggtatcagcagagaccagggaaacgcccctaactcctgatctatgatgcatcctaaattggaaagtcggggtacccatcaaaggttcagtggcagtggatcgtgggacagtatttcactctcacatcagcagtgtgcgactgaatattttgactaaacttctaactgtacaactagacttacagtaccccctanacgtctactacgttcgggacggacggacgaaggtaggaagacgtaacgaaacgacgtcggtacgacgtcg

SEQ ID NO: 310223 - DNA, 503 bp, Homo sapiens
  misc_feature: GZ8MTXP02G1X77.51.78.H01.1.454.CMB.2.raw
tcagcgatcgtatacacgaccggtgctcgatttagtgtgagtagtttgggtttgggcacgaccggtgctcgatttagtgtgagtagtttgggtttggggaggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctaattaaatggtatcagcagagaccaagggaaacgcccctaactccctgatctatgatgcatccaatttggaaagtgggcccatacagttcagtgcagtgatcgtgggacagtattcactctcaccatcagcgagtgtcgcgacctgaagtatttacgactaacttactactcgtacaacagtagttaacacgtaccctcacgtcctctacgttcggg

SEQ ID NO: 310224 - DNA, 551 bp, Homo sapiens
  misc_feature: GZ8MTXP02J4Y5B.51.78.H01.1.454.CMB.2.raw
  modified_base (323)..(323): a, c, t, g, unknown or other
  misc_feature (323)..(323): n is a, c, g, or t
  modified_base (334)..(334): a, c, t, g, unknown or other
  misc_feature (334)..(334): n is a, c, g, or t
tcagcgatcgtatacacgaccggtgctcgatttagtgtgagtagtttgggtttgggcacgaccggtgctcgatttagtgtgagtagtttgggtttgggaggagtcagtctcagtcaggacacagcatggacatgagggtccccgctcagctcctggggctcctgctactctggctccgaggtgccagatgtgacatccagatgacccagtctccatcctccctgtctgcatctggtaggagacagagtcaccatcacttgccgggcaagtcagagcattagcagtctatttaaatggatcagcagagacccaggggtaaaccncccctactccnatctatgatgcatacctagttaggtaaggtcggtccgactacgtagtacgtgtggcgagtaggtagtgtggtacgtacgtacttacttactacctactacctacactacgacgacgtagtcgtcggtaccgtacgtaagtaagttacgttactactactactactacgtacgtaacgtacgtaacgtactaccgtacctacctcgtacgtacgtacg

SEQ ID NO: 310225 - DNA, 540 bp, Homo sapiens
  misc_feature: GZ8MTXP02H4Q55.51.78.H01.1.454.CMB.2.raw
  modified_base (343)..(343): a, c, t, g, unknown or other
  misc_feature (343)..(343): n is a, c, g, or t
  modified_base (358)..(358): a, c, t, g, unknown or other
  misc_feature (358)..(358): n is a, c, g, or t
  modified_base (377)..(377): a, c, t, g, unknown or other
  misc_feature (377)..(377): n is a, c, g, or t
tcagcgatcgtatacacgaccggtgctcgatttagtgtgagtagtttgggtttgggcacgaccggtgctcgatttagtgtgagtagtttgggtttgggcacgaccggtgctcgatttagtgtgagtagtttgggtttggggaggagtcagtctcagtcaggacacagcatggacatgagggtccccgctcagctcctggggctcctgctactctggctccgaggtgccagatgtgacatccagatgacccagtctccatccctccctgtctgcatctgtagagacagatcaccatcacttcgcggcaagtcagagcatagcagctattaaatgtatcagcagngaccaagggaaaccncccctaactcagatctatnatgacatactaagtttaggaaaacgtcggggtacccagtacgtaaaggtttcaaggttgacgtaggtggaactcgtagggtacagtactttacacttctacacctatacagctagtacgtcgaccgtaacgtagaacgtatttacgaccttaactttactacg

SEQ ID NO: 310226 - DNA, 602 bp, Homo sapiens
  misc_feature: GZ8MTXP02G393Q.51.78.H01.1.454.CMB.2.raw
  modified_base (199)..(199): a, c, t, g, unknown or other
  misc_feature (199)..(199): n is a, c, g, or t
  modified_base (280)..(280): a, c, t, g, unknown or other
  misc_feature (280)..(280): n is a, c, g, or t
tcagcgatcgtatacacgaccggtgctcgatttagtgtgagtagtttgggtttggggaggagtcagtctcagtcaggacacagcatggacatgagggtccccgctcagctcctggggctcctgctactctggctccgaggtgccagatgtgacatccagatgacccagtctccatcctccctgtctgcatctgtagganacagagtcaccatcacttgccgggcaagtcagagcattagcagctatttaaatggtatcagcagagaaccgaagggaaacncccctaaacctcctgatctatgatgcatccaatttggaaagtcggggtacccatcgaaggttcagtggcaggtggatcgtaggggaacagttacttacactctacacatcgagcgtagtcgtgacgtacgtaggaatttatttcgaacttaacttactactactaacaaacgtaacgtaacgttaccgtaaccctacccgtacgaccgtccttacgttaccggtttccggggaacggggtaacgggtaaacccggtaaggggtacggaaaaggtaactaaaaccggaaaaaccggtaacgttagggccggttaaccgtaccg

SEQ ID NO: 310227 - DNA, 498 bp, Homo sapiens
  misc_feature: GZ8MTXP02JXQ5K.51.78.H01.1.454.CMB.2.raw
  modified_base (223)..(223): a, c, t, g, unknown or other
  misc_feature (223)..(223): n is a, c, g, or t
  modified_base (440)..(440): a, c, t, g, unknown or other
  misc_feature (440)..(440): n is a, c, g, or t
tcagcgatcgtatacacgaccggtgctcgatttagtgtgagtagtttgggtttggggaggagtcagtctcagtcaggacacagcatggacatgagggtccccgctcagctcctggggctcctgctactctggctccgaggtgccagatgtgacatccagatgacccagtctccatcctcctgtctgcatctgtaggagacagagtcaccatcacttgccgggnaagtcagagcattagcagctattaaattggtatcagcagagaccagggaaacgcccctaacctcctgatctatgatgcatccaatttggaaagtcggggtcccatcaaggttcagtggcagtggatcgtgggacagatttcactctcaccatcagcagtgtgcgacctgaagtatttgctaacttactactgtcaaacagtagttacagtacccctnacgctcacgtttcggcggtacgggaccaaggtgaagatacaaaacgactgtacggctg

SEQ ID NO: 310228 - DNA, 542 bp, Homo sapiens
  misc_feature: GZ8MTXP02HXD40.51.78.H01.1.454.CMB.2.raw
  modified_base (432)..(432): a, c, t, g, unknown or other
  misc_feature (432)..(432): n is a, c, g, or t
  modified_base (434)..(434): a, c, t, g, unknown or other
  misc_feature (434)..(434): n is a, c, g, or t
  modified_base (437)..(437): a, c, t, g, unknown or other
  misc_feature (437)..(437): n is a, c, g, or t
  modified_base (443)..(443): a, c, t, g, unknown or other
  misc_feature (443)..(443): n is a, c, g, or t
  modified_base (451)..(451): a, c, t, g, unknown or other
  misc_feature (451)..(451): n is a, c, g, or t
tcagcgatcgtatacacgaccggtgctcgatttagtgtgagtagtttgggtttgggggagaggagccccagccctgagattcccaggtgtttccattcagtgatcagcactgaacacagaggactcaccatggagttgggactgagcgtggtattttcctttaggctattttaaaaggtgtccagtgtgaagtgctatggtggagtctgggggagcctggtacagcctggcaggtccctgagctctcctgtgcagcctctggattcactttgatgattatgccatgcactggtcggcaagctcgaggaagggccgtggaggtgggtcgtcgtacgtagttagttaggtaagtagtaggtagtatagtcctatgcggactctgtgaggcgactcacatctcagagacaacacaacgaactacctactatctananaanagacangagagagngagacgacgacgtacgttagttagtacgtacgacgaacgaaaacgaacgaacgaacgaacgaacgtacgtacgtacgtacgtaacgtaacg

SEQ ID NO: 310229 - DNA, 527 bp, Homo sapiens
  misc_feature: GZ8MTXP02HCU5P.51.78.H01.1.454.CMB.2.raw
  modified_base (225)..(225): a, c, t, g, unknown or other
  misc_feature (225)..(225): n is a, c, g, or t
  modified_base (381)..(381): a, c, t, g, unknown or other
  misc_feature (381)..(381): n is a, c, g, or t
  modified_base (450)..(450): a, c, t, g, unknown or other
  misc_feature (450)..(450): n is a, c, g, or t
tcagcgatcgtatacacgaccggtgctcgatttagtgtgagtagtttgggtttggggaggagtcagtctcagtcaggacacagcatggacatgagggtccccgctcagctcctggggctcctgctactctggctccgaggtgccagatgtgacatccagatgacccagtctccatccctccctgtctgcatctgtaggagacagagtcaccatcacttgccgggnaagtcagagcattagcagctatttaaattggtatcagcagagaccgaggaaacgcccctaaacctcctgatctatgatgcatcctaatttggaaagtcggggtacccagtcaaggttcagtggcagtgatcgtgggacagtattcatctcacatcngcagtgtgcgactagaagtatttcgactaacttactactgtacaacgagtacgttaacacgtaaccccncaacgtcctctaaccgtttcgggcggtacgggaaccaagggtagaagtataacgaaaccgtagtacggtcggctacg

SEQ ID NO: 310230 - DNA, 580 bp, Homo sapiens
  misc_feature: GZ8MTXP02GVAVD.51.78.H01.1.454.CMB.2.raw
  modified_base (281)..(281): a, c, t, g, unknown or other
  misc_feature (281)..(281): n is a, c, g, or t
  modified_base (306)..(306): a, c, t, g, unknown or other
  misc_feature (306)..(306): n is a, c, g, or t
  modified_base (345)..(345): a, c, t, g, unknown or other
  misc_feature (345)..(345): n is a, c, g, or t
  modified_base (356)..(356): a, c, t, g, unknown or other
  misc_feature (356)..(356): n is a, c, g, or t
  modified_base (364)..(364): a, c, t, g, unknown or other
  misc_feature (364)..(364): n is a, c, g, or t
tcagcgatcgtatacacgaccggtgctcgatttagtgtgagtagtttgggtttgggcacgaccggtgctcgatttagtgtgagtagtttgggtttgggcacgaccggtgctcgatttagtgtgagtagtttgggtttgggaggagtcagtctcagtcaggacacagcatggacatgagggtccccgctcagctcctggggctcctgctactctggctccgaggtgccagatgtgacatccagatgacccagtctccatcctcctgtctgcatctgtagganacagagtcaccatcacttgccgganaagtcagagcattagcagctaatttaatgtatcagcagngacagggaacnccctaacncagatctatgatgacatccaaatttggaaacgtcgggtacccatacgaaaggtttcaggttaggctaagggtggaacttcggtaggggaacctaggtactttaccgaattccctacaaccctattacccgaacgtcgtaaggttcggttcgacccggtaacctttaggaaaaccggttttactttaccggaacctttaaaaccgtttacgttaacg

SEQ ID NO: 310231 - DNA, 532 bp, Homo sapiens
  misc_feature: GZ8MTXP02IFF83.51.78.H01.1.454.CMB.2.raw
  modified_base (459)..(459): a, c, t, g, unknown or other
  misc_feature (459)..(459): n is a, c, g, or t
tcagcgatcgtatacacgaccggtgctcgatttagtgtgagtagtttgggtttggggaggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctatttaaattggtatcagcagagaccaggaaacgcccctaactcctagatctatgatgcataccaagtttaggaaagttcggggtacccatcgaaggttcagtgcagtggatcgtagggacagtatttcactctacacatcagacagtgtcgacgtacctagtaaagtattttgactaactttactactgtacaacagtaagttacacgtaccctnacgactctacgtttcgggacggtacgggaccgtaaggtaggaagatacgaaaacgtaacgtcggtaggctacg

SEQ ID NO: 310232 - DNA, 501 bp, Homo sapiens
  misc_feature: GZ8MTXP02GE86E.51.78.H01.1.454.CMB.2.raw
  modified_base (437)..(437): a, c, t, g, unknown or other
  misc_feature (437)..(437): n is a, c, g, or t
  modified_base (477)..(477): a, c, t, g, unknown or other
  misc_feature (477)..(477): n is a, c, g, or t
tcagcgatcgtatacacgaccggtgctcgatttagtgtgagtagtttgggtttgggaggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctatttaaattggtatcagcagagaccagggaaagcccctaaacctcctgatctatgatgcatccaatttggaaagtggggtcccatcaaggttcagtggcagtggatctgggacagatttcatctcaccatcagcagtgtgcgacctgaaagattttgctaaattactaactgtcaacagattacattacccccncacgctctacgttcggacggacggacgaaggtaggaaganaacaaacgaacgtacgtggcgtcg

SEQ ID NO: 310233 - DNA, 533 bp, Homo sapiens
  misc_feature: GZ8MTXP02FTV9C.51.78.H01.1.454.CMB.2.raw
  modified_base (456)..(456): a, c, t, g, unknown or other
  misc_feature (456)..(456): n is a, c, g, or t
tcagcgatcgtatacacgaccggtgctcgatttagtgtgagtagtttgggtttggggaggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctatttaaattggtatcagcagagaccagggaacgcccctaacctcctgatctatgatgcatccaatttggaaagtcggggtccatcaaggttcagtggcagtggatcgtgggacagatttcactctcaccatcagcagtgtgcgactagaaacgtattttagctaaacctttactactagtaccaacgtagtaacgttaccacgtaccccctnaacgtctacgtacgtttcggggacggacggggtaaccagggttcggaagactacgaaaacgactggtacggctacgg

SEQ ID NO: 310234 - DNA, 582 bp, Homo sapiens
  misc_feature: GZ8MTXP02GAG70.51.78.H01.1.454.CMB.2.raw
  modified_base (199)..(199): a, c, t, g, unknown or other
  misc_feature (199)..(199): n is a, c, g, or t
  modified_base (224)..(224): a, c, t, g, unknown or other
  misc_feature (224)..(224): n is a, c, g, or t
tcagcgatcgtatacacgaccggtgctcgatttagtgtgagtagtttgggtttggggaggagtcagtctcagtcaggacacagcatggacatgagggtccccgctcagctcctggggctcctgctactctggctccgaggtgccagatgtgacatccagatgacccagtctccatcctccctgtctgcatctgtagganacagagtcaccatcacttgccgggnaagtcagagcattagcagtcttaatttaaattggtatcagacagacgaaccgaagggaaaccgcccctaacctcctgatctatgatgactactacctaagtttagggaaaggtccggggtacccagtacgtaaggttcaggtggcgtaggtggagtcgtagggactagtactttcacttctacaccatcagcagtgtcgacgtactagtaagtattttcgacttaacttactactacgtacaaacgtagtaacgttactaccgtaccccctagtacgtccttacgtaccggtttacgggacggtacgggaaccgtaggggtacgaagtaactaacgaaacgtacgtggtacggctacg

SEQ ID NO: 310235 - DNA, 532 bp, Homo sapiens
  misc_feature: GZ8MTXP02FV8M7.51.78.H01.1.454.CMB.2.raw
  modified_base (199)..(199): a, c, t, g, unknown or other
  misc_feature (199)..(199): n is a, c, g, or t
  modified_base (224)..(224): a, c, t, g, unknown or other
  misc_feature (224)..(224): n is a, c, g, or t
  modified_base (396)..(396): a, c, t, g, unknown or other
  misc_feature (396)..(396): n is a, c, g, or t
  modified_base (454)..(454): a, c, t, g, unknown or other
  misc_feature (454)..(454): n is a, c, g, or t
tcagcgatcgtatacacgaccggtgctcgatttagtgtgagtagtttgggtttggggaggagtcagtctcagtcaggacacagcatggacatgagggtccccgctcagctcctggggctcctgctactctggctccgaggtgccagatgtgacatccagatgacccagtctccatcctccctgtctgcatctgtagganacagagtcaccatcacttgccgggnaagtcagagcattagcagctattaaattggtatcagcagagaccagggaaacgcccctaaactcctgatctatgatgcataccaatttcggaaagtcggggtacccagtacaaggttcaagtggcgagtggaatctgggaacagatttcacttctacaccatcagcagtgtncgactgaagtattttgactaacttactactgtacaacagtagttacacgtacccctanactctactacgttacggacgggacggaacgtaaggtacgaacgtacgtaacgaaaacgtacgtacggtacggactacg

SEQ ID NO: 310236 - DNA, 707 bp, Homo sapiens
  misc_feature: GZ8MTXP02I87R0.51.78.H01.1.454.CMB.2.raw
  modified_base (240)..(240): a, c, t, g, unknown or other
  misc_feature (240)..(240): n is a, c, g, or t
  modified_base (264)..(264): a, c, t, g, unknown or other
  misc_feature (264)..(264): n is a, c, g, or t
tcagcgatcgtatacacgaccggtgctcgatttagtgtgagtagtttgggtttgggcacgaccggtgctcgatttagtgtgagtagtttgggtttggggaggagtcagtctcagtcaggacacagcatggacatgagggtccccgctcagctcctggggctcctgctactctggctccgaggtgccagatgtgacatccagatgacccagtctccactcctcctgtctgcatctgtaganacagagtcacatcacttgccgganaagtcagagctattagcagtacttaatttaaagtggtatcagacagaacgaccgaaagggaaccacccctaacctccctagacttacgtaatcggaatcgctaacttaccgtaaagtttacgggaaaacgggttccggggtaccctaagtaccgtaaaggtttccgaaggttcggacgtagggtaggtaacgtttcggtacgggggaactaaggttactttaaccgtacccgtttaccttaaccccgaaacctaacttccggaaaggtcccgtaacggttgggttccggaaccggtaacccgttaagggtaaaaggttactttttaccggaaccgtttaaaacctttacgttaaccgtacgtttaacgaaaacctagggttaaacgtaacctaacccggttacccccttagaacggtccctacgttaaccggtttaccggggg

SEQ ID NO: 310237 - DNA, 664 bp, Homo sapiens
  misc_feature: GZ8MTXP02F6OS7.51.78.H01.1.454.CMB.2.raw
  modified_base (225)..(225): a, c, t, g, unknown or other
  misc_feature (225)..(225): n is a, c, g, or t
  modified_base (289)..(289): a, c, t, g, unknown or other
  misc_feature (289)..(289): n is a, c, g, or t
  modified_base (583)..(583): a, c, t, g, unknown or other
  misc_feature (583)..(583): n is a, c, g, or t
tcagcgatcgtatacacgaccggtgctcgatttagtgtgagtagtttgggtttggggaggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccggganaagtcagagcattagcagtacttaatttaaattggtatacagacagacgaaccgaagggaaacncccctaacctcctagactctatgatgctactacgtaagtttagggaaaggtcccggggtaccctagtacgtaacgggtttacgaggttcgggcgtagggttcgggtaacttccgggtaagggggaactaacggtttactttttaccaacctttccctaccaaaccctaattaccgaaacgtccgtaaggttcggtacgacccgtaaccgttaggtaaacgtttagttttacgaacttaaacctttaaccttacgttacgtaaacaactaaggtacttaacctaccgtacccctnacgtcctacgttacgttacgggacgggtacggaacgtagggtaggaagacgtaaacgaaacggtacgtcggacggactacg

SEQ ID NO: 310238 - DNA, 512 bp, Homo sapiens
  misc_feature: GZ8MTXP02HLUYL.51.78.H01.1.454.CMB.2.raw
  modified_base (447)..(447): a, c, t, g, unknown or other
  misc_feature (447)..(447): n is a, c, g, or t
tcagcgatcgtatacacgaccggtgctcgatttagtgtgagtagtttgggtttggggaggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctattaaattggtatcagcagagaccaagggaaacgcccctaacctcctgatctatgatgcatcctaatttggaaagtcggggtacccatcaaaggtcagtgcagtgatcgtggggacagtatttcactctcaccatcagcagtgtgcgactgaaagtattttgactaactttacactgtacaaacagtattaacacgtacccanacgctactactttcgggacggacgggaaccaaggtggaagatacgaaaacgaactgtcggctacg

SEQ ID NO: 310239 - DNA, 591 bp, Homo sapiens
  misc_feature: GZ8MTXP02IQJFG.51.78.H01.1.454.CMB.2.raw
  modified_base (200)..(200): a, c, t, g, unknown or other
  misc_feature (200)..(200): n is a, c, g, or t
  modified_base (282)..(282): a, c, t, g, unknown or other
  misc_feature (282)..(282): n is a, c, g, or t
  modified_base (507)..(507): a, c, t, g, unknown or other
  misc_feature (507)..(507): n is a, c, g, or t
tcagcgatcgtatacacgaccggtgctcgatttagtgtgagtagtttgggtttggggaggagtcagtctcagtcaggacacagcatggacatgagggtccccgctcagctcctggggctcctgctactctggctccgaggtgccagatgtgacatccagatgacccagtcctccatcctccctgtctgcatctgtagganacagagtcaccatcacttgccggcaagtcagagcattagcagtcttaatttaaatggtatcagcagacgaccgaagggaacncccctaactcctagatctatgatcgctactacctaagtttagggaaacggttcggggtacccatacgtaaaggttcaaggttcggcgtaggtggacgttcgtggggaactagttactttacactcctacactatacgagctagtgacgtaccgacgtagtaaagttactttacgaccttaacttactacgtacgtacaacgtagtaacgttactaccgtaccctnacgtcttacgtacggttcgggacggtacggtaaccgaagggtacggaagtaacgtaacgaaaacgtacgtacggtacgactacg

SEQ ID NO: 310240 - DNA, 522 bp, Homo sapiens
  misc_feature: GZ8MTXP02J06XU.51.78.H01.1.454.CMB.2.raw
  modified_base (344)..(344): a, c, t, g, unknown or other
  misc_feature (344)..(344): n is a, c, g, or t
  modified_base (359)..(359): a, c, t, g, unknown or other
  misc_feature (359)..(359): n is a, c, g, or t
  modified_base (474)..(474): a, c, t, g, unknown or other
  misc_feature (474)..(474): n is a, c, g, or t
tcagcgatcgtatacacgaccggtgctcgatttagtgtgagtagtttgggtttgggcacgaccggtgctcgatttagtgtgagtagtttgggtttgggcacgaccggtgctcgatttagtgtgagtagtttgggtttggggaggagtcagtctcagtcaggacacagcatggacatgagggtccccgctcagctcctggggctcctgctactctggctccgaggtgccagatgtgacatccagatgacccagtctccatcctccctgtctgcatctgtagagacagagtcaccatcacttgccggcaagtcagagcatagcagctattaaatggtatcagcagngaccaaggggaaacncccctaactcctagactactatgatgacatacctaattaggaaagtcggggtacccagtaccgtaaaggttcaaggtgacaggtagatcgtagggacagtacttcgactctcacntacagcagtgtcgacgaacctagaactactttagacctaacttctacg

SEQ ID NO: 310241 - DNA, 509 bp, Homo sapiens
  misc_feature: GZ8MTXP02HQNDV.51.78.H01.1.454.CMB.2.raw
  modified_base (393)..(393): a, c, t, g, unknown or other
  misc_feature (393)..(393): n is a, c, g, or t
  modified_base (437)..(437): a, c, t, g, unknown or other
  misc_feature (437)..(437): n is a, c, g, or t
tcagcgatcgtatacacgaccggtgctcgatttagtgtgagtagtttgggtttggggaggagtcagtctcagtcaggacacagcatggacatgagggtccccgctcagctcctggggctcctgctactctggctccgaggtgccagatgtgacatccagatgacccagtctccatcctcctgtctgcatctgtaggagacagagtcaccatcacttgccgggcaagtcagagcattagcagctatttaaattggtatcagcagagaccaggaaacgcccctaactcctgatctatgatgcatccaatttggaaagtcggggtcccatcaaggttcagtgcagtgatcgtgggacagtatttcatctcaccatcagcagtgtgcgactgaagtntttgactaacttacactgtacaacagtacgttacacgtaccctnacgtcctcgtaacgtttcgggacggtacgggaccaagggtggaacgagtacgaaaacgacgtgtcggctacg

SEQ ID NO: 310242 - DNA, 491 bp, Homo sapiens
  misc_feature: GZ8MTXP02HS5B3.51.78.H01.1.454.CMB.2.raw
  modified_base (261)..(261): a, c, t, g, unknown or other
  misc_feature (261)..(261): n is a, c, g, or t
  modified_base (306)..(306): a, c, t, g, unknown or other
  misc_feature (306)..(306): n is a, c, g, or t
  modified_base (355)..(355): a, c, t, g, unknown or other
  misc_feature (355)..(355): n is a, c, g, or t
  modified_base (364)..(364): a, c, t, g, unknown or other
  misc_feature (364)..(364): n is a, c, g, or t
  modified_base (366)..(366): a, c, t, g, unknown or other
  misc_feature (366)..(366): n is a, c, g, or t
  modified_base (372)..(372): a, c, t, g, unknown or other
  misc_feature (372)..(372): n is a, c, g, or t
  modified_base (440)..(440): a, c, t, g, unknown or other
  misc_feature (440)..(440): n is a, c, g, or t
tcagcgatcgtatacacgaccggtgctcgatttagtgtgagtagtttgggtttgggcacgaccggtgctcgatttagtgtgagtagtttgggtttgggcacgaccggtgctcgatttagtgtgagtagtttgggttggggaggagtcagtctcagtcaggacacagcatggacatgagggtcccgctcagctcctggggctcctgctactctggctccgaggtgccagatgtgacatccagatgacccagtctccatcccnccctgtctgcatctgtaggagacagagtcaccatcacttgccggnaagtcagagcatagcagctattaaatgtatcagcagcgacagggaaacncccctaacncnatctangatgcatccaagtttcggaaagtcgggccatcaggttcagtgcagtgatcgtaggacagatttcactntacaccatcagtcagtcgtagcaactgaaacgtttcttagactacttacac

SEQ ID NO: 310243 - DNA, 546 bp, Homo sapiens
  misc_feature: GZ8MTXP02FUTXF.51.78.H01.1.454.CMB.2.raw
  modified_base (280)..(280): a, c, t, g, unknown or other
  misc_feature (280)..(280): n is a, c, g, or t
  modified_base (476)..(476): a, c, t, g, unknown or other
  misc_feature (476)..(476): n is a, c, g, or t
tcagcgatcgtatacacgaccggtgctcgatttagtgtgagtagtttgggtttggggaggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagcttattaaattggtatcagcagacgaccgagggaaacncccctaacctcctgatctatgactgcatacctaaagtttaggaaacggtcggggtaccccagtacgaaaggtttcaggttggcgagtggatcgtagggacagtatttcacttctacaccatcagctagtgtgacgactagtaactatttagacctaactttactactgtacaacgagtacgttacacgtaccctanacgtctacgtacgtttcggacgggacggacctaaggtcgaagacgtacgaaaacgacgtgtacggctacg

SEQ ID NO: 310244 - DNA, 524 bp, Homo sapiens
  misc_feature: GZ8MTXP02GM048.51.78.H01.1.454.CMB.2.raw
tcagcgatcgtatacacgaccggtgctcgatttagtgtgagtagtttgggtttggggaggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctatttaaattggtatcagcagagaccagggaaacgcccctaacctcctgatctatgatgcatacctaagtttggaaagtcggggtacccatcaaggttcagtggcagtgatcgtgggacagtatttcactctcaccatcagcagtgtgcgactagaagtatttgactaacttactactgtacaaactagacgttacacgtacccctcacgcctctaccgtttcgggcggtaacgggaccgaaagggtcggaagtactacgaaaacgactggtacggctacg

SEQ ID NO: 310245 - DNA, 665 bp, Homo sapiens
  misc_feature: GZ8MTXP02IYQQL.51.78.H01.1.454.CMB.2.raw
  modified_base (318)..(318): a, c, t, g, unknown or other
  misc_feature (318)..(318): n is a, c, g, or t
tcagcgatcgtatacacgaccggtgctcgatttagtgtgagtagtttgggtttgggcacgaccggtgctcgatttagtgtgagtagtttgggtttggggaggagtcagtctcagtcaggacacagcatggacatgagggtccccgctcagctcctggggctcctgctactctggctccgaggtgccagatgtgacatccagatgacccagtctccatcctcctgtctgcatctgtaggagacagagtcaccatcactgccggcaagtcagagcattagcagtctatttaaatggtatcagcagagaccgaagggaacncccctaactccctagatctatgatgcatacctaaagtttacggaaaggttcggggtacccctaagttaccgtaaaggtttccgaaggttcgggacgtaagggttagggaacgttccggttagggggaacctaaggttactttttaccaacctttccttaccaaccctaagttccaagccgtaaggttcggttacggaccgtaaccgttaggtaaaacggttatttttacggaaccttaaacctttaaccgttaaacttacggttaaccaaaaccgttagggtaaactttaaccgaaccggttaaccccccttacgtaaccgttccttaccgttaccggttaccgggg

SEQ ID NO: 310246 - DNA, 543 bp, Homo sapiens
  misc_feature: GZ8MTXP02FZ356.51.78.H01.1.454.CMB.2.raw
  modified_base (290)..(290): a, c, t, g, unknown or other
  misc_feature (290)..(290): n is a, c, g, or t
  modified_base (309)..(309): a, c, t, g, unknown or other
  misc_feature (309)..(309): n is a, c, g, or t
tcagcgatcgtatacacgaccggtgctcgatttagtgtgagtagtttgggtttgggggctctgggagaggagccccagccctgagattcccaggtgtttccattcagtgatcagcactgaacacagaggactcaccatggagttgggactgagctggattttccttttggctattttaaaaggtgtccagtgtgaagtgctactggtggagtcgtgggggaggcctggtacagcctggcaggtccctgagactctcctgtgcagcctctggattcacctttgatgattangccatgcacgtgggtccgnaagctccgagggacgggcctgggagtgggtctcacgtattagtgaatagtgtagtatgctatgcgactctgtgaagggccgattcacatctccagagacaacgaccaagaacctccctagtactctgacaaatagaacagtctagagagcgtaggacggacacgggtccttagtacgttacgtacgcgaacgaaaacgacccgaaaaggaccaaaccgtagcctacgggtaacc

SEQ ID NO: 310247 - DNA, 581 bp, Homo sapiens
  misc_feature: GZ8MTXP02F5WE3.51.78.H01.1.454.CMB.2.raw
  modified_base (308)..(308): a, c, t, g, unknown or other
  misc_feature (308)..(308): n is a, c, g, or t
tcagcgatcgtatacacgaccggtgctcgatttagtgtgagtagtttgggttgggggctctgggagaggagccccagccctgagattcccaggtgtttccattcagtgatcagcactgaacacagaggactcaccatggagttgggactgagctggattttccttttggctattttaaaaggtgtccagtgtgaagtgctactggtggagtcgtgggggaggcctggtacagcctggcaggtccctgagactctcctgtgcagcctctggattcacctttgatgattatgccatgcacgtgggtccgnaagctccgaggggaaggcctgggagtgggctcgacgttattagtgaatggtggtatatgcctagtcggcggtactcgtgtaggaacgggccgtattcacctatcctccagagaacacgaccaagtaaacctccctagtactcgtcgaactaaagtacgaacacggtctagaggtagcgtaggaacggtaccaccggtcctttaggttacttaccgtaggaccgtaacgaaaaacgcccgaaaaggaccaaaacgacgtacgtacggttaaacc

SEQ ID NO: 310248 - DNA, 531 bp, Homo sapiens
  misc_feature: GZ8MTXP02IDB6M.51.78.H01.1.454.CMB.2.raw
  modified_base (285)..(285): a, c, t, g, unknown or other
  misc_feature (285)..(285): n is a, c, g, or t
  modified_base (303)..(303): a, c, t, g, unknown or other
  misc_feature (303)..(303): n is a, c, g, or t
  modified_base (330)..(330): a, c, t, g, unknown or other
  misc_feature (330)..(330): n is a, c, g, or t
  modified_base (352)..(352): a, c, t, g, unknown or other
  misc_feature (352)..(352): n is a, c, g, or t
tcagcgatcgtatacacgaccggtgctcgatttagtgtgagtagtttgggtttgggggctctgggagaggagccccagccctgagattcccaggtgtttccattcagtgatcagcactgaacacagaggactcaccatggagttgggactgagctggtattttccttttggctattttaaaggtgtccagtgtgaagtgctactggtggagtcgtgggggagcctggtacagcctggcaggtccctgagactctcctgtgcagctctgattcacttgatgattangccatgcacgtgggccgnaagctcgagggaggcctggagtggtcncagtattagtgatgtggtagtntgctagtgcgtactctgtgaaggcgattcacatctcagagacaacgccaaagaacctccctagtatctagacaatgaaacagtctagagagcgtagacggacgacggtcctttaggtaacttactggaccgaacgaaaaacggccgaaaacgggccaaaacgtcgacgttacggtaacc

SEQ ID NO: 310249 - DNA, 531 bp, Homo sapiens
  misc_feature: GZ8MTXP02HK6XG.51.78.H01.1.454.CMB.2.raw
  modified_base (380)..(380): a, c, t, g, unknown or other
  misc_feature (380)..(380): n is a, c, g, or t
  modified_base (405)..(405): a, c, t, g, unknown or other
  misc_feature (405)..(405): n is a, c, g, or t
  modified_base (498)..(498): a, c, t, g, unknown or other
  misc_feature (498)..(498): n is a, c, g, or t
tcagcgatcgtatacacgaccggtgctcgatttagtgtgagtagtttgggtttggggaggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctatttaaatggtatcagcagagaccagggaaacgcccctaacctcctagatctatgatgcatcctaatttggaaagtcggggtacccatcgaaggttcagtgcagtggatcgtgggacagtactttcactctcaccntcagcagtgtgcgacctagaagttnttttcgactaacttactactgtacaactagtaacgttaccaacgtacccctcaacgtctactaacgtttcggacgggacgggacccgtaaggnggaagactacgaaaacgtactggtacggctacg

SEQ ID NO: 310250 - DNA, 535 bp, Homo sapiens
  misc_feature: GZ8MTXP02IUBUC.51.78.H01.1.454.CMB.2.raw
  modified_base (281)..(281): a, c, t, g, unknown or other
  misc_feature (281)..(281): n is a, c, g, or t
  modified_base (399)..(399): a, c, t, g, unknown or other
  misc_feature (399)..(399): n is a, c, g, or t
tcagcgatcgtatacacgaccggtgctcgatttagtgtgagtagtttgggtttggggaggagtcagtctcagtcaggacacagcatggacatgagggtccccgctcagctcctggggcctcctgctactctggctccgaggtgccagatgtgacatccagatgacccagtcctccatcctccctgtctgcatctgtaggagacagagtccaccatcacttgccgggcaagtcagagcattagcagctatttaaattggtatcagcagagaccagggaaacncccctaactcctgatctatgatgcatcctaagtttaggaaaggttcggggtaccccagtcgtaaaggttcaaggttggcgagtggatcgtggggacagtatttcactctcaccatcancagtgtgcgactagaagtatttgactaacttactactgtacaacagtaacgttactacgtacccctcacgtctactacgtttcggacggtacggaaccgaaggtaggaagactacgaaaacgactagtcgtctacg

SEQ ID NO: 310251 - DNA, 560 bp, Homo sapiens
  misc_feature: GZ8MTXP02H2CSM.51.78.H01.1.454.CMB.2.raw
  modified_base (361)..(361): a, c, t, g, unknown or other
  misc_feature (361)..(361): n is a, c, g, or t
  modified_base (378)..(378): a, c, t, g, unknown or other
  misc_feature (378)..(378): n is a, c, g, or t
  modified_base (385)..(385): a, c, t, g, unknown or other
  misc_feature (385)..(385): n is a, c, g, or t
tcagcgatcgtatacacgaccggtgctcgatttagtgtgagtagtttgggtttgggcacgaccggtgctcgatttagtgtgagtagtttgggtttgggcacgaccggtgctcgatttagtgtgagtagtttgggtttggggaggagtcagtctcagtcaggacacagcatggacatgagggtccccgctcagctctggggctcctgctactctggctccgaggtgccagatgtgacatccagatgacccagtctccatcctccctgtctgcatctgtaggagacagagtcaccatcacttgccggcaagtcagagcattagcagctaattaaattgtatcagcagagaaccgaaggaaacnccccctaaactccgtanatctaangatgacattactaaagtttggaaacgtcgggtaccaagtacgtaaaggtttcaaggttgactaggtggaattcgagggacagtactttacaacttctacaacctatccgaagtcaagtcgtacgaccggtaacctaggtaaagttacttttacgaccttaaacttttaccgaacg

SEQ ID NO: 310252 - DNA, 533 bp, Homo sapiens
  misc_feature: GZ8MTXP02J1W0W.51.78.H01.1.454.CMB.2.raw
tcagcgatcgtatacacgaccggtgctcgatttagtgtgagtagtttgggtttggggggagaggagccccagccctgagattcccaggtgtttccattcagtgatcagcactgaacacagaggactcaccatggagttgggactgagctggattttccttttggctattttaaaaggtgtccagtgtgaagtgctactggtggagtcgtgggggaggcctggtacagcctggcaggtccctgagactctcctgtgcagcctctggattcacctttgatgattatgccatgcactgggtccgcaagctccgaggggaaggcctggagtgggtctcacgtattagtggaatagtggtagtatagcctatgcggactctgtagaagggccattcaccatcctccagacgacaacgccaaagaacctccctgtatctgacaaatgaacagtctgagagctggacgacgacggtccttagtactacgtgacgtacaaaacgccaaaggcaaacgagctaggtacctacaagtttaacg

SEQ ID NO: 310253 - DNA, 598 bp, Homo sapiens
  misc_feature: GZ8MTXP02I9HWD.51.78.H01.1.454.CMB.2.raw
  modified_base (188)..(188): a, c, t, g, unknown or other
  misc_feature (188)..(188): n is a, c, g, or t
  modified_base (225)..(225): a, c, t, g, unknown or other
  misc_feature (225)..(225): n is a, c, g, or t
  modified_base (271)..(271): a, c, t, g, unknown or other
  misc_feature (271)..(271): n is a, c, g, or t
  modified_base (283)..(283): a, c, t, g, unknown or other
  misc_feature (283)..(283): n is a, c, g, or t
  modified_base (531)..(531): a, c, t, g, unknown or other
  misc_feature (531)..(531): n is a, c, g, or t
tcagcgatcgtatacacgaccggtgctcgatttagtgtgagtagtttgggtttgggcacgaccggtgctcgatttagtgtgagtagtttgggtttgggcacgaccggtgctcgatttagtgtgagtagtttgggtttggggaggagtcagtctcagtcaggacacagcatggacatgagggtccccgntcagctcctggggctcctgctactctggctccgagtnccagatgtgacatccagatcgacccagtcctccatccctcctgtcngcatctgtaganacagagtccacatcacgttgaccggacaagtcagacgcagttagctagtacttaatttaaagttggtatcgagtaccgaagaccggaaccgaaacggggtaaacctcccccgttaaacctcgtagtacttactagtagagtcgactactacgttaagttacgggaaacggttcgggtacccaagtacgtaaacggttcacggttgacgtaggtagactcggtaggactagtacttcaacttctacacnctacgacgtcgagttacgacgtacgtaacgtacgtaagttactttacgactttaaccttacttaacg

SEQ ID NO: 310254 - DNA, 534 bp, Homo sapiens
  misc_feature: GZ8MTXP02HE6AY.51.78.H01.1.454.CMB.2.raw
  modified_base (327)..(327): a, c, t, g, unknown or other
  misc_feature (327)..(327): n is a, c, g, or t
tcagcgatcgtatacacgaccggtgctcgatttagtgtgagtagtttgggtttgggcacgaccggtgctcgatttagtgtgagtagtttgggtttggggaggagtcagtctcagtcaggacacagcatggacatgagggtccccgctcagctcctggggctcctgctactctggctccgaggtgccagatgtgacatccagatgacccagtctccatccctccctgtctgcatctgtaggagacagagtcaccatcacttggccgggcaagtcagagcaattagcagtcttaatttaaattggtatcagcagagaccaagggaaacncccctaactccctgatctatgatgctatcctaaagtttggaaagtcggggtacccatacgaagttcagtggcagtggatcgtagggacagtatttcactctacacatcaagcagtgtgacgactagaagtattttcgacttaaacttactacttacgtacaaactagtaacgttaacaacgtacccctacactctacgtacgttcgg

SEQ ID NO: 310255 - DNA, 559 bp, Homo sapiens
  misc_feature: GZ8MTXP02HXFL4.51.78.H01.1.454.CMB.2.raw
  modified_base (306)..(306): a, c, t, g, unknown or other
  misc_feature (306)..(306): n is a, c, g, or t
  modified_base (470)..(470): a, c, t, g, unknown or other
  misc_feature (470)..(470): n is a, c, g, or t
tcagcgatcgtatacacgaccggtgctcgatttagtgtgagtagtttgggtttggggctctgggagaggagccccagccctgagattcccaggtgtttccattcagtgatcagcactgaacacagaggactcaccatggagttgggactgagctggattttccttttggctattttaaaaggtgtccagtgtgaagtgctactggtggagtctgggggagcctggtacagcctggcaggtccctgacgactctcctgtgcagccctctggattccaccttgatgattatgccatgcagtggtccgnaagctccgaggggaggcctggagtggtctcagtattagtggaatggtggtacgttatagtcctaatcgacggaccttcgtgtgggaaacgggcccgattccaacccagtcctaccagacaaccaacgcctaaagaacctcccctagtacttccagacctaaaanagaacgagacagagagacgagacgacgacgtcgtacgtactacgtacgacgaacgaaacgaacgaacgacgaacgacgacgtacgtacg

SEQ ID NO: 310256 - DNA, 525 bp, Homo sapiens
  misc_feature: GZ8MTXP02JV74U.51.78.H01.1.454.CMB.2.raw
  modified_base (278)..(278): a, c, t, g, unknown or other
  misc_feature (278)..(278): n is a, c, g, or t
  modified_base (387)..(387): a, c, t, g, unknown or other
  misc_feature (387)..(387): n is a, c, g, or t
  modified_base (393)..(393): a, c, t, g, unknown or other
  misc_feature (393)..(393): n is a, c, g, or t
  modified_base (454)..(454): a, c, t, g, unknown or other
  misc_feature (454)..(454): n is a, c, g, or t
tcagcgatcgtatacacgaccggtgctcgatttagtgtgagtagtttgggtttggggaggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctatttaaatggtatcagcagagaccaagggaaacncccctaaacctcctgatctatgatgcatacctaatttggaaagtcggggtacccatcaaggttcagtggcaggtggatcgtgggacagtatttcactctcacctatcancagtgngcgactagaagtattttgactaaacttactactgtacaactagtagtacacgtaacccctnacgtctctacgtttcggacggtacgggaccgtaaggtaggaagactaacgaaacgtaactggtaggctacg

SEQ ID NO: 310257 - DNA, 522 bp, Homo sapiens
  misc_feature: GZ8MTXP02HRF2U.51.78.H01.1.454.CMB.2.raw
  modified_base (187)..(187): a, c, t, g, unknown or other
  misc_feature (187)..(187): n is a, c, g, or t
  modified_base (283)..(283): a, c, t, g, unknown or other
  misc_feature (283)..(283): n is a, c, g, or t
  modified_base (317)..(317): a, c, t, g, unknown or other
  misc_feature (317)..(317): n is a, c, g, or t
  modified_base (364)..(364): a, c, t, g, unknown or other
  misc_feature (364)..(364): n is a, c, g, or t
tcagcgatcgtatacacgaccggtgctcgatttagtgtgagtagtttgggtttgggcacgaccggtgctcgatttagtgtgagtagtttgggtttgggcacgaccggtgctcgatttagtgtgagtagtttgggtttggggaggagtcagtctcagtcaggacacagcatggacatgagggtccccntcagctcctggggctcctgctactctggctccgaggtgccagatgtgacatccagatgacccagtctccatccctccctgtctgcatctgtagganacagagtcaaccatcacttgccggcaagtcagancattagcagcttaatttaaatgtatcagcagacgaccaagggaaacnccccctaaactcctagactctatgatgacataccaagtttggaaagtcggggtacccagtaccaaggttcaggttgctaggtggatcgtagggacagtatttcaactctacacctatcagtcagtctagcgtaactgaatattgactaacttactacg

SEQ ID NO: 310258 - DNA, 495 bp, Homo sapiens
  misc_feature: GZ8MTXP02JEIHE.51.78.H01.1.454.CMB.2.raw
  modified_base (348)..(348): a, c, t, g, unknown or other
  misc_feature (348)..(348): n is a, c, g, or t
  modified_base (361)..(361): a, c, t, g, unknown or other
  misc_feature (361)..(361): n is a, c, g, or t
  modified_base (452)..(452): a, c, t, g, unknown or other
  misc_feature (452)..(452): n is a, c, g, or t
  modified_base (477)..(477): a, c, t, g, unknown or other
  misc_feature (477)..(477): n is a, c, g, or t
tcagcgatcgtatacacgaccggtgctcgatttagtgtgagtagtttgggtttgggcacgaccggtgctcgatttagtgtgagtagtttgggtttgggcacgaccggtgctcgatttagtgtgagtagtttgggtttggggaggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccggcaagtcagagcattagcagcttatttaaatggtatcagcagngaccagggaaacncccctaactctgatctatgatgcatccaatttggaaagtgggaccatacaaggttcagtgcagtgatcgtgggacagattcactctcaccntcagcagtcgtgcgaactgaacgtntttgactaacttactaac

SEQ ID NO: 310259 - DNA, 542 bp, Homo sapiens
  misc_feature: GZ8MTXP02JV7CV.51.78.H01.1.454.CMB.2.raw
  modified_base (301)..(301): a, c, t, g, unknown or other
  misc_feature (301)..(301): n is a, c, g, or t
  modified_base (331)..(331): a, c, t, g, unknown or other
  misc_feature (331)..(331): n is a, c, g, or t
  modified_base (397)..(397): a, c, t, g, unknown or other
  misc_feature (397)..(397): n is a, c, g, or t
tcagcgatcgtatacacgaccggtgctcgatttagtgtgagtagtttgggtttggggggagaggagccccagccctgagattcccaggtgtttccattcagtgatcagcactgaacacagaggactcaccatggagttgggactgagctggattttcctttggctattttaaaaggtgtccagtgtgaagtgctactggtggagtcgtgggggagcctggtacagcctggcaggtccctgagactctcctgtgcagcctctggattcacctttgatgattatgccatgcacgtgggtccgnaagctccgaggggaggcctggagtgggtcncgacgttattaggtgaataggtggtagtatgcctatggcgatcgtgtgaagggcctatcaccatcncagagacaacgccaaagacctcctagtactcgtgacaaatcgaactagtctaggagagctggaagacacggtccttagtattacgtgacgaacgaaaacgcccgaaaggccaaacgacgtactcggtaactacgtaaattaacgg

SEQ ID NO: 310260 - DNA, 525 bp, Homo sapiens
  misc_feature: GZ8MTXP02H8NJJ.51.78.H01.1.454.CMB.2.raw
tcagcgatcgtatacacgaccggtgctcgatttagtgtgagtagtttgggtttggggggagaggagccccagccctgagattcccaggtgtttccattcagtgatcagcactgaacacagaggactcaccatggagttgggactgagctggattttcctttggctattttaaaaggtgtccagtgtgaagtgctactggtggagtcgtgggggaggcctggtacagcctggcaggtccctgagactctcctgtgcagcctctggattcactttgatgattatgccatgcacgtgggtccgcaagctccgaggggaggcctggagtgggtctcacgtatagtgaatagtgtagtatagcctatggcgactcgtgtggaagggccgattcacatctcagagacacgaccaagaactccctgtactctgacaaatgaacagtctgagagcgtgagacgacggtcttagtattacgtcgacgacaaaacgccaaaggcaaacgacgactacggtactactaagttaacg

SEQ ID NO: 310261 - DNA, 543 bp, Homo sapiens
  misc_feature: GZ8MTXP02G61FG.51.78.H01.1.454.CMB.2.raw
  modified_base (281)..(281): a, c, t, g, unknown or other
  misc_feature (281)..(281): n is a, c, g, or t
  modified_base (466)..(466): a, c, t, g, unknown or other
  misc_feature (466)..(466): n is a, c, g, or t
tcagcgatcgtatacacgaccggtgctcgatttagtgtgagtagtttgggtttggggaggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagcttaatttaaatggtatcagcagagaccgaagggaaacncccctaactcctgactctatgatgcatacctaagtttggaaagtcgggtacccagtcaaggttcagtggcagtggatcgtgggacagtactttacactctacaccatcgagcagtgtcgacgtactagtaagtattttcgactaactttactaactgtacaactagtacgttaaccacgtacccncaacgtccttacgtacgttcgggacggtacgggaaccaagggtagaagactaacgaaacgtacgtggtacgcgtacg

SEQ ID NO: 310262 - DNA, 541 bp, Homo sapiens
  misc_feature: GZ8MTXP02GM2B2.51.78.H01.1.454.CMB.2.raw
  modified_base (320)..(320): a, c, t, g, unknown or other
  misc_feature (320)..(320): n is a, c, g, or t
  modified_base (523)..(523): a, c, t, g, unknown or other
  misc_feature (523)..(523): n is a, c, g, or t
tcagcgatcgtatacacgaccggtgctcgatttagtgtgagtagtttgggtttgggcacgaccggtgctcgatttagtgtgagtagtttgggtttggggaggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctaatttaaatggtatcagcagagaccagggaaacncccctaactccctagactctatgatgctatccaaagtttgggaaagttcggggtacccaatacgtaaaggttcaaggtggacaggttgattcgtaggggacagtatttcactctacaccatcaagcagtcgtgcgtacctagaagtatttcgactaaactttactactgtacaaacgtagtaacgttaactacgtacccctanacgtctacgtacgttcgg

SEQ ID NO: 310263 - DNA, 747 bp, Homo sapiens
  misc_feature: GZ8MTXP02HRXNI.51.78.H01.1.454.CMB.2.raw
  modified_base (199)..(199): a, c, t, g, unknown or other
  misc_feature (199)..(199): n is a, c, g, or t
  modified_base (288)..(288): a, c, t, g, unknown or other
  misc_feature (288)..(288): n is a, c, g, or t
tcagcgatcgtatacacgaccggtgctcgatttagtgtgagtagtttgggtttggggaggagtcagtctcagtcaggacacagcatggacatgagggtccccgctcagctcctggggctcctgctactctggctccgaggtgccagatgtgacatccagatgacccagtctccatcctccctgtctgcatctgtagganacagagtcaccatcacttgccgggcaagtcagagcattagcagctatttaaattggtatcagcagagacaggaaacgcccctaactccngatctatgatgcatacctaagtttagggaaaacgttcggggtacccctagttacgaaacggtttcgaaggttgggcgtaggttacgggagttaccgttagggggaacctaagggttaacttttcctaaaccttcccttacccaaacccctaattacccgaaaggtcccgtaagggttcggttacggacccggtaacccgttagggttaaaaggttaatttttttacgggaacctttaaaaccgttttaaccgttaaacctttacggaaccctaaaaccgtaaaggttaaacggtttaacctaaacccggtttaaaccccccgttactaaccggttccctttaccgtaaacccgtttttccgggggaaccgggttaacgggggaaacccgtaaacgggggttaggaaacggtaacttaacggaaaaccggtaaaccggtttggaacggggtcctaaccgg

SEQ ID NO: 310264 - DNA, 531 bp, Homo sapiens
  misc_feature: GZ8MTXP02GAL5M.51.78.H01.1.454.CMB.2.raw
  modified_base (387)..(387): a, c, t, g, unknown or other
  misc_feature (387)..(387): n is a, c, g, or t
  modified_base (517)..(517): a, c, t, g, unknown or other
  misc_feature (517)..(517): n is a, c, g, or t
tcagcgatcgtatacacgaccggtgctcgatttagtgtgagtagtttgggtttgggcacgaccggtgctcgatttagtgtgagtagtttgggtttgggcacgaccggtgctcgatttagtgtgagtagtttgggtttggggaggagtcagtctcagtcaggacacagcatggacatgagggtccccgctcagctcctggggctcctgctactctggctccgagtgccagatgtgacatccagatgacccagtctccatcctcctgtctgcatctgtaggagacagagtcaccatcacttgccggcaagtcagagcattagcagtactatttaaatgtatcagacagacgaccaagggaaacaccccctaacctcctagaatctatanatcgacataccaaagtttggaaaagtcggggtacccatacgaaggttcagtgctagtaggaatcgtagggacaggtattacactctcaacattcaagctagtgtagacgtaacctggaaacttcgtttanactaacttactacg

SEQ ID NO: 310265 - DNA, 579 bp, Homo sapiens
  misc_feature: GZ8MTXP02G531P.51.78.H01.1.454.CMB.2.raw
  modified_base (307)..(307): a, c, t, g, unknown or other
  misc_feature (307)..(307): n is a, c, g, or t
  modified_base (364)..(364): a, c, t, g, unknown or other
  misc_feature (364)..(364): n is a, c, g, or t
tcagcgatcgtatacacgaccggtgctcgatttagtgtgagtagtttgggtttgggcacgaccggtgctcgatttagtgtgagtagtttgggtttgggcacgaccggtgctcgatttagtgtgagtagtttgggtttggggaggagtcagtctcagtcaggacacagcatggacatgagggtccccgctcagctcctggggctcctgctactctggctccgaggtgccagatgtgacatccagatgacccagtctccatccctccctgtctgcatctgtagagacagagtccacatcacttgccggnaagtcagagcattagcagtctaatttaaatgtatcagcagacgaccaaggggaaacnccccctaaactccgagacttactagtgaatgcaacttaccgtaaagtttcgggaaaaggttcggggtaccccagttaccgaaaggtttccaaggttcggactagggtgaacgtcgtagggtaacagtatttaccgaacttcctaccaacctatacgaagtctaggttcgtcgaccgtaacgtagaacttacgtttagacccttaactttactacg

SEQ ID NO: 310266 - DNA, 637 bp, Homo sapiens
  misc_feature: GZ8MTXP02HHEJC.51.78.H01.1.454.CMB.2.raw
  modified_base (405)..(405): a, c, t, g, unknown or other
  misc_feature (405)..(405): n is a, c, g, or t
  modified_base (418)..(418): a, c, t, g, unknown or other
  misc_feature (418)..(418): n is a, c, g, or t
tcagcgatcgtatacacgaccggtgctcgatttagtgtgagtagtttgggtttggggaggagtcagtctcagtcaggacacagcatggacatgagggtccccgctcagctcctggggctcctgctactctggctccgaggtgccagatgtgacatccagatgacccagtcctccatccctccctgtctgcatctggtaggagacagagtccaaccatcacgttcggccgggacaagtcagagctaagttagcagtacttaattttaaagttggtatcgagaccaagacgaccgaagggaaaccgtcccctaacctcctagacttctatgatcgactactacttaagttagggaacggtccgggtaccagtacgtaagttcagtggcaggtgattgaggacagttntcactctacaacntacagacagtgtacgaccgacgttaagtaacgtttagtttacaaccttaaacgtttactacgtacgttaaccaaaagtacggttaaactaaccgtaacccgtaaccccgtactacgtacccttaccgttacgggtttaccggggacggggaaacggttaaccggaagggtacggaaacgtaacgaaaccggtaaaacgtacgtcggtacggtactaccg

SEQ ID NO: 310267 - DNA, 534 bp, Homo sapiens
  misc_feature: GZ8MTXP02FKRB1.51.78.H01.1.454.CMB.2.raw
  modified_base (322)..(322): a, c, t, g, unknown or other
  misc_feature (322)..(322): n is a, c, g, or t
  modified_base (471)..(471): a, c, t, g, unknown or other
  misc_feature (471)..(471): n is a, c, g, or t
  modified_base (516)..(516): a, c, t, g, unknown or other
  misc_feature (516)..(516): n is a, c, g, or t
tcagcgatcgtatacacgaccggtgctcgatttagtgtgagtagtttgggtttgggcacgaccggtgctcgatttagtgtgagtagtttgggtttggggaggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctaatttaaattggtatcagcagagaccaagggaaacnccccctaactcccctgatctatgatgcatacctaagtttagggaaagttcgggggtacccagttaccgaaaggtttcaggttggcgtaaggtggatcgtagggacagtatttcactctacacatcagctagtgtcgacgactagaagtntttcgactaattactactcgtacaacagtacgtaacacgtacccncagcctacacgtttcggg

SEQ ID NO: 310268 - DNA, 492 bp, Homo sapiens
  misc_feature: GZ8MTXP02GNBYK.51.78.H01.1.454.CMB.2.raw
  modified_base (428)..(428): a, c, t, g, unknown or other
  misc_feature (428)..(428): n is a, c, g, or t
  modified_base (431)..(431): a, c, t, g, unknown or other
  misc_feature (431)..(431): n is a, c, g, or t
  modified_base (467)..(467): a, c, t, g, unknown or other
  misc_feature (467)..(467): n is a, c, g, or t
tcagcgatcgtatacacgaccggtgctcgattagtgtgagtagttggtttggaggagtcagtctcagtcaggacacagcatggacatgagggtcccgctcagctcctggggctcctgctactctggctccgaggtgccagatgtgacatccagatgacccagtctccatcctccctgtctgcatctgtaggagacagagtcaccatcacttgccgggcaagtcagagcattagcagctatttaaattggtatcagcagagaccagggaaagcccctaaactcctgatctatgatgcatccaatttggaaatggggtcccatcaagttcagtggcagtggatctgggacagatttcatctcacatcagcagtgtgcgacctgaaagattttgcaacttactaattgtcaaacagattacagtacccctnacnctctacgttcggtacggacggacgaaggaggaaganaacgaaacgaacgtacgtcgcgtcg

SEQ ID NO: 310269 - DNA, 577 bp, Homo sapiens
  misc_feature: GZ8MTXP02JSC2S.51.78.H01.1.454.CMB.2.raw
tcagcgatcgtatacacgaccggtgctcgatttagtgtgagtagtttgggtttgggggggagaggagccccagccctgagattcccaggtgtttccattcagtgatcagcactgaacacagaggactcaccatggagttgggactgagctggattttccttttggctattttaaaaggtgtccagtgtgaagtgctactggtggagtcgtgggggagcctggtacagcctggcaggtccctgagactctcctgtgcagcctctggattcacctttgatgattatgccatgcacgtgggtccgcaagctccgagggaggccgtggagtgggtctcgacgttattaggtggaataggtggtaagtatacggccttagtggacggtactcgtgtaggaacggggccgtattaccacctatcctaccgagaacgaacaaccgaccaaagaaccctcccgtagtactcgtacgaacaaagtacgaaacgtagtcgtagagagcgtagacggacacggtacttggtattcgagacgacaaacgaccgaaggaacaacgacgtctaggtactacgtaaagtacg

SEQ ID NO: 310270 - DNA, 543 bp, Homo sapiens
  misc_feature: GZ8MTXP02GEM8B.51.78.H01.1.454.CMB.2.raw
  modified_base (319)..(319): a, c, t, g, unknown or other
  misc_feature (319)..(319): n is a, c, g, or t
tcagcgatcgtatacacgaccggtgctcgatttagtgtgagtagtttgggtttgggcacgaccggtgctcgatttagtgtgagtagtttgggtttggggaggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctaatttaaatggtatcagcagagaccaggaaacncccctaactccctgatctatgaatgcatacctaaagtttagggaaagttcggggtaccccaagttaccgaaagggtttcaaggtggactaggttaggaatcgtaggggacagtatttacactctacaccatacagcagtgtgcgactagaagtatttcgactaaacttactactacgtacaaacagtacgtaacacgtacccctacacgctactacgtttcggg

SEQ ID NO: 310271 - DNA, 623 bp, Homo sapiens
  misc_feature: GZ8MTXP02JTN4O.51.78.H01.1.454.CMB.2.raw
tcagcgatcgtatacacgaccggtgctcgatttagtgtgagtagtttgggtttggggggagaggagccccagccctgagattcccaggtgtttccattcagtgatcagcactgaacacagaggactcaccatggagttgggactgagctggtattttccttttggcttattttaaaaggtgtccagtgtgaagtgctactggtggagtcgtgggggaggcctggtacagcctggcaggtccctgagactctcctgtgcagcctctggattcacctttgatgattatgccatgcacgtgggtccgcaacgcctacgaggggacggccgtgggagtcgggtctcgtacgttattaggttaggaattaggtaggttaagtatacggaccttagtcggccgggtactcgttagggtagggaaacggggcctaacttccaaccctattccctaccgaaggaacgaaccgaacccgaccaaacgtaacctcccgtagtaactcgtagacaaagtgaacagtctaggagacgtcgaggacgacgaaccgggtctttacggtacttacgcggaacgaaacgaaaacgccgaaaggaaccaaacgacgtccgtaggtacctacgaaattacg

SEQ ID NO: 310272 - DNA, 522 bp, Homo sapiens
  misc_feature: GZ8MTXP02ICOYV.51.78.H01.1.454.CMB.2.raw
  modified_base (319)..(319): a, c, t, g, unknown or other
  misc_feature (319)..(319): n is a, c, g, or t
tcagcgatcgtatacacgaccggtgctcgatttagtgtgagtagtttgggtttgggcacgaccggtgctcgatttagtgtgagtagtttgggtttggggaggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctatttaaattggtatcagcagagaccagggaacncccctaactcccctgatctatgatgcatccaaagtttggaaagtgggggtacccatcaaaggttcagtgcagtgatctgggacagatttcactctcaccattcagcagtgtgcgtaccttagtaagtagttttacgactaaactttactactcgttacgaaactagagttaacacgtacccctcaacgtctctaactttcggg

SEQ ID NO: 310273 - DNA, 576 bp, Homo sapiens
  misc_feature: GZ8MTXP02JEB43.51.78.H01.1.454.CMB.2.raw
  modified_base (323)..(323): a, c, t, g, unknown or other
  misc_feature (323)..(323): n is a, c, g, or t
  modified_base (497)..(497): a, c, t, g, unknown or other
  misc_feature (497)..(497): n is a, c, g, or t
tcagcgatcgtatacacgaccggtgctcgatttagtgtgagtagtttgggtttgggcacgaccggtgctcgatttagtgtgagtagtttgggtttggggaggagtcagtctcagtcaggacacagcatggacatgagggtccccgctcagctcctggggctcctgctactctggctccgaggtgccagatgtgacatccagatgacccagtctccactcctcctgtctgcatctgtagagacagagtcacatcactgccggcaagtcagagcattagcagtacttatttaattggtatcagcagacgaaccgaagggaaaccncccctaacctcctagactactatgatgctataccttaaagttaggaaacggtcggggtaccagtacgaacggtttcaggtggactaggtagtactcgtacgggaactagtactttaccgaacttcctaccactactcaaacgtccgagttgcggacctaaccgtagtaaagttntttacgacttaaactttactacgtcgtaccaaacgtgtacttaacaccgtacccctagactctacctacgtttccgggg

SEQ ID NO: 310274 - DNA, 587 bp, Homo sapiens
  misc_feature: GZ8MTXP02IW5G4.51.78.H01.1.454.CMB.2.raw
  modified_base (283)..(283): a, c, t, g, unknown or other
  misc_feature (283)..(283): n is a, c, g, or t
  modified_base (305)..(305): a, c, t, g, unknown or other
  misc_feature (305)..(305): n is a, c, g, or t
tcagcgatcgtatacacgaccggtgctcgatttagtgtgagtagtttgggtttggggaggagtcagtctcagtcaggacacagcatggacatgagggtccccgctcagctcctggggctcctgctactctggctccgaggtgccagatgtgacatccagatgacccagtctccatcctccctgtctgcatctgtaggagacagatcaccatcacttggccgggcaagtcagagcattagcagcttaatttaaattggtatcagcagagaccgaagggaaaccncccctaacctcctagactctancttgactagtccaatttcgaaatttggggaaccctaggggttcccaagttcaagttcgacgtggtcggagtcgtaggtactagggacttacgactttactactacctactacccaagtccagcgtagtcgtacgtcggaaccgtactttaaggactttacgactaacttacttactacgtacaacgtacaagttacctactacccgtctacgacttacgtaccgttacgggacggacgggtacggaacggaacgtacgaacgactaacgtacgtacgtgacg

SEQ ID NO: 310275 - DNA, 590 bp, Homo sapiens
  misc_feature: GZ8MTXP02HECEJ.51.78.H01.1.454.CMB.2.raw
tcagcgatcgtatacacgaccggtgctcgatttagtgtgagtagtttgggtttggggggagaggagccccagccctgagattcccaggtgtttccattcagtgatcagcactgaacacagaggactcaccatggagttgggactgagctggtattttccttttggctattttaaaaggtgtccagtgtgaagtgctactggtggagtcgtgggggaggcctggtacagcctggcaggtccctgagactctcctgtgcagcctctggattcacctttgatgattatgccatgcacgtgggtccgcaagctccgagggaggcctggagtgggtctcacgtattaggttggaataggtggtatatagcctagtggcggtactcgtggtgaacggggcctattccaccatctaccgagacgacaacgaccaaagtaacctccctagtactctagacaaatcgaaacagtcagacgagctaggacggacacgggtccttaggtactttacgacggacgaaccgaaaaacggccccgaaaagggaaccaaaacgacggtacgttaacgggtaacctaccggtaaaatttaaaccgg

SEQ ID NO: 310276 - DNA, 536 bp, Homo sapiens
  misc_feature: GZ8MTXP02JXIC1.51.78.H01.1.454.CMB.2.raw
  modified_base (309)..(309): a, c, t, g, unknown or other
  misc_feature (309)..(309): n is a, c, g, or t
  modified_base (318)..(318): a, c, t, g, unknown or other
  misc_feature (318)..(318): n is a, c, g, or t
  modified_base (368)..(368): a, c, t, g, unknown or other
  misc_feature (368)..(368): n is a, c, g, or t
tcagcgatcgtatacacgaccggtgctcgatttagtgtgagtagtttgggtttgggcacgaccggtgctcgatttagtgtgagtagtttgggtttgggcacgaccggtgctcgatttagtgtgagtagtttgggtttggggaggagtcagtctcagtcaggacacagcatggacatgagggtccccgctcagctcctggggctcctgctactctggctccgaggtgccagatgtgacatccagatgacccagtctccatccctccctgtctgccatctgtaggagacagagtcaccatcacttgccggnaagtcagancattagcagcttaatttaaatggtatcagcagagaccgaaggggaaaccnccccctaaacctcctagactctatgatgcatcctaatttagggaaaggttcggggtacccatacgtaaaggttcaggtgacaggtaggatcgtagggacagtacttcactctacaccatacagacagtgtcgccgaaccgtagaacgtatttcgactaacttactacg

SEQ ID NO: 310277 - DNA, 675 bp, Homo sapiens
  misc_feature: GZ8MTXP02GOCPW.51.78.H01.1.454.CMB.2.raw
  modified_base (241)..(241): a, c, t, g, unknown or other
  misc_feature (241)..(241): n is a, c, g, or t
  modified_base (317)..(317): a, c, t, g, unknown or other
  misc_feature (317)..(317): n is a, c, g, or t
tcagcgatcgtatacacgaccggtgctcgatttagtgtgagtagtttgggtttgggcacgaccggtgctcgatttagtgtgagtagtttgggtttggggaggagtcagtctcagtcaggacacagcatggacatgagggtccccgctcagctcctggggctcctgctactctggctccgaggtgccagatgtgacatccagatgacccagtctccatcctccctgtctgcatctgtagganacagagtcaccatcacttgccgggcaagtcagagcattagcagctatttaaatggtatcagcagagaccaggaacncccctaactccctgatctatgatgctatacctaaagtttggggaaaacgttcgggggtacccctaagttaccgtaaagggtttccaaggttcgggactaagggtcggaagttccgttagggggaacctaaggtactttaccgaaccttcctaccaacctaactccaaaggtcctaagggttggtacggtaccggtacccgttagggtaaaacggttttacttttaacggtaaccctttaaacgtttaacccgttaaccgttacgtaaaccgtaaaacgtaacggttaaccgtttaaaccgtaacccgttaacccccgttacgtaacgtacccgtttaccgttacccgggtttacgggg

SEQ ID NO: 310278 - DNA, 606 bp, Homo sapiens
  misc_feature: GZ8MTXP02GHRJ6.51.78.H01.1.454.CMB.2.raw
  modified_base (254)..(254): a, c, t, g, unknown or other
  misc_feature (254)..(254): n is a, c, g, or t
  modified_base (261)..(261): a, c, t, g, unknown or other
  misc_feature (261)..(261): n is a, c, g, or t
  modified_base (281)..(281): a, c, t, g, unknown or other
  misc_feature (281)..(281): n is a, c, g, or t
  modified_base (301)..(301): a, c, t, g, unknown or other
  misc_feature (301)..(301): n is a, c, g, or t
tcagcgatcgtatacacgaccggtgctcgatttagtgtgagtagtttgggtttggggggagaggagccccagccctgagattcccaggtgtttccattcagtgatcagcactgaacacagaggactcaccatggagttgggactgagctggattttccttttggctattttaaaaggtgtccagtgtgaagtgctactggtggagtcgtgggggagcctggtacagcctggcaggtccctgagactctcctgtncagcctnggattcactttgatgattancgcatgcacgtgggtccganagctcgagggaggcctgggagtgggtctcgacgttataggtggaatggtgtatatacgcctagtcgcgtactcgtgtagaacggggcctaattccgactatccgtaccgaagacgaacaaccgaccaaaggaacctccctgtaactccgttagactaaaagtcgaaacgtagtaccgtaggaacgaggtccgtaaggaacgggaccgtaaccgggtccttttaaggtactttaaccggaggaccgtaacgaaaacgcccgaaaggaaccaaaccgagttccgtaggtaacctactaaagttaacg

SEQ ID NO: 310279 - DNA, 546 bp, Homo sapiens
  misc_feature: GZ8MTXP02I89AH.51.78.H01.1.454.CMB.2.raw
  modified_base (309)..(309): a, c, t, g, unknown or other
  misc_feature (309)..(309): n is a, c, g, or t
  modified_base (317)..(317): a, c, t, g, unknown or other
  misc_feature (317)..(317): n is a, c, g, or t
  modified_base (350)..(350): a, c, t, g, unknown or other
  misc_feature (350)..(350): n is a, c, g, or t
  modified_base (365)..(365): a, c, t, g, unknown or other
  misc_feature (365)..(365): n is a, c, g, or t
  modified_base (470)..(470): a, c, t, g, unknown or other
  misc_feature (470)..(470): n is a, c, g, or t
tcagcgatcgtatacacgaccggtgctcgatttagtgtgagtagtttgggtttgggcacgaccggtgctcgatttagtgtgagtagtttgggtttgggcacgaccggtgctcgatttagtgtgagtagtttgggtttggggaggagtcagtctcagtcaggacacagcatggacatgagggtccccgctcagctcctggggctcctgctactctggctccgaggtgccagatgtgacatccagatcgacccagtctccatcctccctgtctgcatctgtaggagacagagtcaccatcacttcgccggnaagtcagngcattagcagtctaatttaaatgtatcagcagngaaccaggggaaacnccccctaacgtctagattactatcgatgctaagtccaaagtttcggaaagtcgggtacccagttacgaaggttcagttggacaggtagactcgtagggactagtnttacgactctaccgacatcaagtcagttacgtcgaaccgtaacgtgaaacgttctttacgacctaacgttactacg

SEQ ID NO: 310280 - DNA, 516 bp, Homo sapiens
  misc_feature: GZ8MTXP02FOSPE.51.78.H01.1.454.CMB.2.raw
  modified_base (458)..(458): a, c, t, g, unknown or other
  misc_feature (458)..(458): n is a, c, g, or t
tcagcgatcgtatacacgaccggtgctcgatttagtgtgagtagtttgggtttggggaggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctatttaaattggtatcagcagagaccagggaaacgcccctaacctcctgatctatgatgcataccaagtttagggaaagtcggggtacccatcaaggttcaggttgcagtggatcgtagggacagtattcactctacacatcagcagtgtgcgacctagaattattttgacttaacttactactacgtacaacagtaacgttacacgtacccctnacgctctacgttcggacggacgggaccaggtggaagagtacaacgactggacgctacg

SEQ ID NO: 310281 - DNA, 588 bp, Homo sapiens
  misc_feature: GZ8MTXP02JMXKP.51.78.H01.1.454.CMB.2.raw
  modified_base (318)..(318): a, c, t, g, unknown or other
  misc_feature (318)..(318): n is a, c, g, or t
tcagcgatcgtatacacgaccggtgctcgatttagtgtgagtagtttgggtttgggcacgaccggtgctcgatttagtgtgagtagtttgggtttgggcacgaccggtgctcgatttagtgtgagtagtttgggtttggggaggagtcagtctcagtcaggacacagcatggacatgagggtccccgctcagctcctggggctcctgctactctggctccgaggtcgccagatgtgacatccagatgacccagtctccatccctcctgtctgcatctgtaggagacagagtcacatcacttggccggacaagtcaganctatacgcagtcttaatttaaatgtactcgagcgaagacgaacgaacgggaaacctcccccgtaaactcgtagacttactatgatcgactaacttccgtaaaaggtttcggaaaacgggttcggggtaccctaagttacgtaaacggtttcaaggtcgacgtaggtcggatcggtagggactagtacttacacttctaccaacttagtaccgagtctagtacgtccgacgtaacgtagtaaacgttctttacaactttaacttactaacg

SEQ ID NO: 310282 - DNA, 557 bp, Homo sapiens
  misc_feature: GZ8MTXP02H7170.51.78.H01.1.454.CMB.2.raw
  modified_base (471)..(471): a, c, t, g, unknown or other
  misc_feature (471)..(471): n is a, c, g, or t
tcagcgatcgtatacacgaccggtgctcgatttagtgtgagtagtttgggtttgggggagaggagccccagccctgagattcccaggtgtttccattcagtgatcagcactgaacacagaggactcaccatggagttgggactgagctggtattttccttttggcttaattttaaaaggtgtccagtgtgaagtgctactggtggagtcgtgggggaggcctggtacagcctggcaggtccctgagactctcctgtgcagcctctggattcacctttgatgattatgccatgcacgtggggtcccgcaagctaccgaggggacgggcctggagtgggtctcgacgttattaggtgaataggtgtagtatagcttatgcggtactcgtgtagaacgggcctattccaaccatcctaccgaagacgaaccaacgaccaaataacctccctagtactctagactaaatgaaacngtctagagagctagacgacacggtcttagtatactggacaacgaaaacgaccaaggaaccaacgagctaggtactactaaagtacg

SEQ ID NO: 310283 - DNA, 502 bp, Homo sapiens
  misc_feature: GZ8MTXP02GABSV.51.78.H01.1.454.CMB.2.raw
  modified_base (393)..(393): a, c, t, g, unknown or other
  misc_feature (393)..(393): n is a, c, g, or t
tcagcgatcgtatacacgaccggtgctcgatttagtgtgagtagtttgggtttggggaggagtcagtctcagtcaggacacagcatggacatgagtgtccccgctcagctcctggggctcctgctactctggctccgaggtgccagatgtgacatccagatgacccagtctccatcctccctgtctgcatctgtaggagacagagtcaccatcacttgccggcaagtcagagcattagcagctatttaaatggtatcagcagagaccagggaaacgcccctaactcctgatctatgatgcatcaattgaaagtcggggtccatcaaggttcagtggcagtggatcgtgggacagatttcactctacaccatcagcagtgtgcgacctgaagtntttgactaacttactactgtacaacagagttacacgttaccctcacgtctcgtacgtttcggacggacgggaccaaggtgaacgaactacgaaacgtaacgtgtacggc

SEQ ID NO: 310284 - DNA, 644 bp, Homo sapiens
  misc_feature: GZ8MTXP02F5NP0.51.78.H01.1.454.CMB.2.raw
  modified_base (231)..(231): a, c, t, g, unknown or other
  misc_feature (231)..(231): n is a, c, g, or t
  modified_base (308)..(308): a, c, t, g, unknown or other
  misc_feature (308)..(308): n is a, c, g, or t
tcagcgatcgtatacacgaccggtgctcgatttagtgtgagtagtttgggtttgggggctctgggagaggagccccagccctgagattcccaggtgtttccattcagtgatcagcactgaacacagaggactcaccatggagttgggactgagctggattttccttttggctattttaaaaggtgtccagtgtgaagtgctactggtggagtcgtgggggagcctggtacngcctggcaggtccctgagactctcctgtgcagcctctggattcacctttgatgattatgccatgcacgtgggcccgnaacgctaccgaggggacgggcctgggaggtgggtctcgacgttagttagtggaataggtggtagtatcggaccttagtacggccggtacttcgtaggtacgggaaacggggcctaagtttcccaacctacttcccgtacccgaaggaacgaaacccgaaaccgacccgtaaaagtaaaccccttccccgttaggtaacttctacggaacctaaaagtacgaaacgtagtaccgtaggacgaagtcgtaggacggtaaccgtcggtccgtttagtaactttacgacgaccgaaacgaaaaccgaccgaaaggacaaacgtagaccgtaggttaaacc

SEQ ID NO: 310285 - DNA, 613 bp, Homo sapiens
  misc_feature: GZ8MTXP02JT0OX.51.78.H01.1.454.CMB.2.raw
  modified_base (319)..(319): a, c, t, g, unknown or other
  misc_feature (319)..(319): n is a, c, g, or t
  modified_base (551)..(551): a, c, t, g, unknown or other
  misc_feature (551)..(551): n is a, c, g, or t
  modified_base (597)..(597): a, c, t, g, unknown or other
  misc_feature (597)..(597): n is a, c, g, or t
tcagcgatcgtatacacgaccggtgctcgatttagtgtgagtagtttgggtttgggcacgaccggtgctcgatttagtgtgagtagtttgggtttgggcacgaccggtgctcgatttagtgtgagtagtttgggtttggggaggagtcagtctcagtcaggacacagcatggacatgagggtccccgctcagctccgtggggctcctgctactctggctccgaggtgccagatgtgacatccagatcgacccagtcctccactcctccctgtctgcatctgtaggagacagacgtcaccatcctacttcggcccggganaaggtcaaggacgactaagttaacgacctaaggtacctttaaagttttaaaacgttggtaaactcgacgacgaaggacgaaaccgaaagggggaaacctacccccgtaaactccgtagaacttctagtgactcgactagtacctagttacggaaaggtcgggtacctagtacgaagttccgaggtcgactaggtgacttcggagggaactgtaacttcgacttctacacctntaccgagccgtagtcggtacgacgtaacgtagtaacgtcgtttacncttaaacgtcttaacg

SEQ ID NO: 310286 - DNA, 636 bp, Homo sapiens
  misc_feature: GZ8MTXP02GDJI7.51.78.H01.1.454.CMB.2.raw
  modified_base (284)..(284): a, c, t, g, unknown or other
  misc_feature (284)..(284): n is a, c, g, or t
  modified_base (307)..(307): a, c, t, g, unknown or other
  misc_feature (307)..(307): n is a, c, g, or t
  modified_base (315)..(315): a, c, t, g, unknown or other
  misc_feature (315)..(315): n is a, c, g, or t
tcagcgatcgtatacacgaccggtgctcgatttagtgtgagtagtttgggtttgggcacgaccggtgctcgatttagtgtgagtagtttgggtttgggcacgaccggtgctcgatttagtgtgagtagtttgggtttggggaggagtcagtctcagtcaggacacagcatggacatgagggtccccgctcagctcctggggctcctgctactctggctccgaggtgccagatgtgacatccagatgacccagtctccatccctccctgtctgcatctgtagganacagagtcacatcacttgccggnaagtcagngctatagcagcttaatttaacgtggtatacgagctaagcgtaaccgaaggggaaactcccccgtaaaaccttcctagtaacttactaagttacgtaagtcgacctaacgttacccgtaaagttttaacggggaaaacggttcgggggttacccctaagttaccgtaaacgggtttccgtaaggtcggtaccgtagggtacgtacgttacggtaggtactaacggtactttcgaacttctacacctataccgtagaccgtaagtcgtacgaccgtaacgtaacgtaagttactttacggaaccttaaccgttacgttaaccg

SEQ ID NO: 310287 - DNA, 600 bp, Homo sapiens
  misc_feature: GZ8MTXP02JQXXA.51.78.H01.1.454.CMB.2.raw
  modified_base (347)..(347): a, c, t, g, unknown or other
  misc_feature (347)..(347): n is a, c, g, or t
  modified_base (465)..(465): a, c, t, g, unknown or other
  misc_feature (465)..(465): n is a, c, g, or t
tcagcgatcgtatacacgaccggtgctcgatttagtgtgagtagtttgggtttgggcacgaccggtgctcgatttagtgtgagtagtttgggtttggggaggagtcagtctcagtcaggacacagcatggacatgagggtccccgctcagctcctggggctcctgctactctggctccgaggtgccagatgtgacatccagatgacccagtctccatccctccctgtctgcatctgtaggagacagagtcaccatcacttcggccgggacaagtcagagctatagcagtacttaatttaaatgtatcagacagaacgaccgaaagggaaccacccctaactccctanactctaatgatcgctataccgtaaagtttacgggaaaggttcgggtaccctagtacgtaaggttcaggtggctaaggtgagtcgtagggaacagtacttcactctacacatcgagtanaggtcgtacgaccgtaacgtaagtaacgttacgtttacaacttaaactttacgtaacgttacgtaacctaaacgtaacgtaacgtaaccgtaaccgtaccctacgtacgtaccttaaccggtacgtttaccgggg

SEQ ID NO: 310288 - DNA, 566 bp, Homo sapiens
  misc_feature: GZ8MTXP02G00OW.51.78.H01.1.454.CMB.2.raw
  modified_base (372)..(372): a, c, t, g, unknown or other
  misc_feature (372)..(372): n is a, c, g, or t
  modified_base (422)..(422): a, c, t, g, unknown or other
  misc_feature (422)..(422): n is a, c, g, or t
tcagcgatcgtatacacgaccggtgctcgatttagtgtgagtagtttgggtttggggaggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagcttaatttaaatggtatcagcagagaccgaggaaacgcccctaaccgtcctgatctatgatgacatacctaagtttaggaaaggtccggggtaccccagtacgaaggtttcaggtggcaggtggaatcgnggggacagtacttcactctcacctatccagcagtgtgacactagaagttntttagactaaactttactactcgtaacaacgtagtacgttacaccgttacccactacgtcctctacggtttacgggacgggttacggaaaccgtaagggtacggaagtacgtaacgaaaacgtacgtacggtacggtactaccg

SEQ ID NO: 310289 - DNA, 523 bp, Homo sapiens
  misc_feature: GZ8MTXP02HM8IE.51.78.H01.1.454.CMB.2.raw
  modified_base (406)..(406): a, c, t, g, unknown or other
  misc_feature (406)..(406): n is a, c, g, or t
  modified_base (446)..(446): a, c, t, g, unknown or other
  misc_feature (446)..(446): n is a, c, g, or t
tcagcgatcgtatacacgaccggtgctcgatttagtgtgagtagtttgggtttggggaggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctatttaaatggtatcagcagagaccagggaaacgcccctaaacctcctgatctatgatgcatacctaatttggaaagtcggggtacccagtcaaggttcagttgcagtggatcgtggacagtattcactctcacatcagcagtgtgcgactgaatagggtttnactaacttactactgtacaacagtagttacacgtaccctnacgtctctacgtttcggcggtacggaccgtaagggtcgaagtacgtaacgaaaacgtaacgtcggtacggtactacg

SEQ ID NO: 310290 - DNA, 562 bp, Homo sapiens
  misc_feature: GZ8MTXP02F5LTS.51.78.H01.1.454.CMB.2.raw
  modified_base (199)..(199): a, c, t, g, unknown or other
  misc_feature (199)..(199): n is a, c, g, or t
  modified_base (276)..(276): a, c, t, g, unknown or other
  misc_feature (276)..(276): n is a, c, g, or t
tcagcgatcgtatacacgaccggtgctcgatttagtgtgagtagtttgggtttggggaggagtcagtctcagtcaggacacagcatggacatgagggtccccgctcagctcctggggctcctgctactctggctccgaggtgccagatgtgacatccagatgacccagtctccatcctccttgtctgcatctgtagganacagagtcaccatcacttgccgggcaagtcagagcattagcagctaattaaattggtatcagcagagacaggaaacncccctaactcctagatctatgatgcatacctaaagtttaggaaaggtcggggtacccagtactaaaggttcgaagtcggcaaggtggaatcgtaggggaactagtaactttcactcctacaaccatcaagctagtgtagaccgacctagaaagttattttacgacttaaacttactactacgtacaaacagtaacgttaaccaacgtacccctacaacgtcctacgtacgtttcggacggacgggaaccgaagggtcgaagactacgaaaacgactggacgctacg

SEQ ID NO: 310291 - DNA, 558 bp, Homo sapiens
  misc_feature: GZ8MTXP02JAE9B.51.78.H01.1.454.CMB.2.raw
  modified_base (283)..(283): a, c, t, g, unknown or other
  misc_feature (283)..(283): n is a, c, g, or t
  modified_base (307)..(307): a, c, t, g, unknown or other
  misc_feature (307)..(307): n is a, c, g, or t
  modified_base (344)..(344): a, c, t, g, unknown or other
  misc_feature (344)..(344): n is a, c, g, or t
  modified_base (358)..(358): a, c, t, g, unknown or other
  misc_feature (358)..(358): n is a, c, g, or t
tcagcgatcgtatacacgaccggtgctcgatttagtgtgagtagtttgggtttgggcacgaccggtgctcgatttagtgtgagtagtttgggtttgggcacgaccggtgctcgatttagtgtgagtagtttgggtttggggaggagtcagtctcagtcaggacacagcatggacatgagggtccccgctcagctcctggggctcctgctactctggctccgaggtgccagatgtgacatccagatgacccagtctccatcctccctgtctgcatctgtagganacagagtcaccatcacttgccggnaagtcagagcatagcagctaattaaatgatcagcagngaccaagggaaacncccctaaactcctagatctatgatgacatacctaaagtttaggaaagttcggggtacccaagttacaaaggttcaaggtggtacaggtagaagttcgtagggactagtatttacacttctacacctataccagactagtagtacgaccggtaacctaggtaaacgttacgttttacgaccttaaaactttacgttaaccg

SEQ ID NO: 310292 - DNA, 606 bp, Homo sapiens
  misc_feature: GZ8MTXP02JTRL9.51.78.H01.1.454.CMB.2.raw
  modified_base (288)..(288): a, c, t, g, unknown or other
  misc_feature (288)..(288): n is a, c, g, or t
  modified_base (519)..(519): a, c, t, g, unknown or other
  misc_feature (519)..(519): n is a, c, g, or t
tcagcgatcgtatacacgaccggtgctcgatttagtgtgagtagtttggggtttggggggagtcagtctcagtcaggacacagcatggacatgagggtccccgctcagctcctggggctcctgctactctggctccgaggtgccagatgtgacatccagatgacccagtctccatccctccctgtctgcatctgtaggagacagagtccaccatcacttggccgggcaagtcagagcattagcagtacttaatttaaattggtatcgagcaagagaccgaagggaacnccccctaactcctgactctatgatgacatcctaaagtttaggaaacggtcggggtacccccagtacgaaggttcgaggtggactaggtggacttcggaggggactaggtactttcacttctaccacctatcgagctaggtcgtcgaccgtacgttagtaaagttacttttacggaacttaaaccgttactacgttacgtacaaacgtacgtacgttaccaccgttaccctnacgtctacgtacggttcgggacggtaacgggaccgtagggtacgaagtaacgtacgaaaacgtacggtggtacggtactacgtaacc

SEQ ID NO: 310293 - DNA, 611 bp, Homo sapiens
  misc_feature: GZ8MTXP02GH8X3.51.78.H01.1.454.CMB.2.raw
  modified_base (239)..(239): a, c, t, g, unknown or other
  misc_feature (239)..(239): n is a, c, g, or t
  modified_base (320)..(320): a, c, t, g, unknown or other
  misc_feature (320)..(320): n is a, c, g, or t
  modified_base (330)..(330): a, c, t, g, unknown or other
  misc_feature (330)..(330): n is a, c, g, or t
  modified_base (340)..(340): a, c, t, g, unknown or other
  misc_feature (340)..(340): n is a, c, g, or t
tcagcgatcgtatacacgaccggtgctcgatttagtgtgagtagtttgggtttgggcacgaccggtgctcgatttagtgtgagtagtttgggtttgggcacgaccggtgctcgatttagtgtgagtagtttgggtttggggaggagtcagtctcagtcaggacacagcatggacatgagggtccccgctcagctccgtggggctcctgctactctggctccgaggtgccagatgtgacntccagatcgacccagtcctccatccctccctgtctgctatctggtaggagacagagtccaaccatcctacttggcccgganaaggtcaganctaatacganaacgtacttaatttaaactgtaatcagcaagacgtaccgaaaggggaaacctacccccttaaacgtccgtagtattaccgtaagtagacgtacgactaacgttaaccgtaaggtttagggaaaacgggttcgggaaccctaggttacctaaaggttcaagggtggactagggtgaactcggtacgggaactagttacgttaccactctacacctatccgaaagctagtacgcgtacgaactaggtaacttacttcgactaacgttactacg

SEQ ID NO: 310294 - DNA, 556 bp, Homo sapiens
  misc_feature: GZ8MTXP02JYOJZ.51.78.H01.1.454.CMB.2.raw
tcagcgatcgtatacacgaccggtgctcgatttagtgtgagtagtttgggtttgggcacgaccggtgctcgatttagtgtgagtagtttgggtttgggcacgaccggtgctcgatttagtgtgagtagtttgggtttggggaggagtcagtctcagtcaggacacagcatggacatgagggtcccgctcagctcctggggctcctgctactctggctccgaggtgccagatgtgacatccagatgacccagtctccatcctccctgtctgcatctgtaggagacagagtcaccatcacttggccggacaaggtcagacgcattagcagcttaattaaatggtatcagacagacgaccgaaggggaaactcccctaaacgtcctgactctaatgatgacagtacctaaagtttacgggaaagtcggggtaccctagtactaaaggttcaaggttcgggcaggttgaacttccgtagggacagtactttcaactcctacacccatcgagcgacgtacgacgacgtaacgtacgtacgtacttacgtactactactacg

SEQ ID NO: 310295 - DNA, 545 bp, Homo sapiens
  misc_feature: GZ8MTXP02GNB9G.51.78.H01.1.454.CMB.2.raw
  modified_base (199)..(199): a, c, t, g, unknown or other
  misc_feature (199)..(199): n is a, c, g, or t
tcagcgatcgtatacacgaccggtgctcgatttagtgtgagtagtttgggtttggggaggagtcagtctcagtcaggacacagcatggacatgagggtccccgctcagctcctggggctcctgctactctggctccgaggtgccagatgtgacatccagatgacccagtctccatcctccctgtctgcatctgtagganacagagtcaccatcacttgccgggcaagtcagagcatagcagctattaaatggtatcagcagagaccagggaaacgcccctaactcctgatctatgatgcataccaagtttaggaaagtcggggtacccatacgaaaggttcaaggttggcgagtggagtcgtggggaacagtatttcactctacaccatcagcagtgtgcgactagaagtatttgactaacttactactagtacaacagtaacgttacaacgtacccctgtactctacctacgtttcgggacgggacggtaaccgaagggtacggaagtaaacgtacgaaaaacgtacgtaggtacggactaccg

SEQ ID NO: 310296 - DNA, 592 bp, Homo sapiens
  misc_feature: GZ8MTXP02HAQ66.51.78.H01.1.454.CMB.2.raw
  modified_base (199)..(199): a, c, t, g, unknown or other
  misc_feature (199)..(199): n is a, c, g, or t
  modified_base (276)..(276): a, c, t, g, unknown or other
  misc_feature (276)..(276): n is a, c, g, or t
  modified_base (294)..(294): a, c, t, g, unknown or other
  misc_feature (294)..(294): n is a, c, g, or t
tcagcgatcgtatacacgaccggtgctcgatttagtgtgagtagtttgggtttggggaggagtcagtctcagtcaggacacagcatggacatgagggtccccgctcagctcctggggctcctgctactctggctccgaggtgccagatgtgacatccagatgacccagtctccatcctccctgtctgcatctgtagganacagagtcaccatcacttgccgggcaagtcagagcattagcagctaatttaaatgtatcagcagagaccagggaacnccctaacctctgatctangatgcatacctaaagtttaggaaagtccgggtacccatcgaaggttcaggtgcaggtgatcgtagggactagtacttcacttctcaaccgtatccgaagtcgaacggttgtacggaccgtaactaggaaacggtttacttttacgacttaaacctttacgtacttagtaaccaacgtagtaacgttaccgaccgtacccctacgacgttcccgtacgttaccggttcggggacgggtaacgggaacccgtaaggggtaacgaagaacttaacggaaaacgtaagtcggtacggctacg

SEQ ID NO: 310297 - DNA, 589 bp, Homo sapiens
  misc_feature: GZ8MTXP02HHP1C.51.78.H01.1.454.CMB.2.raw
  modified_base (334)..(334): a, c, t, g, unknown or other
  misc_feature (334)..(334): n is a, c, g, or t
  modified_base (348)..(348): a, c, t, g, unknown or other
  misc_feature (348)..(348): n is a, c, g, or t
tcagcgatcgtatacacgaccggtgctcgatttagtgtgagtagtttgggtttgggcacgaccggtgctcgatttagtgtgagtagtttgggtttggggaggagtcagtctcagtcaggacacagcatggacatgagggtccccgctcagctcctggggctcctgctactctggctccgaggtgccagatgtgacatccagatgacccagtcctccatccctccctgtctgcatctggtaggagacagagtcaccatcacttggccgggacaaagtcaagagcattagcagtcttaatttaaagtgtatcagacaggagaccgaagggaaaccncccctaactcccgngactctatgatgctactactaaagtttacgggaaaggtcgggtaccctaagtacgtaaaggttacagtggactaaggtggactcggtaggaaccagttaacttcaactctacaccatccaagctaggtcgtcgacgtaactgtaactactttcaacttaacttacgtacgtttacgaacgaaacctaggtaactaaccgtaaaccttacccccgtactacgtcctacgttaccggtacggg

SEQ ID NO: 310298 - DNA, 568 bp, Homo sapiens
  misc_feature: GZ8MTXP02GZIEN.51.78.H01.1.454.CMB.2.raw
  modified_base (223)..(223): a, c, t, g, unknown or other
  misc_feature (223)..(223): n is a, c, g, or t
  modified_base (281)..(281): a, c, t, g, unknown or other
  misc_feature (281)..(281): n is a, c, g, or t
  modified_base (427)..(427): a, c, t, g, unknown or other
  misc_feature (427)..(427): n is a, c, g, or t
  modified_base (474)..(474): a, c, t, g, unknown or other
  misc_feature (474)..(474): n is a, c, g, or t
tcagcgatcgtatacacgaccggtgctcgatttagtgtgagtagtttgggtttggggaggagtcagtctcagtcaggacacagcatggacatgagggtccccgctcagctcctggggctcctgctactctggctccgaggtgccagatgtgacatccagatcgacccagtctccatcctccctgtctgcatctgtaggagacagagtcacatcacttgccggnaagtcagagcattagcagtacttaatttaaatggtatcagcagagaccgagggaaacncccctaacctcctagatctatgatgactactacctaagtttaggaaagtccggggtacccagtacgaaggttcaggtcggcgtaggtggacttacgtggggactagtactttcactctacacatcagcagtgtagcacgtagattntttagctaattactatagtaccaagtaagacttaacaccgttacccntaacgtctacgtaccgtttacggggacggtaacgggaccgtaagggtaggaacgtaacgtaaaccgaaaacggtaccgttaggtcgacgtaacg

SEQ ID NO: 310299 - DNA, 556 bp, Homo sapiens
  misc_feature: GZ8MTXP02GIOZ0.51.78.H01.1.454.CMB.2.raw
  modified_base (320)..(320): a, c, t, g, unknown or other
  misc_feature (320)..(320): n is a, c, g, or t
  modified_base (400)..(400): a, c, t, g, unknown or other
  misc_feature (400)..(400): n is a, c, g, or t
  modified_base (434)..(434): a, c, t, g, unknown or other
  misc_feature (434)..(434): n is a, c, g, or t
tcagcgatcgtatacacgaccggtgctcgatttagtgtgagtagtttgggtttgggcacgaccggtgctcgatttagtgtgagtagtttgggtttggggaggagtcagtctcagtcaggacacagcatggacatgagggtcccgctcagctcctggggctcctgctactctggctccgaggtgccagatgtgacatccagatgacccagtctccatcctccctgtctgcatctgtaggagacagagtcaccatcacttgccgggcaagtcagagcattagcagctaatttaaatgtatcagcagacgaccaaggggaacncccctaactccctagactctatgaatgcctataccaaagtttggaaagtcggggtacccatacgaaagttccagtcgganagtggactcgtaggggacagtactttacaccttntaccaccgatccagcagttcgcgacgtactagtaattactttacgacttaaacttactacgtactaacaaacgtacgtaacgtaacctaccgtaccctacgactactaccgtacggttcggg

SEQ ID NO: 310300 - DNA, 585 bp, Homo sapiens
  misc_feature: GZ8MTXP02JFP7J.51.78.H01.1.454.CMB.2.raw
  modified_base (225)..(225): a, c, t, g, unknown or other
  misc_feature (225)..(225): n is a, c, g, or t
  modified_base (282)..(282): a, c, t, g, unknown or other
  misc_feature (282)..(282): n is a, c, g, or t
tcagcgatcgtatacacgaccggtgctcgatttagtgtgagtagtttgggtttggggaggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacgttgccgggnaagtcagagcattagcagtactatttaaatggtatcagcaggagaccgagggaaacncccctaactcctgatctatgatgctactcctaagtttaggaaagtccggggtacccagtcgtaaaggttcaggttggctaggtggtatcgtaggggacagtatttcaactctacaccatcagctagtgtcgacgactagtaacgttatttcgacctaacttactactacgtacaaactaggtacttaccacgtaaccccctgaccgtacttaccgtaccggtttacgggaccgggttacgggaacccgaaggggttacggaaagacgttaaacgaaaacccgtagtacggtaggtaccgtacg

SEQ ID NO: 310301 - DNA, 645 bp, Homo sapiens
  misc_feature: GZ8MTXP02IUZFH.51.78.H01.1.454.CMB.2.raw
  modified_base (322)..(322): a, c, t, g, unknown or other
  misc_feature (322)..(322): n is a, c, g, or t
tcagcgatcgtatacacgaccggtgctcgatttagtgtgagtagtttgggtttgggcacgaccggtgctcgatttagtgtgagtagtttgggtttgggcacgaccggtgctcgatttagtgtgagtagtttgggttggggaggagtcagtctcagtcaggacaaagcatggacatgagggtccccgctcagctcctggggctcctgctactctggctccgaggtgccagatgtgacatccagatcgacccagtcctccactccctcctgtctgcatctgtagagacagacgtccacatctacgttcgccggacaagtcaganctaattacgactagtaccttaagtttaaagtggtatcgtaagacgaaggaacgaccgtaacggggaaaacctacccccgttaaaccgtccgtagtaacttacgtaagtcgagtacgactaaacttaccgtaaagtttacggggaaacgttccggggtaacctagttacgtaaacgggtttcctaaagggttggtaccgtagggtacggtaatccgggtagggtaacctaggttactttaccgactttccaacgtacctatcgacgtctaaggtcgtacgacgtacgtaagtacttactttacgacctaacgttcttacgtacg

SEQ ID NO: 310302 - DNA, 648 bp, Homo sapiens
  misc_feature: GZ8MTXP02JOK0F.51.78.H01.1.454.CMB.2.raw
tcagcgatcgtatacacgaccggtgctcgatttagtgtgagtagtttgggtttggggggagaggagccccagccctgagattcccaggtgtttccattcagtgatcagcactgaacacagaggactcaccatggagttgggactgagctggattttccttttggctattttaaaaggtgtccagtgtgaagtgctactggtggagtcgtgggggaggcctggtacagcctggcaggtccctgagactctcctgtgcagcctctggattcacctttgatgattatgccatgcacgtggggtcccgacaagcctaccgaaggggaacgggccgtgggacggttggggtctcgtacgttagttaggttaggaattaggtggtagtatagccttatcggcggtacttcgtggtaggaacggggtcccgtaattccgaacctaattccgtaccgaagaacgaaaccaaaccgacccaaacgtaaccctcccgtagttaactctagaccaaaattacggaaacctagtctaggaagtacgcgtaggacggaaccgaaccgggtcctttaggttacttaccgtacgaccgaaccgaaaaacgcccgaaaaggaaccaaacgacgtacgtacggtaactacgtaaacgtttaacgg

SEQ ID NO: 310303 - DNA, 655 bp, Homo sapiens
  misc_feature: GZ8MTXP02F3Z7T.51.78.H01.1.454.CMB.2.raw
  modified_base (292)..(292): a, c, t, g, unknown or other
  misc_feature (292)..(292): n is a, c, g, or t
  modified_base (321)..(321): a, c, t, g, unknown or other
  misc_feature (321)..(321): n is a, c, g, or t
tcagcgatcgtatacacgaccggtgctcgatttagtgtgagtagtttgggtttgggcacgaccggtgctcgatttagtgtgagtagtttgggtttgggcacgaccggtgctcgatttagtgtgagtagtttgggtttggggaggagtcagtctcagtcaggacacagcatggacatggacgggtccccgctcagcctccgtggggcctcctgctactctggctccgaggtgccagatgtgacatccagatcgacccagtcctccactccctccctgtctgcatctgtagganacagagtccaccatcacgttcggccgganaagtcagagctattacgcagtacttaatttaaattggtatcagacagacgaaccaacggggaaacctccccctaacctctagacttcgtaatcgatcgactaacttaccgtaaagtttagggaaaacgggttcggggtaccctaagttaccgtaaaggttccgaaggtcggacgtagggttacggaactcgggttagggaacctaaggttacttttaccgaaccttcctaaccctaaccctattacgtaacggcgtacggttacggtacgtacccgtaaccgttaaggtaaacgtttaactttacgaaccctttaaaacctttactttaaaccg

SEQ ID NO: 310304 - DNA, 541 bp, Homo sapiens
  misc_feature: GZ8MTXP02INR8D.51.78.H01.1.454.CMB.2.raw
  modified_base (241)..(241): a, c, t, g, unknown or other
  misc_feature (241)..(241): n is a, c, g, or t
  modified_base (323)..(323): a, c, t, g, unknown or other
  misc_feature (323)..(323): n is a, c, g, or t
  modified_base (518)..(518): a, c, t, g, unknown or other
  misc_feature (518)..(518): n is a, c, g, or t
tcagcgatcgtatacacgaccggtgctcgatttagtgtgagtagtttgggtttgggcacgaccggtgctcgatttagtgtgagtagtttgggtttggggaggagtcagtctcagtcaggacacagcatggacatgagggtccccgctcagctcctggggctcctgctactctggctccgaggtgccagatgtgacatccagatgacccagtctccatcctccctgtctgcatctgtagganacagagtcaccatcacttgccgggcaagtcagagcattagcagtctaatttaaattggtatcagcagagaccaagggaaacncccctaactccctagatctatgatgctatcctaaagtttgggaaaagtcggggtacccagtaccgtaaggttcagtggcagtggatcgtgggacagtatttcactctactaccatcagcagtgtgcgtactagaacgtatttcgactaaacttactactacgtacaaacgtagtaacgttaaccacgtacccctnaacgtcctacgtacgttaccggg

SEQ ID NO: 310305 - DNA, 687 bp, Homo sapiens
  misc_feature: GZ8MTXP02GJPJZ.51.78.H01.1.454.CMB.2.raw
  modified_base (255)..(255): a, c, t, g, unknown or other
  misc_feature (255)..(255): n is a, c, g, or t
  modified_base (283)..(283): a, c, t, g, unknown or other
  misc_feature (283)..(283): n is a, c, g, or t
tcagcgatcgtatacacgaccggtgctcgatttagtgtgagtagtttgggtttgggcacgaccggtgctcgatttagtgtgagtagtttgggtttgggcacgaccggtgctcgatttagtgtgagtagtttgggtttggggaggagtcagtctcagtcaggacacagcatggacatgagggtccccgctcagctcctggggctcctgctactctggctccgaggtgccagatgtgacatccagatgacccagtcnccatcctccctgtctgcatctgtagganacagacgtccaccatccacgttcggacccggtacaagtcaggacgctaagttagcaagtacttaacttttaaagtggtactacgagacaaggacgaaaccgaaaggggaaacctaccccccgttaaacctcccgtaagtacttactagtacgatcggacttaacgtacctaaaggtttagggaaaacggttcggggtaacccctaagttaccgtaaagggtttccaagggttcggacgtagggttacgaacgttaccggtaaggggacctaaggttaccttttaccaccgttaccctaactacccgtaacgttaccgaggtaaccgtagggtcgttacgacccccggtaaacgttagtaaacggtttcgttttaacgaacccttaaaccgtttactttaaccgg

SEQ ID NO: 310306 - DNA, 564 bp, Homo sapiens
  misc_feature: GZ8MTXP02GABPL.51.78.H01.1.454.CMB.2.raw
  modified_base (285)..(285): a, c, t, g, unknown or other
  misc_feature (285)..(285): n is a, c, g, or t
  modified_base (317)..(317): a, c, t, g, unknown or other
  misc_feature (317)..(317): n is a, c, g, or t
  modified_base (324)..(324): a, c, t, g, unknown or other
  misc_feature (324)..(324): n is a, c, g, or t
  modified_base (366)..(366): a, c, t, g, unknown or other
  misc_feature (366)..(366): n is a, c, g, or t
  modified_base (378)..(378): a, c, t, g, unknown or other
  misc_feature (378)..(378): n is a, c, g, or t
tcagcgatcgtatacacgaccggtgctcgatttagtgtgagtagtttgggtttgggcacgaccggtgctcgatttagtgtgagtagtttgggtttgggcacgaccggtgctcgatttagtgtgagtagtttgggtttggggaggagtcagtctcagtcaggacacagcatggacatgagggtccccgctcagctcctggggctcctgctactctggctccgaggtgccagatgtgacatccagatcgacccagtctccatccctccctgtctgcatctgtagganacagagtcaccatcacttgccggcaagtcagngcattancagtctaatttaaatggtatcagcagacgaccaagggaaacncccctaactctnatactatgatcgactattacctaagtttacgggaaaacggttcggggtaccctaagtacgtaaaggttcaaggtggactaggtgtaacgtcggtaggactagtatttaccactctacacctaatcgaagcgtagtcgtagtaccgaaccgtagtaaacgttatttacgaacttaaactttactaac

SEQ ID NO: 310307 - DNA, 619 bp, Homo sapiens
  misc_feature: GZ8MTXP02HRYNW.51.78.H01.1.454.CMB.2.raw
tcagcgatcgtatacacgaccggtgctcgatttagtgtgagtagtttgggtttgggggggagaggagccccagccctgagattcccaggtgtttccattcagtgatcagcactgaacacagaggactcaccatggagttgggactgagctggtattttccttttggctattttaaaaggtgtccagtgtgaagtgctactggtggagtcgtgggggaggcctggtacagcctggcaggtccctgagactctcctgtgcagcctctggattcactttgatgattatgccatcgctacgtcggggtccgacaagctaccggaggggacgggcctggaggtgggtctcgacgttattaggttaggaataggtgtagtatagccttagtcggcggtactcgtggtaggaacggggtcctagttaccacctactcctaccgaaggaacgaaccgaaaccggacccaaaacgtaaccctccctagttaactccgtagaacaaaagttcgaaacgtgtacgtagaaggtacgacgtaggacggacgacggttccttaggttacttactcggacgaacgaaaacgccgaaagaaccaaacggacgtacgtagtactactaacgtacg

SEQ ID NO: 310308 - DNA, 575 bp, Homo sapiens
  misc_feature: GZ8MTXP02HGA93.51.78.H01.1.454.CMB.2.raw
  modified_base (188)..(188): a, c, t, g, unknown or other
  misc_feature (188)..(188): n is a, c, g, or t
  modified_base (226)..(226): a, c, t, g, unknown or other
  misc_feature (226)..(226): n is a, c, g, or t
  modified_base (285)..(285): a, c, t, g, unknown or other
  misc_feature (285)..(285): n is a, c, g, or t
  modified_base (297)..(297): a, c, t, g, unknown or other
  misc_feature (297)..(297): n is a, c, g, or t
  modified_base (309)..(309): a, c, t, g, unknown or other
  misc_feature (309)..(309): n is a, c, g, or t
  modified_base (320)..(320): a, c, t, g, unknown or other
  misc_feature (320)..(320): n is a, c, g, or t
  modified_base (500)..(500): a, c, t, g, unknown or other
  misc_feature (500)..(500): n is a, c, g, or t
  modified_base (512)..(512): a, c, t, g, unknown or other
  misc_feature (512)..(512): n is a, c, g, or t
tcagcgatcgtatacacgaccggtgctcgatttagtgtgagtagtttgggtttgggcactaccggtgctcgatttagtgtgagtagtttgggtttgggcacgaccggtgctcgatttagtgtgagtagtttgggtttggggaggagtcagtctcagtcaggacacagcatggacatgagggtccccgntcagctcctggggctcctgctactctggctccgaggtnccagatgtgacatccagatcgacccagtcctccatccctccctgtctgcatctgtaganacagagtcaccntccatcgccggnaagtcagacgnattagctagtcttaattaaactgtatacagcagacgaccgaaagggaaaccctccccctaaactcctagtactactagtagactcgactaatacctaaagtttcgggaaagtccgggtaccagtaccgtaaagttcaggtgacgtaggagctacggtaggactagtacttacaccttacncctaaaccttanacgacggtactacggtcgtacgacgtaacgtagtaacgtttcttacgactttaactttacgag

SEQ ID NO: 310309 - DNA, 672 bp, Homo sapiens
  misc_feature: GZ8MTXP02FJ2XG.51.78.H01.1.454.CMB.2.raw
  modified_base (240)..(240): a, c, t, g, unknown or other
  misc_feature (240)..(240): n is a, c, g, or t
  modified_base (266)..(266): a, c, t, g, unknown or other
  misc_feature (266)..(266): n is a, c, g, or t
  modified_base (318)..(318): a, c, t, g, unknown or other
  misc_feature (318)..(318): n is a, c, g, or t
tcagcgatcgtatacacgaccggtgctcgatttagtgtgagtagtttgggtttgggcacgaccggtgctcgatttagtgtgagtagtttgggtttgggaggagtcagtctcagtcaggacacagcatggacatgagggtccccgctcagctcctggggctcctgctactctggctccgaggtgccagatgtgacatccagatgacccagtctccatcctccctgtctgcatctgtagganacagagtcaccatcacttgccgggtnaagtcagagcattagcagctaattaactggtatcagcagagaccagggaacncccctaactcccctagactctatgatgctatacctaatttacgggaaagtcggggtacccaagttaccgtaaagggtttccaaggttcggaccgtaaggttcggtaaacgttccggtacgggggtaacctaagggttacttttacccgaaaccgtttcctaccctaaacccgtagttacccgtaaggtccctaaagggttcggtacggtacccggtaacccgttaggtaaaacgttacgttttacggaaccttaaaccgtttaccgtaacgttacgtaaccgtaaaaccgtacggttaacgttaaccgaacggttaccccctagtaaccgtcctaccgtacgtttaaccggggg

SEQ ID NO: 310310 - DNA, 657 bp, Homo sapiens
  misc_feature: GZ8MTXP02HJEH3.51.78.H01.1.454.CMB.2.raw
tcagcgatcgtatacacgaccggtgctcgatttagtgtgagtagtttgggtttggggggagaggagccccagccctgagattcccaggtgtttccattcagtgatcagcactgaacacagaggactcaccatggagttgggactgagctggattttccttttggctattttaaaaggtgtccagtgtgaagtgctactggtggagtcgtgggggagcctggtacagcctggcaggtccctgagactctcctgtgcagcctcgtggtattcctacctttgatgattatgccatgccacgtcgggtccgcaagcctccgaaggggaacggccgtgggaggttcggggtctacgtacggttagtttaggttaggaaagtttaggtagggttaagttaagtacgtaccgttaagtcgggtaccgggtaacttcgttagggtagggaacggggcccgtaacttccgaaccctacttcctacccgaagacgaaccgaaccgaccgaaacgtacctcccctagtactctagactaaatcgaactagtcgtagagacgcgtaggaacggacgaccggttacctttagttaccgtttacgcggaccgaaccgaaaacgcccgaaaggaaccaacgacgtaccgtaggtacctacttaaagttaacg

SEQ ID NO: 310311 - DNA, 632 bp, Homo sapiens
  misc_feature: GZ8MTXP02H1C26.51.78.H01.1.454.CMB.2.raw
tcagcgatcgtatacacgaccggtgctcgatttagtgtgagtagtttgggtttggggggagaggagccccagccctgagattcccaggtgtttccattcagtgatcagcactgaacacagaggactcaccatggagttgggactgagctggattttccttttggctattttaaaaggtgtccagtgtgaagtgctactggtggagtcgtgggggaggcctggtacagcctggcaggtccctgagactctcctgtgcagcctctggattcactttgatgattatgccatgcacgtggggtcccgacaagcctaccgaggggaacgggcctggggagtcgggtctcgacgttattaggttggaatggtggtagtatagccttatggcggtactcgtggtagggaacgggtccgtattccaacctattccacccgaaggacgaaacccgaaaccggacccaaaacggaacccttcccgtagtactctagactaaaagtcgaaacagttcgagagtagcgtaggaacggaccgtaaccgggtcctttaggttactttacgcggaaccgaacgaaaacggacccgaaaggaaccaaacgtaggtaccgttacggtaacctacgtaaaacgttaacgg

SEQ ID NO: 310312 - DNA, 659 bp, Homo sapiens
  misc_feature: GZ8MTXP02IP82C.51.78.H01.1.454.CMB.2.raw
  modified_base (265)..(265): a, c, t, g, unknown or other
  misc_feature (265)..(265): n is a, c, g, or t
  modified_base (328)..(328): a, c, t, g, unknown or other
  misc_feature (328)..(328): n is a, c, g, or t
tcagcgatcgtatacacgaccggtgctcgatttagtgtgagtagtttgggtttgggcacgaccggtgctcgatttagtgtgagtagtttgggtttggggaggagtcagtctcagtcaggacacagcatggacatgagggtccccgctcagctcctggggctcctgctactctggctccgaggtgccagatgtgacatccagatgacccagtctccatcctccctgtctgcatctgtaggagacagatcaccatcacttgccgggnaagtcagagcattagcagtactaatttaaattggtatcagcaggacgaaccgaagggaaaccncccctaactccctagactctatgatgctataccgtaaagtttaggggaaaggttcggggtacccaagtaccgtaaggttcgaggtggacaggttggagttcgtagggactagtactttccaccttacacctactactaccaagtcgtaaggttcggtacgtaccggtaaccgttagtaaaagtttacgtttttacgaacctttaaaacctttaaccttaaacgttacggttaaaaccctaaaacgttaacggtaaaccgtttaaacccgtaacccgttaacccccttacgaaccggttccccttaccgtttaaccgggtttaacccggggg

SEQ ID NO: 310313 - DNA, 544 bp, Homo sapiens
  misc_feature: GZ8MTXP02G8DOG.51.78.H01.1.454.CMB.2.raw
  modified_base (308)..(308): a, c, t, g, unknown or other
  misc_feature (308)..(308): n is a, c, g, or t
  modified_base (341)..(341): a, c, t, g, unknown or other
  misc_feature (341)..(341): n is a, c, g, or t
  modified_base (362)..(362): a, c, t, g, unknown or other
  misc_feature (362)..(362): n is a, c, g, or t
tcagcgatcgtatacacgaccggtgctcgatttagtgtgagtagtttgggtttgggcacgaccggtgctcgatttagtgtgagtagtttgggtttgggcacgaccggtgctcgatttagtgtgagtagtttgggtttggggaggagtcagtctcagtcaggacacagcatggacatgagggtccccgctcagctcctggggctcctgctactctggctccgaggtgccagatgtgacatccagatgacccagtcctccatccctcctgtctgcatctgtaggagacagatcaccatcacttgccgganaagtcagagcatagcagtctaatttaagtgtancagcagcgacgagggaaaccncccctaactcagactctatgatgacactactaagttacggaaaggttcgggtaccctagtacgtaaggttcaggtggactaggtagactcgtagggactagtactttaccactctacacctatcgagactagtcgtacgacgtaacgtagtaacgttactttacgacttaacttacgtaacg

SEQ ID NO: 310314 - DNA, 727 bp, Homo sapiens
  misc_feature: GZ8MTXP02JK1R2.51.78.H01.1.454.CMB.2.raw
tcagcgatcgtatacacgaccggtgctcgatttagtgtgagtagtttgggtttgggggctctgggagaggagccccagccctgagattcccaggtgtttccattcagtgatcagcactgaacacagaggactcaccatggagttgggactgagctggtattttccttttggcttattttaaaaggtgtccagtgtgaagtgctactggtggagtcgtgggggaggcctggtacagccgtggcaggtccctgagactctcctgtgcagcctctggattctacctttgatgtattatcgcctatgcacgtcgggtccgacaagccgtaccggaaggggaacgggccgtaggggacggtcggggtactcgtaacgttagtttaggttaggtaataggttggtaagttaagtacgtccttaagtcggtaccggtacttcgtagggtacgggaaacggggtcccgtaaacttcccgaaaccctacgtttacccgaccgaacggaaaccgaaacccgaaaccggacccaaaaccggtaacccttacccccgtaggttaacctcgttaacgaaacctaaaagttacgaaacgtacggttacgtaggaaagacggtaccgaggggaaacggtacccggtaaaccggttcccgtttaagttaacgtttaccgtacggaccgaaaaccgaaaacggacccgaaaggaaccgaaacgacgtacgtaacggtttaaacc

SEQ ID NO: 310315 - DNA, 532 bp, Homo sapiens
  misc_feature: GZ8MTXP02JJ1FC.51.78.H01.1.454.CMB.2.raw
  modified_base (277)..(277): a, c, t, g, unknown or other
  misc_feature (277)..(277): n is a, c, g, or t
tcagcgatcgtatacacgaccggtgctcgatttagtgtgagtagtttgggtttggggaggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctattaaattggtatcagcagagaccagggaaacncccctaacctctgatctatgatgcatcctaattggaaagtcggggtcccatcaaggttcagtggcagtggatcgtgggacagtatttcactctcacatcagcagtgtcgcgaccttagaaagttattttagactaactttactactagtacaaacagtacgttaacacgttacccatacgctactacgtttcggacggacgggaaccgtaaggtacggaagacgtaacgaaaacggtactacggtacggctaccg

SEQ ID NO: 310316 - DNA, 529 bp, Homo sapiens
  misc_feature: GZ8MTXP02H9UZ4.51.78.H01.1.454.CMB.2.raw
  modified_base (240)..(240): a, c, t, g, unknown or other
  misc_feature (240)..(240): n is a, c, g, or t
  modified_base (264)..(264): a, c, t, g, unknown or other
  misc_feature (264)..(264): n is a, c, g, or t
  modified_base (319)..(319): a, c, t, g, unknown or other
  misc_feature (319)..(319): n is a, c, g, or t
  modified_base (340)..(340): a, c, t, g, unknown or other
  misc_feature (340)..(340): n is a, c, g, or t
tcagcgatcgtatacacgaccggtgctcgatttagtgtgagtagtttgggtttgggcacgaccggtgctcgatttagtgtgagtagtttgggtttggggaggagtcagtctcagtcaggacacagcatggacatgagggtccccgctcagctcctggggctcctgctactctggctccgaggtgccagatgtgacatccagatgacccagtctccatcctcctgtctgcatctgtagganacagagtcaccatcacttgccggnaagtcagagcattagcagtctaattaaatggtatcagcagagaccaagggaaacncccctaactccctagatctangatgcatctaagttgaagtcgggaccatcaagtcagtgcagtgatcgtgggactagtattcacttcacaccatacgagcgaagtcgtcgaccgtacgtagtaagttactttacgacttaacttactaccgtagtacaacgtaagtacttaaccgtaccgtaaccctcacgtcctacgtacgttaccggg

SEQ ID NO: 310317 - DNA, 591 bp, Homo sapiens
  misc_feature: GZ8MTXP02IK1TI.51.78.H01.1.454.CMB.2.raw
tcagcgatcgtatacacgaccggtgctcgatttagtgtgagtagtttgggtttgggggctctgggagaggagccccagccctgagattcccaggtgtttccattcagtgatcagcactgaacacagaggactcaccatggagttgggactgagctggattttccttttggctattttaaaaggtgtccagtgtgaagtgctactggtggagtcgtgggggagcctggtacagcctggcaggtccctgagactctcctgtgcagcctctggattcacctttgatgattatgccatgcacgtgggccgcaagctcgagggaggctggagtggtctcgagtattaggtgaataggtggtatatgcctatggcgtactcgtgtaggaacgggtccgattccgaccatccctaccgaagaacgaaccaaaccgccaaagaacctcccctagtaactctagactaaatcgaaacctagtctaggaagacgacgtaggaacggaccgtaccgggtacctttaggttaactttaccgacgaccgaaaccgaaaaacggcccgaaaagggaccaaacgacggtaccgttacggtaaaccc

SEQ ID NO: 310318 - DNA, 546 bp, Homo sapiens
  misc_feature: GZ8MTXP02JFW78.51.78.H01.1.454.CMB.2.raw
  modified_base (456)..(456): a, c, t, g, unknown or other
  misc_feature (456)..(456): n is a, c, g, or t
  modified_base (460)..(460): a, c, t, g, unknown or other
  misc_feature (460)..(460): n is a, c, g, or t
tcagcgatcgtatacacgaccggtgctcgatttagtgtgagtagtttgggtttgggggctctgggagaggagccccagccctgagattcccaggtgtttccattcagtgatcagcactgaacacagaggactcaccatggagttgggactgagctggattttccttttggctattttaaaaggtgtccagtgtgaagtgctactggtggagtcgtgggggaggcctggtacagcctggcagggtccctgagactctcctgtgcagcctctggattcacctttgatgattatgccatgcacgtgggtccgcaagctccgaggggaagggcctgggagtgggtctcgacgtattagttggaataggtggtagtatgcctatgcgatctgtgaagggccattcaccatctaccagagacaacgccaagaacctccctagtactctgacaaatcgaaacngtcngagagctggacgacacggtccttagtacttacgacgccgaacaaaacggcccaaaagggccaaacgacggtacgtacggttaaacc

SEQ ID NO: 310319 - DNA, 592 bp, Homo sapiens
  misc_feature: GZ8MTXP02F6N87.51.78.H01.1.454.CMB.2.raw
  modified_base (261)..(261): a, c, t, g, unknown or other
  misc_feature (261)..(261): n is a, c, g, or t
  modified_base (303)..(303): a, c, t, g, unknown or other
  misc_feature (303)..(303): n is a, c, g, or t
tcagcgatcgtatacacgaccggtgctcgatttagtgtgagtagtttgggtttggggggagaggagccccagccctgagattcccaggtgtttccattcagtgatcagcactgaacacagaggactcaccatggagttgggactgagctggattttcctttggctattttaaaaggtgtccagtgtgaagtgctactggtggagtcgtgggggtagcctggtacagcctggcaggtccctgagactctcctgtgcagcctntggattcacctttgatgattatgccatgcacgtggggtccgnaagcctccgaggggacggcctgggaggtgggtctcgacgtattaggtggaattggtgtagtatagcctatcggcgactcgtgtggaaggggccctattccgacctatcctaccaggaacgaaccaacgaccaaacgacctacccgtgtaactctagactaaatgaaaccagtctggagagtacgaggacggacacgggtcctttagttaacttaccgtaggacgaacgaaaaacgccctaaaagggaaccaaacgaggtaccgtaggtaacctacgaaagtttaaccgg

SEQ ID NO: 310320 - DNA, 693 bp, Homo sapiens
  misc_feature: GZ8MTXP02JB0Y3.51.78.H01.1.454.CMB.2.raw
tcagcgatcgtatacacgaccggtgctcgatttagtgtgagtagtttgggtttgggggctctgggagaggagccccagccctgagattcccaggtgtttccattcagtgatcagcactgaacacagaggactcaccatggagttgggactgagctggtattttccttttggcttaattttaaaaggtgtccagtgtgaagtgctacgtggtggagtcgtgggggagcctggtacagccgtggcacggtccctgacgactctcctgtgcagcctcgtggtacttctacctttgattgtattagcgccagtcgacctacggttcggggtcccgactaacgccgtaccggaaggggacgggtccgtgggacggtcggtcctacgtacggttagttagttaggaagttaggtggttaagtagtcgtcccttagtcgggtaccgtacgttcgtagggtacgggaaacggggtccctacttacccgacctatcccgtaccgaaggaacgaaccgaacccgacctaaacgtaacccgtcccttaggttactcccgttaaagaaccgtaaaagtacgtaaacgtaggttacgagaacggacgtcggtaaggacgtaccggtaccgttacgttaagtaacgtaccgacggaaccgaaacgaaaacgaccgaacggaaccacgtacgtaccgttaacgtaacc

SEQ ID NO: 310321 - DNA, 535 bp, Homo sapiens
  misc_feature: GZ8MTXP02I080M.51.78.H01.1.454.CMB.2.raw
  modified_base (270)..(270): a, c, t, g, unknown or other
  misc_feature (270)..(270): n is a, c, g, or t
  modified_base (317)..(317): a, c, t, g, unknown or other
  misc_feature (317)..(317): n is a, c, g, or t
tcagcgatcgtatacacgaccggtgctcgatttagtgtgagtagtttgggtttgggcacgaccggtgctcgatttagtgtgagtagtttgggtttggggaggagtcagtctcagtcaggacacagcatggacatgagggtccccgctcagctcctggggctcctgctactctggctccgaggtgccagatgtgacatccagatgacccagtctccatcctcctgtctgcatctgtagagacagagtcaccatcacttgccggcagtcagngcattagcagtctatttaaatggtatcagcagagaccaagggaaacncccctaactccctgactctatgattgctatacctaaagtttggaaacggttcggggaccctatacgtaaagttcagtggcagtgactcgtggacagtatttcactctcacatcgagctagtgtgacgactagtaatattttacgacttaaacttactactacgtacaacgtacgtaacttaacgaccgtaccctacagtacctcgtaaccgtttcggg

SEQ ID NO: 310322 - DNA, 603 bp, Homo sapiens
  misc_feature: GZ8MTXP02GO49N.51.78.H01.1.454.CMB.2.raw
  modified_base (275)..(275): a, c, t, g, unknown or other
  misc_feature (275)..(275): n is a, c, g, or t
  modified_base (300)..(300): a, c, t, g, unknown or other
  misc_feature (300)..(300): n is a, c, g, or t
  modified_base (516)..(516): a, c, t, g, unknown or other
  misc_feature (516)..(516): n is a, c, g, or t
tcagcgatcgtatacacgaccggtgctcgatttagtgtgagtagtttgggtttggggggagaggagccccagccctgagattcccaggtgtttccattcagtgatcagcactgaacacagaggactcaccatggagttgggactgagctggtattttcctttggctattttaaaaggtgtccagtgtgaagtgctactggtggagtcgtgggggagcctggtacagcctggcaggtccctgagactctcctgtgcagcctctggattcactttgntgattatgccatgcacgtgggccgnaacgctaccgaggggaggccgtggagtgggtcctcgaacgttgttaggttaggaataggtaggttagtattacgccttaagtcggaccggtaacttcgtaggtagggaaaggggttcatttaccactactctaccgagacgaacaaccgaccaaacgtaccctcctagtaactccgtagactaaatagaacagtctaggagagcgtaggacggacncgggtaccttaggtacttacgtcggacaacgaaaacgcccgaaaggaaccaacgacggtactacggtaactactaaagtttaaccgg

SEQ ID NO: 310323 - DNA, 650 bp, Homo sapiens
  misc_feature: GZ8MTXP02IRAV3.51.78.H01.1.454.CMB.2.raw
  modified_base (199)..(199): a, c, t, g, unknown or other
  misc_feature (199)..(199): n is a, c, g, or t
  modified_base (276)..(276): a, c, t, g, unknown or other
  misc_feature (276)..(276): n is a, c, g, or t
tcagcgatcgtatacacgaccggtgctcgatttagtgtgagtagtttgggtttggggaggagtcagtctcagtcaggacacagcatggacatgagggtccccgctcagctcctggggctcctgctactctggctccgaggtgccagatgtgacatccagatgacccagtctccatcctccctgtctgcatctgtagganacagatcaccatcacttgccgggcaagtcagagcattagcagctatttaaatgtatcagcagagaccgaagggaacncccctaactcctgatctatgtatcgactactaacgttaaggttacggaaacggttcccggtacctagtacgtaaggttcgaggtcggacgtagttaggacttacgggtacgggactaagtttacttacctacctcctaccaactactacgaacgcgtaaggtgaccgtaccgtaacgtagttaaagtttacgtttacgtaacttaaacttacgtactactaaacgaaacgtaagttaacttaaccgtacccgtaaccctacgtacgtaccttacggttaccggttaccggggaacgggtaaccgggtaaaccgtaaggggacgtaaaacgttaacgaaaaccgtaaaaccggtagtcggtacggtactaaccgg

SEQ ID NO: 310324 - DNA, 592 bp, Homo sapiens
  misc_feature: GZ8MTXP02JIHM9.51.78.H01.1.454.CMB.2.raw
  modified_base (224)..(224): a, c, t, g, unknown or other
  misc_feature (224)..(224): n is a, c, g, or t
  modified_base (277)..(277): a, c, t, g, unknown or other
  misc_feature (277)..(277): n is a, c, g, or t
  modified_base (483)..(483): a, c, t, g, unknown or other
  misc_feature (483)..(483): n is a, c, g, or t
tcagcgatcgtatacacgaccggtgctcgatttagtgtgagtagtttgggtttggggaggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggnaagtcagagcattagcagctattaaattggtatcagcagagaccagggaaacncccctaactcctgatctatgatgcatacctaaagtttaggaaagttccggggtaccctagtacgaaaggtttcgaagttcggcgtaggtggtatcgtggggaacagtattcactcacaaccatcagctagtgtgacgtactgtaagtatttacgactaacttactacttgtaccaaacgtagtaacgttaccacgttaaccccctntaacggtccttaccgtaccggttttacgggaccgggtaaacgggtacccgtaaaaggggttggaaacgtaacgtaaccgaaaacggtaccgtaggtacgggactaccgg

SEQ ID NO: 310325 - DNA, 575 bp, Homo sapiens
  misc_feature: GZ8MTXP02GJDU6.51.78.H01.1.454.CMB.2.raw
  modified_base (261)..(261): a, c, t, g, unknown or other
  misc_feature (261)..(261): n is a, c, g, or t
  modified_base (280)..(280): a, c, t, g, unknown or other
  misc_feature (280)..(280): n is a, c, g, or t
  modified_base (455)..(455): a, c, t, g, unknown or other
  misc_feature (455)..(455): n is a, c, g, or t
  modified_base (462)..(462): a, c, t, g, unknown or other
  misc_feature (462)..(462): n is a, c, g, or t
tcagcgatcgtatacacgaccggtgctcgatttagtgtgagtagtttgggtttggggggagaggagccccagccctgagattcccaggtgtttccattcagtgatcagcactgaacacagaggactcaccatggagttgggactgagctggattttcctttggctattttaaaaggtgtccagtgtgaagtgctactggtggagtcgtgggggagcctggtacagcctggcaggtccctgagactctcctgtgcagcctcnggattcacttgatgattangccatgcacgtggggtcccgcaagctaccgaggggaacggcctggagtgggtctcgacgttattaggttggaatagtggtatatagacctagtgacggacttcgtgtaggaaacgggcctattacacctatctaccagacgacaacgaccaaagacctccctagtactccgtaanaacaaanacgaacgagtacgagacgacgacgaggaacgacgacgtacgttagtactacgtacgacgaacgaaaacgaccgaaacgaacaacgacgtacgtacgtactacgtaacgtaacg

SEQ ID NO: 310326 - DNA, 565 bp, Homo sapiens
  misc_feature: GZ8MTXP02GS7S6.51.78.H01.1.454.CMB.2.raw
  modified_base (200)..(200): a, c, t, g, unknown or other
  misc_feature (200)..(200): n is a, c, g, or t
  modified_base (226)..(226): a, c, t, g, unknown or other
  misc_feature (226)..(226): n is a, c, g, or t
  modified_base (294)..(294): a, c, t, g, unknown or other
  misc_feature (294)..(294): n is a, c, g, or t
  modified_base (415)..(415): a, c, t, g, unknown or other
  misc_feature (415)..(415): n is a, c, g, or t
  modified_base (423)..(423): a, c, t, g, unknown or other
  misc_feature (423)..(423): n is a, c, g, or t
  modified_base (490)..(490): a, c, t, g, unknown or other
  misc_feature (490)..(490): n is a, c, g, or t
tcagcgatcgtatacacgaccggtgctcgatttagtgtgagtagtttgggtttggggaggagtcagtctcagtcaggacacagcatggacatgagggtccccgctcagctcctggggcctcctgctactctggctccgaggtgccagatgtgacatccagatgacccagtctccatcctccctgtctgcatctgtagganacagatcaccatcacttggccggganaagtcagagcaattagcagtacttaattaaaattggtatacagacagaacgaaccgaaaggggaaacnccccctaaacctcctagatctatgatgctatacctaagttaggaaaggtcggggtacccagtacgaagttcaggtgctagtgaatcgtagggactagtactttcactctaccacgatccanctagtcgngacgactaggatagtttacattaacttactatagtacaaactaggtacttaacgaccgttaccccanacgtccttacgtacggtcgggacggaacggaacgtaggagaacgtaacaaacgaaaacgtagtacggacgacacg

SEQ ID NO: 310327 - DNA, 717 bp, Homo sapiens
  misc_feature: GZ8MTXP02I8B9U.51.78.H01.1.454.CMB.2.raw
  modified_base (206)..(206): a, c, t, g, unknown or other
  misc_feature (206)..(206): n is a, c, g, or t
  modified_base (228)..(228): a, c, t, g, unknown or other
  misc_feature (228)..(228): n is a, c, g, or t
  modified_base (287)..(287): a, c, t, g, unknown or other
  misc_feature (287)..(287): n is a, c, g, or t
tcagcgatcgtatacacgaccggtgctcgatttagtgtgagtagtttgggtttgggcacgaccggtgctcgatttagtgtgagtagtttgggtttgggcacgaccggtgctcgatttagtgtgagtagtttgggttggggaggagtcagtctcagtcaggacacagcatggacatgagggtccccgctcagctccgtggggctccngcctactctggctccgaggtcnccagatgtgacatccagactgacccagtctccatccctcctgtctgcatctagtagganacagacgtcaccatcacgttggacccggacaaggtcaagacgctaagttacgctaacgtactttaaagttttaaagtcgggtaactacgaagtacaaggaccgggtaaccgaaaacgggggtaaaaccctccccccttaaaacgttcccgtaggtaaacttaaccttagttacggaacttacggacctaacgttaacctaaagggttttacgggaaaacggtttccggggtaaccctagttaccggtaaaggtttcgaacggtcggacttagggtacggtaacgttcggtaggggaaccttaggtaactttcccggaacttccgttaccaaccgttactaccggtaacgacgtaaacgggttcgtacggacccggtaacttaacggtaaacgtttacgtttaaccgaacttaaaaccgtttttacaaccg

SEQ ID NO: 310328 - DNA, 586 bp, Homo sapiens
  misc_feature: GZ8MTXP02GCJST.51.78.H01.1.454.CMB.2.raw
  modified_base (242)..(242): a, c, t, g, unknown or other
  misc_feature (242)..(242): n is a, c, g, or t
  modified_base (267)..(267): a, c, t, g, unknown or other
  misc_feature (267)..(267): n is a, c, g, or t
  modified_base (459)..(459): a, c, t, g, unknown or other
  misc_feature (459)..(459): n is a, c, g, or t
tcagcgatcgtatacacgaccggtgctcgatttagtgtgagtagtttgggtttgggcacgaccggtgctcgatttagtgtgagtagtttgggtttggggaggagtcagtctcagtcaggacacagcatggacatgagggtccccgctcagctcctggggctcctgctactctggctccgaggtgccagatgtgacatccagatgacccagtcctccatcctccctgtctgcatctgtagganacagagtcaccatcacttgccgggnaagtcagagcattagcagtcttaatttaaagttggtatacagacagaacgaccgaaagggaaaccgcccctaaactcccctagactctatgatcgctatacctaaagtttaggaaacggtcgggtacccagtactaaggttcaggtgacagtgatcgtaggacagtatttacactctacacctatacagacnggtgtacgacgtaccgtaagtaacgttactttacgaccttaaaacttactaacgttagacctaaaacgtaggttaacgttaactaccgtaacccctagacgtacctaccgtaacggtttaccggggg

SEQ ID NO: 310329 - DNA, 633 bp, Homo sapiens
  misc_feature: GZ8MTXP02F95C1.51.78.H01.1.454.CMB.2.raw
  modified_base (292)..(292): a, c, t, g, unknown or other
  misc_feature (292)..(292): n is a, c, g, or t
  modified_base (323)..(323): a, c, t, g, unknown or other
  misc_feature (323)..(323): n is a, c, g, or t
  modified_base (572)..(572): a, c, t, g, unknown or other
  misc_feature (572)..(572): n is a, c, g, or t
tcagcgatcgtatacacgaccggtgctcgatttagtgtgagtagtttgggtttgggcacgaccggtgctcgatttagtgtgagtagtttgggtttgggcacgaccggtgctcgatttagtgtgagtagtttgggtttggggaggagtcagtctcagtcaggacacagcatggacatgagggtccccgctcagctcctggggctcctgctactctggctccgaggtcgccagactgtgacatccagatcgacccagtcctccactccctccctgtctgctatcgtagtagganacagacgtccacctatctacgtcggccgganaacgtcagacgactaagttagactaagtacttaaagttttaaacgtggtatacgagtacaaggacgaaaccgaaacgggtaaacccgtacccctaaaccgtccgtagtaacttactagtgaactcgactaacgtaccgtaaagtttaacgggaaacggttcgggtaccctagtaacggtaaggtttcgaggtacggacgtagggtacgacgttcggagggtactaagtactttacacttactacactanccgagacgtagtacgtcgaacgtaacgtagtaacgttacttcgaacttaacgtacttaacg

SEQ ID NO: 310330 - DNA, 661 bp, Homo sapiens
  misc_feature: GZ8MTXP02I39ES.51.78.H01.1.454.CMB.2.raw
  modified_base (296)..(296): a, c, t, g, unknown or other
  misc_feature (296)..(296): n is a, c, g, or t
  modified_base (397)..(397): a, c, t, g, unknown or other
  misc_feature (397)..(397): n is a, c, g, or t
tcagcgatcgtatacacgaccggtgctcgatttagtgtgagtagtttgggtttgggggctctgggagaggagccccagccctgagattcccaggtgtttccattcagtgatcagcactgaacacagaggactcaccatggagttgggactgagctggtatttttccttttggcttaattttaaaaggtgtccagtgtgaagtgctactggtggagtcgtgggggagcctggtacagccgtggcaggtccctgagactctcctgtgcacgcctcgtgattctactttgattgattancgccatgcacgtcgggtccgacaacgccgtaccggaggggaacgggccgtgggtacggtcgggtctacgtacgtagttaggtggaattaggtcggtagtangtcctagcggtcgtacctggtaggtacggaaacgggtccgtaacttcacctatcctaccgacgaacgaacaaccgacctaaacgaacctccctagtactctagactaaaactgaaaccgtgtacgtaggaagacggtacgtacgggaacggtaaccgtaaccgggttcctttaagggttaacttaacccgtacggaaccggaaaccaaaaaccggaccggaaaacgggaccaaaacggaacggttccgtaacggtttaaaaccc

SEQ ID NO: 310331 - DNA, 529 bp, Homo sapiens
  misc_feature: GZ8MTXP02IDGTZ.51.78.H01.1.454.CMB.2.raw
  modified_base (187)..(187): a, c, t, g, unknown or other
  misc_feature (187)..(187): n is a, c, g, or t
  modified_base (283)..(283): a, c, t, g, unknown or other
  misc_feature (283)..(283): n is a, c, g, or t
  modified_base (295)..(295): a, c, t, g, unknown or other
  misc_feature (295)..(295): n is a, c, g, or t
  modified_base (308)..(308): a, c, t, g, unknown or other
  misc_feature (308)..(308): n is a, c, g, or t
  modified_base (345)..(345): a, c, t, g, unknown or other
  misc_feature (345)..(345): n is a, c, g, or t
  modified_base (360)..(360): a, c, t, g, unknown or other
  misc_feature (360)..(360): n is a, c, g, or t
  modified_base (371)..(371): a, c, t, g, unknown or other
  misc_feature (371)..(371): n is a, c, g, or t
  modified_base (379)..(379): a, c, t, g, unknown or other
  misc_feature (379)..(379): n is a, c, g, or t
tcagcgatcgtatacacgaccggtgctcgatttagtgtgagtagtttgggtttgggcacgaccggtgctcgatttagtgtgagtagtttgggtttgggcacgaccggtgctcgatttagtgtgagtagtttgggttggggaggagtcagtctcagtcaggacacagcatggacatgagggtccccgntcagctccgtggggctcctgctactctggctccgaggtgccagatgtgacatccagatgacccagtctccatcctccctgtctgcatctgtagganacagagtcaccntcacttggccggnaagtcagagcatagcagctattaaatgtatcagcagngaccaagggaaaccncccctaactcngactctangatgcataccaagtttaggaaagtcgggtacccagtctaaaggttcaagtggactagtgactcgtagggacagtattcactctacacctatcagctacgtgtacgcgtaacctggtaaagtacttttacgaccttaaactttacgtaacg

SEQ ID NO: 310332 - DNA, 696 bp, Homo sapiens
  misc_feature: GZ8MTXP02HL1EJ.51.78.H01.1.454.CMB.2.raw
  modified_base (313)..(313): a, c, t, g, unknown or other
  misc_feature (313)..(313): n is a, c, g, or t
tcagcgatcgtatacacgaccggtgctcgatttagtgtgagtagtttgggtttgggcacgaccggtgctcgatttagtgtgagtagtttgggtttgggcacgaccggtgctcgatttagtgtgagtagtttgggtttggggaggagtcagtctcagtcaggacacagcatggacatgagggtccccgctcagctcctggggctcctgctactctggctccgaggtgccagatgtgacatccagatcgacccagtcctccatccctccctgtctgcatctagtaggagacagagtcaccatcacttcgccgganaagtcagacgcaattacgctacgtacttaacgtttaaattggtactacgagacaaggacggaaacccgaaggggtaaaacccgccccccttaaacccgtccctagtacttactaagtgacttacggactaacgttaccttaaaggttttacgggaaaacgggttccggggtacccctaagttaacccgtaaacggggttttccaaaggggtttcggaccgtaggggtacggtacgtcggtaacggggaacttaacggtacttttacccgacttacccttaccgaaccctaagttcccgaaacgtcctaacgggttccgtacgtacccgtaaccgttagtaaaacgtttacggtttactacccttaaaacttttccgtaaaccg

SEQ ID NO: 310333 - DNA, 496 bp, Homo sapiens
  misc_feature: GZ8MTXP02I4LXC.51.78.H01.1.454.CMB.2.raw
  modified_base (306)..(306): a, c, t, g, unknown or other
  misc_feature (306)..(306): n is a, c, g, or t
  modified_base (345)..(345): a, c, t, g, unknown or other
  misc_feature (345)..(345): n is a, c, g, or t
  modified_base (357)..(357): a, c, t, g, unknown or other
  misc_feature (357)..(357): n is a, c, g, or t
  modified_base (436)..(436): a, c, t, g, unknown or other
  misc_feature (436)..(436): n is a, c, g, or t
  modified_base (464)..(464): a, c, t, g, unknown or other
  misc_feature (464)..(464): n is a, c, g, or t
  modified_base (474)..(474): a, c, t, g, unknown or other
  misc_feature (474)..(474): n is a, c, g, or t
tcagcgatcgtatacacgaccggtgctcgatttagtgtgagtagtttgggtttgggcacgaccggtgctcgatttagtgtgagtagtttgggtttgggcacgaccggtgctcgatttagtgtgagtagtttgggtttgggaggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccggnaagtcagagcattagcagctatttaaatggatcagcagngaccagggaaancccctaactctgatctatgatgacatccaatttgaaagtgggtacccatccaaggttcagtagcagtcgatcgtggacngatttcatctacaccatccagcaacgtntagcgtaacngaaacgttcttcactactactc

SEQ ID NO: 310334 - DNA, 628 bp, Homo sapiens
  misc_feature: GZ8MTXP02GTN1T.51.78.H01.1.454.CMB.2.raw
tcagcgatcgtatacacgaccggtgctcgatttagtgtgagtagtttgggtttggggggagaggagccccagccctgagattcccaggtgtttccattcagtgatcagcactgaacacagaggactcaccatggagttgggactgagctggtattttccttttggcttaattttaaaaggtgtccagtgtgaagtgctactggtggagtcgtgggggaggcctggtacagccgtggcaggtccctgagactctcctgtgcagcctctggattcacctttgatgattatgccatgccacgtgggtccgcaagccgtacgaggggaacggccgtgggagtgggtctcgacgttagttaggtaggaataggtgtaagtatagccttagtggcgtactcgtgtaggaacggggtcctattaccacctatccctacgaagacgaaccgaaccgaccaaacgaacccttcccgtagtaacttctacgaactaaaagtacgaaacgtacgtactaggaacgtaggacgtaggaacggaccgaccggttacctttagttaacttacgtacggacgaaaccaaaacgccgaaaaggaacaaacgacgtacgtacggtaactacgtaaagtttaaccg

SEQ ID NO: 310335 - DNA, 504 bp, Homo sapiens
  misc_feature: GZ8MTXP02I46H6.51.78.H01.1.454.CMB.2.raw
tcagcgatcgtatacacgaccggtgctcgatttagtgtgagtagtttgggtttgggcacgaccggtgctcgatttagtgtgagtagtttgggtttggggaggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctatttaaattggtatcagcagagaccagggaaacgcccctaactcccctgactctatgatgcatccaatttgaaagtgggtccatcaagttcagtgcagtgatctgggacagatttcactctcaccatcagcagtgtcgcgacctagaagtatttcgactaaacttactactcgttacaacagagttaacacgtacccctacacgctctacgtttcggg

SEQ ID NO: 310336 - DNA, 596 bp, Homo sapiens
  misc_feature: GZ8MTXP02F8VJG.51.78.H01.1.454.CMB.2.raw
  modified_base (286)..(286): a, c, t, g, unknown or other
  misc_feature (286)..(286): n is a, c, g, or t
tcagcgatcgtatacacgaccggtgctcgatttagtgtgagtagtttgggtttgggcacgaccggtgctcgatttagtgtgagtagtttgggtttgggcacgaccggtgctcgatttagtgtgagtagtttgggtttggggaggagtcagtctcagtcaggacacagcatggacatgagggtccccgctcagctccgtggggctcctgctactctggctccgaggtgccagatgtgacatccagatcgacccagtctccatccctccctgtctgcatctgtagganacagagtccaccatcacgttgccggacagtcagagctatagcagtcttaatttaatgtatcagcagagaaccaggggaaacctccccctaactcctagactactatgatacgactaacgtacctaagtttaagggaaacggttcggggtaccctaagttaccgaaggtttcgaggttagcgtagggtagacgttcggtaggggaacctaggttaactttccaacctttcctaacctacctagtcgaagaccgtagttcgcggtaccgtaacgtagtaaacgttactttacgaaccttaactttacgtaac

SEQ ID NO: 310337 - DNA, 510 bp, Homo sapiens
  misc_feature: GZ8MTXP02FFSYZ.51.78.H01.1.454.CMB.2.raw
  modified_base (343)..(343): a, c, t, g, unknown or other
  misc_feature (343)..(343): n is a, c, g, or t
tcagcgatcgtatacacgaccggtgctcgatttagtgtgagtagtttgggtttggggaggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctattaaatggtatcagcagagacagggaaagcccctaacctcctgatctatgatgcatccaatttggaaagtcggggtcccatcaaggttcagtggcagnggatcgtgggacagatttcactctcacatcagcagtgtgcgactagaagtatttgctaactttacactgtacaaactagacgttaacacgttaccccacacgctactactttcgggacggacgggaaccgaaggtacggaagatacaaaacgaactggacggctacg

SEQ ID NO: 310338 - DNA, 596 bp, Homo sapiens
  misc_feature: GZ8MTXP02IKN52.51.78.H01.1.454.CMB.2.raw
  modified_base (199)..(199): a, c, t, g, unknown or other
  misc_feature (199)..(199): n is a, c, g, or t
  modified_base (224)..(224): a, c, t, g, unknown or other
  misc_feature (224)..(224): n is a, c, g, or t
  modified_base (289)..(289): a, c, t, g, unknown or other
  misc_feature (289)..(289): n is a, c, g, or t
tcagcgatcgtatacacgaccggtgctcgatttagtgtgagtagtttgggtttggggaggagtcagtctcagtcaggacacagcatggacatgagggtccccgctcagctcctggggctcctgctactctggctccgaggtgccagatgtgacatccagatgacccagtctccatcctccctgtctgcatctgtagganacagagtcaccatcacttggccggnaagtcaagagctattagcagtacttaatttaaattggtatcagacagacgaccgaagggaaaccncccctaaacctcctagatctatgatgacattacctaagtttaggaaggttccggggtacccagtacgtaaaggttcgaggttcgcgtaggtggattcgtagggacagtacttcactctacaccatacagctagtgtcgacacgtagtaacgttatttcgaacttaacttactactacgtactaaacgtacgtaacgttacctaccgtacccctacgtacgtaccttacgtaccggtttacgggacgggtacgggaaaccgtaagggtacggaagtaacgaacgtaaaacgtacgtggtacggctacg

SEQ ID NO: 310339 - DNA, 608 bp, Homo sapiens
  misc_feature: GZ8MTXP02IPCY8.51.78.H01.1.454.CMB.2.raw
  modified_base (199)..(199): a, c, t, g, unknown or other
  misc_feature (199)..(199): n is a, c, g, or t
  modified_base (274)..(274): a, c, t, g, unknown or other
  misc_feature (274)..(274): n is a, c, g, or t
tcagcgatcgtatacacgaccggtgctcgatttagtgtgagtagtttgggtttggggaggagtcagtctcagtcaggacacagcatggacatgagggtccccgctcagctcctggggctcctgctactctggctccgaggtgccagatgtgacatccagatgacccagtctccatcctccctgtctgcatctgtagganacagagtcaccatcacttgccggcaagtcagagcattagcagctatttaaatgtatcagcagagacagggaaacnccctaacctcctagatctatgatgacatacctaagtttaggaaaaggtcggggtacccagtacgtaaggttcaggttggctaagtggatcgtagggacagtattcactcacacatcagcagtgtcgacgtactagaattagtttacgacttaacgttactacgtcgttacaaacgtagtaacgttaaccaacgttaccccctacgtaacgtccgttaccgttaacccgtttacgggggaaccgggttaacggggaaaccccggtaaaggggtcgggtaaaacggtaacgttaaaccgaaaaccggtaaacgttcggtacgggtaccttaaccgg

SEQ ID NO: 310340 - DNA, 552 bp, Homo sapiens
  misc_feature: GZ8MTXP02HHSIC.51.78.H01.1.454.CMB.2.raw
  modified_base (276)..(276): a, c, t, g, unknown or other
  misc_feature (276)..(276): n is a, c, g, or t
tcagcgatcgtatacacgaccggtgctcgatttagtgtgagtagtttgggtttggggaggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctattaaattggtatcagcagagaccagggaacncccctaacctcctgatctatgatgacatacctaagtttaggaaagtccggggtaccctagtacgtaaaggtttcaaggttggctaggtcggattcgtaggggacagtacttacactctacaccatacagcagtgtcgacgtacctagagttatttgactaacttactactagtacaactagacttaacaccgtaaccctcaacgtctacacgtttcggacggtaacgggacccaagggtacgaagacgtaacgaaacgaacgtggtacggactacg

SEQ ID NO: 310341 - DNA, 537 bp, Homo sapiens
  misc_feature: GZ8MTXP02JSDMK.51.78.H01.1.454.CMB.2.raw
  modified_base (326)..(326): a, c, t, g, unknown or other
  misc_feature (326)..(326): n is a, c, g, or t
  modified_base (339)..(339): a, c, t, g, unknown or other
  misc_feature (339)..(339): n is a, c, g, or t
  modified_base (438)..(438): a, c, t, g, unknown or other
  misc_feature (438)..(438): n is a, c, g, or t
tcagcgatcgtatacacgaccggtgctcgatttagtgtgagtagtttgggtttgggcacgaccggtgctcgatttagtgtgagtagtttgggtttggggaggagtcagtctcagtcaggacacagcatggacatgagggtccccgctcagctcctggggctcctgctactctggctccgaggtgccagatgtgacatccagatgacccagtctccatcctccctgtctgcatctggtaggagacagagtcaccatcacttggccggcaagtcagagctaattagcagtcttaatttaaatggtatcagcagagaccgagggaaccncccctaactcccngatcatgatgctatactaagtttaggaaacggttcggtacccagtacgtaagtcagtggactaggtcgagtcgtaggacagtactttcgactctcaacntacagcaggtgtcgcgaactagaagtatttcgacttacttaactctagactaacgagtacgtaacaccgtacccagacgtcctacgtacgttaccgggg

SEQ ID NO: 310342 - DNA, 649 bp, Homo sapiens
  misc_feature: GZ8MTXP02IMHDM.51.78.H01.1.454.CMB.2.raw
  modified_base (201)..(201): a, c, t, g, unknown or other
  misc_feature (201)..(201): n is a, c, g, or t
  modified_base (290)..(290): a, c, t, g, unknown or other
  misc_feature (290)..(290): n is a, c, g, or t
  modified_base (414)..(414): a, c, t, g, unknown or other
  misc_feature (414)..(414): n is a, c, g, or t
tcagcgatcgtatacacgaccggtgctcgatttagtgtgagtagtttgggtttggggaggagtcagtctcagtcaggacacagcatggacatgagggtcccccgctcagctcctggggctcctgctactctggctccgaggtgccagatgtgacatccagatgacccagtcctccatcctccctgtctgcatctgtagganacagagtcaccatcacttggccggacaagtcagagcattagctagacttaatttaaagttggtatcagacagacgaccgaagggaaccncccctaacctcctagatctatgatgacatacctaagtttagggaaacgtccggggtacccagtacgtaaggttcaggtggcgtagtggatcgtaggggactagtacttccactacctcaacctnttaccgagctaggtcgtcgaccgtactagtaagttattttacgacttaacgtttactaactacgtacaaacgtacgtaacgttacctaaccgtacccctacgtacgtaccttacccgtaccggtttaccggggaaccggggtaaccgggtaaacccggtaaggggtacgggtaaaacgtaacgtaaacccgtaaaaaccggaacggtttcgggtaccggggtaccttaacccggg

SEQ ID NO: 310343 - DNA, 545 bp, Homo sapiens
  misc_feature: GZ8MTXP02F8CQ6.51.78.H01.1.454.CMB.2.raw
  modified_base (310)..(310): a, c, t, g, unknown or other
  misc_feature (310)..(310): n is a, c, g, or t
  modified_base (366)..(366): a, c, t, g, unknown or other
  misc_feature (366)..(366): n is a, c, g, or t
  modified_base (524)..(524): a, c, t, g, unknown or other
  misc_feature (524)..(524): n is a, c, g, or t
tcagcgatcgtatacacgaccggtgctcgatttagtgtgagtagtttgggtttgggcacgaccggtgctcgatttagtgtgagtagtttgggtttgggcacgaccggtgctcgatttagtgtgagtagtttgggtttggggaggagtcagtctcagtcaggacacagcatggacatgagggtccccgctcagctcctggggctcctgctactctggctccgaggtgccagatgtgacatccagatgacccagtctccatccctccctgtctgcatctgtaggagacagagtcaccatcacttggccgganaagtcaagagcatagcagtcttaatttaaatgtatcagcagcgaccaggggaaacnccccctaactctagatctatgatgacatacctaagtttcggaaaacgtcggggtacccagtaccgtaaaggttcaggtgactagggtgtaactcgtagggactagtactttacacttctacaccatcaagctagtcgtgacgaaccgtagaaacgttntttacgacttaacttactacg

SEQ ID NO: 310344 - DNA, 571 bp, Homo sapiens
  misc_feature: GZ8MTXP02FSSNB.51.78.H01.1.454.CMB.2.raw
  modified_base (283)..(283): a, c, t, g, unknown or other
  misc_feature (283)..(283): n is a, c, g, or t
  modified_base (311)..(311): a, c, t, g, unknown or other
  misc_feature (311)..(311): n is a, c, g, or t
  modified_base (320)..(320): a, c, t, g, unknown or other
  misc_feature (320)..(320): n is a, c, g, or t
  modified_base (375)..(375): a, c, t, g, unknown or other
  misc_feature (375)..(375): n is a, c, g, or t
tcagcgatcgtatacacgaccggtgctcgatttagtgtgagtagtttgggtttgggcacgaccggtgctcgatttagtgtgagtagtttgggtttgggcacgaccggtgctcgatttagtgtgagtagtttgggtttggggaggagtcagtctcagtcaggacacagcatggacatgagggtccccgctcagctcctggggctcctgctactctggctccgaggtgccagatgtgacatccagatcgacccagtctccatcctccctgtctgcatctgtaganacagagtcaccatccacgttgcccgganaagtcaagngctattacgctaagtcttaatttaaatgtaatcagcaagacgacaaggggaaacnccccctaactcctagacttctatcgatgaccattacccaagtttacgggaaaggtcgggtaaccctagtaccgtaaaggttcaaggtggactaaggtggtaactcggtagggactagtctttacactctacacctatccgagcaggttgacgaccgtaacgtagtaagttacttttacgactaacctttactaacg

SEQ ID NO: 310345 - DNA, 668 bp, Homo sapiens
  misc_feature: GZ8MTXP02G0ZYX.51.78.H01.1.454.CMB.2.raw
tcagcgatcgtatacacgaccggtgctcgatttagtgtgagtagtttgggtttgggggctctgggagaggagccccagccctgagattcccaggtgtttccattcagtgatcagcactgaacacagaggactcaccatggagttgggactgagctggattttccttttggctattttaaaaggtgtccagtgtgaagtgctactggtggagtcgtgggggagcctggtacagcctggcaggtccctgagactctcctgtcgcagcctcgtggtacttccacctttgatgtattatgccatgctacgtcgggtccgacaacgcctaccggaggggaacgggccgtgggaggtggggtctacgtacgtattaggtaggtaataggtggtagtatcgctagtcgacgtactcgtgtaggaacgggtccgtattaccaaccgtatcctaccgacggaacgaaccgaaccgaccaaacgtaaacccttccccgtaaggtacctacgtacgaacctaaaagttacggaaactacggttacgtaaggaaggtaacgtaccgtagggaaacggtaaccgtaccgggttaccctttaggtaacctttacggacgaacccgaaacgaaaaaccggcccgaaaaggacccaaacgtacggtaccgttacggttaaaccc

SEQ ID NO: 310346 - DNA, 658 bp, Homo sapiens
  misc_feature: GZ8MTXP02HEU02.51.78.H01.1.454.CMB.2.raw
  modified_base (333)..(333): a, c, t, g, unknown or other
  misc_feature (333)..(333): n is a, c, g, or t
tcagcgatcgtatacacgaccggtgctcgatttagtgtgagtagtttgggtttgggcacgaccggtgctcgatttagtgtgagtagtttgggtttggggaggagtcagtctcagtcaggacacagcatggacatgagggtccccgctcagctccgtggggctcctgctactctggctccgaggtgccagatgtgacatccagatgacccagtctccatccctcctgtctgcatctgtaggagacagagtcacatcacgttcgccggacaagtcaagagacattagcagtcttaatttaaatggtatcgagacagacgaccgaaggggaaaccnccccgtaactccccgtagatactatgatcgctatactaaagttaggaaacggttcggggtaccctaagtacgtaaaggttaccgaggtagggcgtaaggtggtacgtacggagggtaaccgtaggttactttaccgaccttaccgtacctaacctaacgtaccgtaagtaccgtaggttaacggtcggtaaccgtaccgtaagtaaaggttacttttacgaacttaaactttaacgttaaaccgttacggtaacaaacgtaacgtaacgttaaccgtaacttaaccccgtactaacggtcctaccgttaccggtttaaccggggg

SEQ ID NO: 310347 - DNA, 617 bp, Homo sapiens
  misc_feature: GZ8MTXP02GSKNA.51.78.H01.1.454.CMB.2.raw
tcagcgatcgtatacacgaccggtgctcgatttagtgtgagtagtttgggtttggggggagaggagccccagccctgagattcccaggtgtttccattcagtgatcagcactgaacacagaggactcaccatggagttgggactgagctggattttccttttggctattttaaaaggtgtccagtgtgaagtgctactggtggagtcgtgggggagcctggtacagcctggcaggtccctgagactctcctgtgcagcctctggattcacctttgatgattatgccatgcacgtcgggtccgcaagcctccgaggggaacggccgtgggacggtgggtctcgtacgttattaggttggaagttaggtaggttagtatagcctaagtggccggactcgtgaggaacggggcctagttccaccatcctccgagacgaaccaacggaccaaacgacctccccgtgtaactctagacctaaaagtcgaaccgtagtaccgtaggaagacgacgtaggaacgggtaaccgaccggggttctttagttagtttaccgaggaccgaaaccgaaaacgcccgaaaggaaccaaacgcgtacgtacggtactacctaagttaacgg

SEQ ID NO: 310348 - DNA, 657 bp, Homo sapiens
  misc_feature: GZ8MTXP02HXUHQ.51.78.H01.1.454.CMB.2.raw
  modified_base (226)..(226): a, c, t, g, unknown or other
  misc_feature (226)..(226): n is a, c, g, or t
  modified_base (255)..(255): a, c, t, g, unknown or other
  misc_feature (255)..(255): n is a, c, g, or t
  modified_base (258)..(258): a, c, t, g, unknown or other
  misc_feature (258)..(258): n is a, c, g, or t
tcagcgatcgtatacacgaccggtgctcgatttagtgtgagtagtttgggtttggggggagaggagccccagccctgagattcccaggtgtttccattcagtgatcagcactgaacacagaggactcaccatggagttgggactgagctggattttccttttggctattttaaaaggtgtccagtgtgaagtgctactggtggagtccgggtggggcgtcgtgacncgcgtgcgacgtcagacgtctcctcgtgngcncgcctgtgtctaccttcgttagagtatattgtcgactagtccgacgtacggtccggggccgaacgacgtccgtacgggaagggaccggtcggtagggtagggttcggtctacgtaacgttagttaggtagtagttaggttaggttagtagtcgtacgttagtcgggtacgtacgttgtaggtagggaccggtcttaccctcgactacctccaacgaaggacaaaaccgacccgaactaaacgtcccttcgtaagtccctgtaaccaataacgacgacgtacgtgaggaagtcctggaaggaccgaacgtccgtttcgttaagttaaacctcgacgaaccgaaaacgaaccgaccgtaagaaccgaacgtcgtacgttacgtactaagttacgtaaacgg

SEQ ID NO: 310349 - DNA, 600 bp, Homo sapiens
  misc_feature: GZ8MTXP02H2IR7.51.78.H01.1.454.CMB.2.raw
  modified_base (203)..(203): a, c, t, g, unknown or other
  misc_feature (203)..(203): n is a, c, g, or t
  modified_base (229)..(229): a, c, t, g, unknown or other
  misc_feature (229)..(229): n is a, c, g, or t
  modified_base (357)..(357): a, c, t, g, unknown or other
  misc_feature (357)..(357): n is a, c, g, or t
  modified_base (399)..(399): a, c, t, g, unknown or other
  misc_feature (399)..(399): n is a, c, g, or t
tcagcgatcgtatacacgaccggtgctcgatttagtgtgagtagtttgggtttggggaggagtcagtctcagtcaggacacagcatggacatgacgggtccccgctcagctccgtggggctcctgctactctggctccgaggtgccagatgtgacatccagatcgacccagtcctccatccctcctgtctgcatctgtagganacagagtcacatcacttggccggganaagtcagagactatagcagacttaatttaaatgtatcagacagagaccgaagggaaacgacccctaacctcctagatctatgatgacatactaattaggaaagtcgggaccagtcgaagttcagtcgnagtagatcgtagggactagtactttcaactctacaaccgtancgagtacgagtgacgtacgtaacgtagtaagtttacgttacgtaacttaacttactacgtagtaacaaacgtacgtaactaccgtaaccgtacccacgtaccgtacgttacgtaccggttacgggaaccgggtaaacgggtaaccgaagggtacgaaacgtaaacgaaaccgtaaaacgtacgttacggtacgtacgtacg

SEQ ID NO: 310350 - DNA, 547 bp, Homo sapiens
  misc_feature: GZ8MTXP02GALF2.51.78.H01.1.454.CMB.2.raw
  modified_base (306)..(306): a, c, t, g, unknown or other
  misc_feature (306)..(306): n is a, c, g, or t
  modified_base (315)..(315): a, c, t, g, unknown or other
  misc_feature (315)..(315): n is a, c, g, or t
  modified_base (368)..(368): a, c, t, g, unknown or other
  misc_feature (368)..(368): n is a, c, g, or t
tcagcgatcgtatacacgaccggtgctcgatttagtgtgagtagtttgggtttgggcacgaccggtgctcgatttagtgtgagtagtttgggtttgggcacgaccggtgctcgatttagtgtgagtagtttgggtttggggaggagtcagtctcagtcaggacacagcatggacatgagggtccccgctcagctcctggggctcctgctactctggctccgaggtgccagatgtgacatccagatgacccagtctcatccctcctgtctgcatctgtaggagacagagtcaccatcacttgccggnaagtcaganctattagcaagtcttaatttaaatggtaatcagcagacgaccgaagggaaacncccctaactctagactctatgatcgacatacctaagtttacggaaaggttcgggtacccagtacgtaaaggttcaggtgacaggtagactcgtagggactaacgtacttacactctacgactatacagctagtcgtcgacgtaacgtaggaacttacgtttacgactaacttactaacg

SEQ ID NO: 310351 - DNA, 609 bp, Homo sapiens
  misc_feature: GZ8MTXP02JNKAM.51.78.H01.1.454.CMB.2.raw
  modified_base (556)..(556): a, c, t, g, unknown or other
  misc_feature (556)..(556): n is a, c, g, or t
tcagcgatcgtatacacgaccggtgctcgatttagtgtgagtagtttgggtttgggggggagaggagccccagccctgagattcccaggtgtttccattcagtgatcagcactgaacacagaggactcaccatggagttgggactgagctggattttcctttggcttaattttaaaaggtgtccagtgtgaagtgctactggtggagtcgtgggggagcctggtacagcctggcaggtcctgagctctcctgtgcagcctctggattctacttgatgattatgccatgctacgtcggggtccgcaacggcctcggaaggggaacggccgtagggacggttgggtctcgtacgttattaggtggaatggtagtagtatacgcctagtcggcggacttcggtgtaggaacggggcctattccgacctacgttcctaccgaggaaccgaaacctaaccggaacccaaaacgtacctccccgtagttaactcgtacgaacaaaagttgaaaccgtagtcgtaggacgacgcgtaggacgacgacggtcttagtacttacncgacgaaccaaacgccgaagaacaacgacgctaggtactaactacgttaacgg

SEQ ID NO: 310352 - DNA, 529 bp, Homo sapiens
  misc_feature: GZ8MTXP02FOY41.51.78.H01.1.454.CMB.2.raw
  modified_base (321)..(321): a, c, t, g, unknown or other
  misc_feature (321)..(321): n is a, c, g, or t
  modified_base (460)..(460): a, c, t, g, unknown or other
  misc_feature (460)..(460): n is a, c, g, or t
tcagcgatcgtatacacgaccggtgctcgatttagtgtgagtagtttgggtttgggcacgaccggtgctcgatttagtgtgagtagtttgggtttggggaggagtcagtctcagtcaggacacagcatggacatgagggtccccgctcagctcctggggctcctgctactctggctccgaggtgccagatgtgacatccagatgacccagtctccatcctccctgtcttcatctgtaggagacagagtcaccatcacttgccggcaagtcagagcattagcagtctaatttaaatggtatcagcagagaccgagggaaacnccctaacctctagatctatgatgactatacctaaagtttagggaaaagttcggggtacccagtaccgtaaaggttcaggtgcaggtgatcgtgggactagtacttcactcacaccatcagcagtgtgacgactgaagtntttagactaacttatactagtacaactagtagttaccaacgtaccctcacgtctactacgttcggacgg

SEQ ID NO: 310353 - DNA, 532 bp, Homo sapiens
  misc_feature: GZ8MTXP02GA7V2.51.78.H01.1.454.CMB.2.raw
  modified_base (284)..(284): a, c, t, g, unknown or other
  misc_feature (284)..(284): n is a, c, g, or t
  modified_base (307)..(307): a, c, t, g, unknown or other
  misc_feature (307)..(307): n is a, c, g, or t
  modified_base (358)..(358): a, c, t, g, unknown or other
  misc_feature (358)..(358): n is a, c, g, or t
  modified_base (387)..(387): a, c, t, g, unknown or other
  misc_feature (387)..(387): n is a, c, g, or t
tcagcgatcgtatacacgaccggtgctcgatttagtgtgagtagtttgggtttgggcacgaccggtgctcgatttagtgtgagtagtttgggtttgggcacgaccggtgctcgatttagtgtgagtagtttgggtttggggaggagtcagtctcagtcaggacacagcatggacatgagggtccccgctcagctcctggggctcctgctactctggctccgaggtgccagatgtgacatccagatgacccagtctccatccctccctgtctgcatctgtagganacagagtcacatcacttgccggnaagtcagagcatagcagctaattaaatgtatcagcagagacaagggaaacncccctaaactcctagactctatgaatcgntataccaagtttggaaaagtcgggaccctagtacgaaagttcgagtgactaggtgatcgtagggactaggtatttccactactcacatacgaagctacgtgtcgacgtaaccgtgtaaacgtatttacgactaaacttactaacg

SEQ ID NO: 310354 - DNA, 674 bp, Homo sapiens
  misc_feature: GZ8MTXP02FYGCO.51.78.H01.1.454.CMB.2.raw
tcagcgatcgtatacacgaccggtgctcgatttagtgtgagtagtttgggtttgggcacgaccggtgctcgatttagtgtgagtagtttgggtttggggaggagtcagtctcagtcaggacacagcatggacatgagggtccccgctcagctcctggggctcctgctactctggctccgaggtgccagatgtgacatccagatcgacccagtcctccatccctccctgtctgcatctggtaggagacagacgtcaccatcacgttggccgggacaaggtcaagagctattagcagtacttaatttaaagtggtatcgagcagacgaaccgaagggaaacctcccctaactcccgtgactctatgatcgctattacctaaagtttacgggaacggttcggggtaccctaagttaccgtaaagggtttccgaaggtacgggtacgtaagggttacggtagttacggtaggggtaactacggttacttttaccgaccttactacccaacctacgttacgaacgtaccgtagtcggtacgtaaccgtaccgttaaggtaaagtttacgtttacgaacttaaacgtttaccttaacgtacgtaacgtaaacgtaggttaaacttaaccgtaacccgtacccttacgaccggtaccttacccgttacggttacccggggg

SEQ ID NO: 310355 - DNA, 640 bp, Homo sapiens
  misc_feature: GZ8MTXP02GL9UT.51.78.H01.1.454.CMB.2.raw
  modified_base (574)..(574): a, c, t, g, unknown or other
  misc_feature (574)..(574): n is a, c, g, or t
tcagcgatcgtatacacgaccggtgctcgatttagtgtgagtagtttgggtttggggggagaggagccccagccctgagattcccaggtgtttccattcagtgatcagcactgaacacagaggactcaccatggagttgggactgagctggtattttccttttggcttattttaaaaggtgtccagtgtgaagtgcttactggtggagtcgtgggggagcctggtacagcctggcaggtccctgagactctcctgtgcagcctctggacttcacctttgatgtattatgccatcgcacgtcggggtccgcaagccgtccggaaggggaacgggtccgtggggtaggtcgggtcctacgtaacgttagttaggttaggaaagttaggttgggtaagtagtacgacccttaagtcggaccggtacttcgtagggtaggaaacgggggtcctaacttccgaaccctatccctaccgaaggaacgaaccaaccgaccaaacgaacctccctagtactctagacaaagtacgaacagtctaggagtagcgtaggagacgaccggtcttagtatttacgngaccgaacgaaaacgccgaaacggaacgaaacgtacgacgttacggtaactacgtaaacgttaacg

SEQ ID NO: 310356 - DNA, 519 bp, Homo sapiens
  misc_feature: GZ8MTXP02I405I.51.78.H01.1.454.CMB.2.raw
  modified_base (199)..(199): a, c, t, g, unknown or other
  misc_feature (199)..(199): n is a, c, g, or t
  modified_base (371)..(371): a, c, t, g, unknown or other
  misc_feature (371)..(371): n is a, c, g, or t
  modified_base (400)..(400): a, c, t, g, unknown or other
  misc_feature (400)..(400): n is a, c, g, or t
tcagcgatcgtatacacgaccggtgctcgatttagtgtgagtagtttgggtttggggaggagtcagtctcagtcaggacacagcatggacatgagggtccccgctcagctcctggggctcctgctactctggctccgaggtgccagatgtgacatccagatgacccagtctccatcctccctgtctgcatctgtagganacagagtcaccatcacttgccgggcaagtcagagcattagcagctatttaaattgtatcagcagagaccagggaaacgcccctaacctcctgatctatgatgcatacctaattggaaagtcggggtccagtcaaggttcaggtgcagtggatcgtgggacagatttcactcncaccatcagcagtgtgacgactgaacgtntttacgactaacttactactgtacaacagtaacgttacacgtacccctcacgtctactacgtttcgggacggtacgggaccgaaggtggaagacgtaacaaaacgactggtcgactacg

SEQ ID NO: 310357 - DNA, 581 bp, Homo sapiens
  misc_feature: GZ8MTXP02J0KAD.51.78.H01.1.454.CMB.2.raw
  modified_base (309)..(309): a, c, t, g, unknown or other
  misc_feature (309)..(309): n is a, c, g, or t
tcagcgatcgtatacacgaccggtgctcgatttagtgtgagtagtttgggtttgggggctctgggagaggagccccagccctgagattcccaggtgtttccattcagtgatcagcactgaacacagaggactcaccatggagttgggactgagctggattttccttttggcttattttaaaaggtgtccagtgtgaagtgctactggtggagtcgtgggggagcctggtacagcctggcaggtccctgagactctcctgtgcagcctctggattcacctttgatgattatgccatgcacgtgggtccgnaagctccgagggaggcctggagtgggtctcgacgttattaggtgaattggtggtattatgcctagtcgcggactcgtggtaggaaacgggtccgtattccgtaaccacgttcctccgagaacgaaccgaaccgaccaaacgaacctccctacgtatctagacctaaatgaaccgtagtcgtagacgagcgtacggacggacgtaccgtccgttacgttacgttacgcgaccgaacaaaacgacccgaaggacaacgacgacgtacggtaccg

SEQ ID NO: 310358 - DNA, 633 bp, Homo sapiens
  misc_feature: GZ8MTXP02H94PH.51.78.H01.1.454.CMB.2.raw
  modified_base (608)..(608): a, c, t, g, unknown or other
  misc_feature (608)..(608): n is a, c, g, or t
tcagcgatcgtatacacgaccggtgctcgatttagtgtgagtagtttgggtttggggggagaggagccccagccctgagattcccaggtgtttccattcagtgatcagcactgaacacagaggactcaccatggagttgggactgagctggtattttccttttggctattttaaaaggtgtccagtgtgaagtgctactggtggagtcgtgggggaggcctggtacagcctggcaggtccctgagactctcctgtgcagcctcgtggtacttctacctttgatgtattatgccagtgcacggttggggcccgacaagcctaccgaggggacggcgtggaggtcgggtctcgtaacgttagttaggttaggaattaggtaggtagtatacgtcctagtggaccggtactccgtagtacgggaacgggtccgtattacccaccattcccgtaccgaaggaaccgaacaaccggaccaaacgaacccttcccgtagtaactctacgactaaaatcggaacagttcgaagagacggactaggaacgtaccgtaccggtacgttgttaacgtacctaggaaccaaaccgaaaacgcccgaaaggtccaaacgngtacgtagtacctaataacgtaccg

SEQ ID NO: 310359 - DNA, 676 bp, Homo sapiens
  misc_feature: GZ8MTXP02HPTCO.51.78.H01.1.454.CMB.2.raw
  modified_base (284)..(284): a, c, t, g, unknown or other
  misc_feature (284)..(284): n is a, c, g, or t
  modified_base (424)..(424): a, c, t, g, unknown or other
  misc_feature (424)..(424): n is a, c, g, or t
tcagcgatcgtatacacgaccggtgctcgatttagtgtgagtagtttgggtttgggcacgaccggtgctcgatttagtgtgagtagtttgggtttgggcacgaccggtgctcgatttagtgtgagtagtttgggtttggggaggagtcagtctcagtcaggacacagcatggacatgagggtccccgctcagctcctggggctcctgctactctggctccgaggtgccagatgtgacatccagatgacccagtctccatccctccctgtctgcatctgtagganacagtagtcaccatcacgttcggaccggacaaagtcaagacgctaaatagacagtacttaatttaaaagtgtatcagacgaagacgaaccgaacgggaaaacccgtccccccttaaacgtccgtagaaacttccgttaanggtaatcgactacgttactaaaggtttacggaaacggtcgggtaccctaagtacgtaaacggttcagggttcgacgtagggtacggtaacgttcggtacgggtaactacggttactttacccaacttcccctaacacccctaaagttaccaaaggtccgttagggttaccgtaccggtaccggttaacccttaaggttaaaccggttttaactttaccggtaaacccgttaaaactttttaccgtaaaccgg

SEQ ID NO: 310360 - DNA, 609 bp, Homo sapiens
  misc_feature: GZ8MTXP02I4ZP2.51.78.H01.1.454.CMB.2.raw
  modified_base (315)..(315): a, c, t, g, unknown or other
  misc_feature (315)..(315): n is a, c, g, or t
  modified_base (389)..(389): a, c, t, g, unknown or other
  misc_feature (389)..(389): n is a, c, g, or t
tcagcgatcgtatacacgaccggtgctcgatttagtgtgagtagtttgggtttgggcacgaccggtgctcgatttagtgtgagtagtttgggtttgggcacgaccggtgctcgatttagtgtgagtagtttgggttggggaggagtcagtctcagtcaggacacagcatggacatgagggtccccgctcagctccgtggggctcctgctactctggctccggaggtgccagatgtgacatccagatcgacccagtcctccatccctccctgtctgcatctgtaggagacagacgtcaccatcacttcggccgganaaagtcaagagcaagttagccagtacttaatttaaagtggtatacgagcgaagacgaccgaaacggggaaaccnccccctaacctccgtagtacttctagtagatcgactactaccgtaagtttaggaaacggttccgggtaccagttaaccgtaaaggtttaccgaggttacggcgtaagggtagacgttacggtaacgggactaagtactttacacgttcctacgacctatcgacgtacgagttcgacgacgtaacgtaggaactttacttacgaaccttaacgttactacg

SEQ ID NO: 310361 - DNA, 577 bp, Homo sapiens
  misc_feature: GZ8MTXP02ICGCK.51.78.H01.1.454.CMB.2.raw
  modified_base (285)..(285): a, c, t, g, unknown or other
  misc_feature (285)..(285): n is a, c, g, or t
  modified_base (404)..(404): a, c, t, g, unknown or other
  misc_feature (404)..(404): n is a, c, g, or t
  modified_base (438)..(438): a, c, t, g, unknown or other
  misc_feature (438)..(438): n is a, c, g, or t
  modified_base (461)..(461): a, c, t, g, unknown or other
  misc_feature (461)..(461): n is a, c, g, or t
tcagcgatcgtatacacgaccggtgctcgatttagtgtgagtagtttgggtttgggcacgaccggtgctcgatttagtgtgagtagtttgggtttgggcacgaccggtgctcgatttagtgtgagtagtttgggtttggggaggagtcagtctcagtcaggacacagcatggacatgagggtccccgctcagctcctggggctcctgctactctggctccgaggtgccagatgtgacatccagatgacccagtcctccactcctccctgtctgcatctgtagganacagacgtcaccatccacttcggccggacaagtcagagctatacgacagtacttaatttaaatgtatcagcaagacgaaccgaaagggaaacctacccccgtaaactccgatactctangatgacattacaagttcgaaaggtcggtacctanacgtaagttcaggttgactaggngtactcgaggaactagttactttccgaacttcctacaacctatacaaccggtactagttcggtacaccggtaaccttagtaaacgtttcgtttacgaaccttaactttacgtaccg

SEQ ID NO: 310362 - DNA, 655 bp, Homo sapiens
  misc_feature: GZ8MTXP02FNGIY.51.78.H01.1.454.CMB.2.raw
tcagcgatcgtatacacgaccggtgctcgatttagtgtgagtagtttgggtttgggcacgaccggtgctcgatttagtgtgagtagtttgggtttggggaggagtcagtctcagtcaggacacagcatggacatgagggtccccgctcagctcctggggctcctgctactctggctccgaggtgccagatgtgacatccagatgacccagtctccatcctcctgtctgcatctgtaggagacagagtcaccatcactgccgggcaagtcagagcattagcagtcttaatttaatgtatcagcagagaccgaaggaacacccctaactccctagtactctatgatgcactacctaaagtttagggaaagttcggggtacccataccgtaaggttaccgaaggtcggacgtagggtacggtaacgttcggttaacggggactaaacggttacttttaccgtaaaccttccctaccctaacccgtaacttacccgaaaggtaccgtaaggttcggtacggtaccgttacccgtaagggtaaacgttaacgttttacggaccttaaactttaaaccttacgttaacgtacctaaacgtacgttaaacgttaaccgtaaccgtacccttacgtaccgtactaccgtacggtttaccgggg

SEQ ID NO: 310363 - DNA, 533 bp, Homo sapiens
  misc_feature: GZ8MTXP02JQH2X.51.78.H01.1.454.CMB.2.raw
  modified_base (281)..(281): a, c, t, g, unknown or other
  misc_feature (281)..(281): n is a, c, g, or t
  modified_base (408)..(408): a, c, t, g, unknown or other
  misc_feature (408)..(408): n is a, c, g, or t
tcagcgatcgtatacacgaccggtgctcgatttagtgtgagtagtttgggtttggggaggagtcagtctcagtcaggacacagcatggacatgagggtccccgctcagctcctggggctcctgctactctggctccgaggtgccagatgtgacatccagatgacccagtctccatcctcctgtctgcatctgtaggagacagagtcaccatcacttggccgggcaagtcagagctattagcagctatttaaattggtatcagcagagaccgaagggaaacncccctaacctcctagatctatgatgcatacctaagttaggaaagtcggggtaccatcaaggttcagtgcagtggatcgagggacagtattcactctcacatcatcagtgtcgcgaccgtagaagttntttacgacttaacttactatgtacaatgaacgttacctacgtaccctcgacgtcctcgtaacgttcgggacggacgggtaccgaaggtagaagtacgtaacgaaacgtacgtaggtcgactaccg

SEQ ID NO: 310364 - DNA, 564 bp, Homo sapiens
  misc_feature: GZ8MTXP02G84TI.51.78.H01.1.454.CMB.2.raw
  modified_base (241)..(241): a, c, t, g, unknown or other
  misc_feature (241)..(241): n is a, c, g, or t
  modified_base (336)..(336): a, c, t, g, unknown or other
  misc_feature (336)..(336): n is a, c, g, or t
  modified_base (345)..(345): a, c, t, g, unknown or other
  misc_feature (345)..(345): n is a, c, g, or t
  modified_base (355)..(355): a, c, t, g, unknown or other
  misc_feature (355)..(355): n is a, c, g, or t
  modified_base (358)..(358): a, c, t, g, unknown or other
  misc_feature (358)..(358): n is a, c, g, or t
  modified_base (389)..(389): a, c, t, g, unknown or other
  misc_feature (389)..(389): n is a, c, g, or t
  modified_base (395)..(395): a, c, t, g, unknown or other
  misc_feature (395)..(395): n is a, c, g, or t
tcagcgatcgtatacacgaccggtgctcgatttagtgtgagtagtttgggtttgggcacgaccggtgctcgatttagtgtgagtagtttgggtttggggaggagtcagtctcagtcaggacacagcatggacatgagggtccccgctcagctcctggggctcctgctactctggctccgaggtgccagatgtgacatccagatgacccagtctccatccctcctgtctgcatctgtagganacagacgtcaccatcacttgccgggacaaagtcaagagcagtttagcagtcttaaatttaaagttggtaatcagcaagacgacaaggggaaaccncccctaacncctgatcatnatncatcaattgaagtcggaccatcagtcagcgnagtgancgtggacagtcttacactcactacatcagactaggtctacggactaccgtaagtaagttagttttacggaccttaaactttacctaacgttcgtaacctaaaacgtacgtaacgttaaaccctaccgttaaacccctgaacgttaccctacggtacgtttacccggggg

SEQ ID NO: 310365 - DNA, 582 bp, Homo sapiens
  misc_feature: GZ8MTXP02JRU2S.51.78.H01.1.454.CMB.2.raw
  modified_base (334)..(334): a, c, t, g, unknown or other
  misc_feature (334)..(334): n is a, c, g, or t
  modified_base (436)..(436): a, c, t, g, unknown or other
  misc_feature (436)..(436): n is a, c, g, or t
tcagcgatcgtatacacgaccggtgctcgatttagtgtgagtagtttgggtttgggcacgaccggtgctcgatttagtgtgagtagtttgggtttggggaggagtcagtctcagtcaggacacagcatggacatgagggtccccgctcagctccgtggggctcctgctactctggctccgaggtgccagatgtgacatccagatgacccagtctccatccctcctgtctgctatctgtaggagacagagtcaccatcacttcggccgggacaagtcagagcaattagcagtactttaatttaaatggtatcgagacagagaccgaagggaaccncccctaactccctgactctatgatgcatctaaagttaggaagtcgggtaccagtacgtaaggttcagtcggataggtagactcgtagggactagtctttacnctacacacatacagtcgtagtcgtacgacgtacgtagtaacgttacgtttacgaaccttaaacttacgtacgttacgtaacgtaacgtaacgttaacgttaaccgtaacccgtaccctacgacgttccgtacggttacggtacggg

SEQ ID NO: 310366 - DNA, 577 bp, Homo sapiens
  misc_feature: GZ8MTXP02IAOCX.51.78.H01.1.454.CMB.2.raw
  modified_base (306)..(306): a, c, t, g, unknown or other
  misc_feature (306)..(306): n is a, c, g, or t
tcagcgatcgtatacacgaccggtgctcgatttagtgtgagtagtttgggtttgggggctctgggagaggagccccagccctgagattcccaggtgtttccattcagtgatcagcactgaacacagaggactcaccatggagttgggactgagctggattttcctttggctattttaaaaggtgtccagtgtgaagtgctactggtggagtcgtgggggagcctggtacagcctggcaggtccctgagactctcctgtgcagcctctggattcactttgatgattatgccatgcacgtgggtccgnaacgctaccgaggggacgggcctgggagtgggtctcgacgttattagttggaattaggtggtagtatgcctagtggccgactcgtggtaggaacggggccgtattccgactatcctacaggacgaaccgaacgccaaagaacctcccgtagtactctagacaaaatgaacagtctagacgagcgtaggacggactacgggcctttagtaactttacgacgaccgaacaaaaacggcccaaaagggccaaaacgacgtacgtacggttaacc

SEQ ID NO: 310367 - DNA, 603 bp, Homo sapiens
  misc_feature: GZ8MTXP02HSMKD.51.78.H01.1.454.CMB.2.raw
  modified_base (200)..(200): a, c, t, g, unknown or other
  misc_feature (200)..(200): n is a, c, g, or t
  modified_base (281)..(281): a, c, t, g, unknown or other
  misc_feature (281)..(281): n is a, c, g, or t
tcagcgatcgtatacacgaccggtgctcgatttagtgtgagtagtttgggtttggggaggagtcagtctcagtcaggacacagcatggacatgagggtccccgctcagctccgtggggctcctgctactctggctccgaggtgccagatgtgacatccagatgacccagtctccatcctccctgtctgcatctgtagganacagagtcaccatcacttgccgggcaagtcagagcattagcagactatttaaatggtatcagcagagaccgagggaaaccncccctaactcctagactctatgatgactactacctaaagtttagggaaaacggttccggggtacccctaagttacgtaaaggttctagggtcgcgtaaggttgagttcgtagggacagttacttcactctacacatcgatcgtagtcgtcgacgtacgtagtaaagttattttcgaacttaacgttactactacgtacaagtaagtacgttaaccaccgtaccctactaccgtacttaccgtaccgtttacgggacgggaaccggtacgtaaggggtagaaacgtacgtaacgtaaaaccggtaagtcggtacggactaccg

SEQ ID NO: 310368 - DNA, 611 bp, Homo sapiens
  misc_feature: GZ8MTXP02IXOT1.51.78.H01.1.454.CMB.2.raw
  modified_base (236)..(236): a, c, t, g, unknown or other
  misc_feature (236)..(236): n is a, c, g, or t
tcagcgatcgtatacacgaccggtgctcgatttagtgtgagtagtttgggtttggggaggagtcagtctcagtcaggacacagcatggacatgagggtccccgctcagctccgtggggctcctgctactctggctccgaggtgccagatgtgacatccagatgacccagtcctccatcctccctgtctgcatctgtaggagacagagtcacatcacttggccgggacaagtcagancattagcagtacttaatttaaagttggtatcagcagagaccgaagggaaaccgcccctaacctcctagactctatgatgcatacctaagttaggaagtcgggtaccagtcaaggttcagtgcagtggatcgtgggacagtattcactctccactatcgagtcgagtcgtcgactacgtagaagttatttacgacttaacgtttactacgtacgtacaaacgtagtaacgttaacctaaccgttaccccctagtaaccggttccttaccggttacccggtttaccggggaaccgggtaacggggaaacccgtaaggggttacggaagtaacgtaaaacccggaaaacggtacgtttacgggacggttactacccgg

SEQ ID NO: 310369 - DNA, 645 bp, Homo sapiens
  misc_feature: GZ8MTXP02JM45G.51.78.H01.1.454.CMB.2.raw
  modified_base (269)..(269): a, c, t, g, unknown or other
  misc_feature (269)..(269): n is a, c, g, or t
  modified_base (316)..(316): a, c, t, g, unknown or other
  misc_feature (316)..(316): n is a, c, g, or t
tcagcgatcgtatacacgaccggtgctcgatttagtgtgagtagtttggggtttgggggggagaggagccccagccctgagattcccaggtgtttccattcagtgatcagcactgaacacagaggactcaccatggagttgggactgagctggtattttcctttggcttaattttaaaaggtgtccagtgtgaagtgctactgggtggagtcgtgggggagcctggtacagcctggcaggtccctgagactctcctgtgcagtcctcgnggtattcacctttgatgattatcgccatcgccacgtcggggtccganaagcctaccgaggggacggcctggggagtcgggtcctacgtacgttagtttaggtaggaattaggtcggtaatatcgccttagtcggcgtacttcgtggtacggaaacggggtccctaattccgaaccctattacccgaccgaagaacgacaaaccgcccaaaacgtaccctacccgtgttaacttccagaaccaaattacgaaacgtagtctaggagacggtgacggaaggtacccgacggttccgtttaagtacgttaacgtcggaaccgaaccgaaaaacgccgaaaaggcctaaaacgcgtacgtacgtacctacgtaacgtacg

SEQ ID NO: 310370 - DNA, 701 bp, Homo sapiens
  misc_feature: GZ8MTXP02JO6XT.51.78.H01.1.454.CMB.2.raw
  modified_base (228)..(228): a, c, t, g, unknown or other
  misc_feature (228)..(228): n is a, c, g, or t
  modified_base (257)..(257): a, c, t, g, unknown or other
  misc_feature (257)..(257): n is a, c, g, or t
tcagcgatcgtatacacgaccggtgctcgatttagtgtgagtagtttgggtttggggggagaggagccccagccctgagattcccaggtgtttccattcagtgatcagcactgaacacagaggactcaccatggagttgggactgagctggtattttccttttggcttaattttaaaaggtgtccagtgtgaagtgctactggtggagtcgtgggggagcctggtacngcctggcaggtccctgagactctcctgtncagcctctggattcacctttgatgtattatgccatgcacgtcggggtccgacaacggcctaccggaagggggacgggtcccgtaggggtacggttcggggttacctacggtaacggtttaagtttaagggttaggtaaaacgttagggttagggttaaagttaagtacggtaccttagtcgggtaccggtaacgttccgttgggtagggaaacgggggtccctaagtttaccgaaccctaattcccgtaccgaaggaaccgaaccaaaccggacccaaaacgtaacccttaccctagttaactccgttagaacctaaagtacgaacgtaagttcgaggacgagacgtaggacggacgaccgggttaccttaggtacttacgcggaacgaacgaaaacggccgaaacggaacaaacgagtactacggtactacgtaaagttaacg

SEQ ID NO: 310371 - DNA, 580 bp, Homo sapiens
  misc_feature: GZ8MTXP02GEMUX.51.78.H01.1.454.CMB.2.raw
  modified_base (188)..(188): a, c, t, g, unknown or other
  misc_feature (188)..(188): n is a, c, g, or t
  modified_base (212)..(212): a, c, t, g, unknown or other
  misc_feature (212)..(212): n is a, c, g, or t
  modified_base (226)..(226): a, c, t, g, unknown or other
  misc_feature (226)..(226): n is a, c, g, or t
  modified_base (283)..(283): a, c, t, g, unknown or other
  misc_feature (283)..(283): n is a, c, g, or t
  modified_base (319)..(319): a, c, t, g, unknown or other
  misc_feature (319)..(319): n is a, c, g, or t
  modified_base (482)..(482): a, c, t, g, unknown or other
  misc_feature (482)..(482): n is a, c, g, or t
tcagcgatcgtatacacgaccggtgctcgatttagtgtgagtagtttgggtttgggcacgaccggtgctcgatttagtgtgagtagtttgggtttgggcacgaccggtgctcgatttagtgtgagtagtttgggtttggggaggagtcagtctcagtcaggacacagcatggacatgagggtccccgntcagctcctggggctcctgttacnctggctccgaggtnccagatgtgacatccagatgacccagtctccatcctccctgtctgcatctgtagganacagagtcacatcacttgccgggacaagtcaagacncagttacgcagtacttaaatttaaacttggtatcgagacaagacgaccgaagggaaaccgtcccctaaaccgtcctagactactatgatgacacttccaaagttcgaaaggtcggtaccagtacgtaaggttccaggtcgactagtacggtatcgagggtaanacgttatttccaacttccttaacacctatccgaagactaggtcgtacgaccgacctggaaaacttcttttacgaacctaacgtttaaccacgttaacg

SEQ ID NO: 310372 - DNA, 545 bp, Homo sapiens
  misc_feature: GZ8MTXP02HRCM1.51.78.H01.1.454.CMB.2.raw
  modified_base (269)..(269): a, c, t, g, unknown or other
  misc_feature (269)..(269): n is a, c, g, or t
  modified_base (330)..(330): a, c, t, g, unknown or other
  misc_feature (330)..(330): n is a, c, g, or t
  modified_base (525)..(525): a, c, t, g, unknown or other
  misc_feature (525)..(525): n is a, c, g, or t
tcagcgatcgtatacacgaccggtgctcgatttagtgtgagtagtttgggtttgggcacgaccggtgctcgatttagtgtgagtagtttgggtttggggaggagtcagtctcagtcaggacacagcatggacatgagggtccccgctcagctcctggggctcctgctactctggctccgaggtgccagatgtgacatccagatcgacccagtctccatccctcctgtctgcatctgtaggagacagagtcaccatcacttggccggganaagtcagagcattagcagtcttaatttaaatggtatcagcagacgaccgaaggggaaaccncccctaactccctagatctatgattgctatactaaagtttagggaaagtcgggtacctagtacgtaagttcagtggcagtgatcgtagggactagtattacactctacaccgatacgagcgagtgcgacgactagaagttatttacgacttaacttactacgtacgacaacgtagtacgttaacacgtaccctanactcctactacggttacggg

SEQ ID NO: 310373 - DNA, 673 bp, Homo sapiens
  misc_feature: GZ8MTXP02G7BTP.51.78.H01.1.454.CMB.2.raw
  modified_base (230)..(230): a, c, t, g, unknown or other
  misc_feature (230)..(230): n is a, c, g, or t
  modified_base (248)..(248): a, c, t, g, unknown or other
  misc_feature (248)..(248): n is a, c, g, or t
tcagcgatcgtatacacgaccggtgctcgatttagtgtgagtagtttgggtttgggcacgaccggtgctcgatttagtgtgagtagtttgggtttgggcacgaccggtgctcgatttagtgtgagtagtttgggtttggggaggagtcagtctcagtcaggacacagcatggacatggacgggtccccgctcagctccgtggggctcctgctactctggctccgaggtcnccagatgtgacatccagntcgacccagtctaccactccctcctgtctcgcatctaggtacggagacagacgtcaacctatcctaacgttcggaccggacaaagtcgaagacgactagttaacgactacgtactttaaactttaaagtggtactactacgacgaacggtacgaaccgaaacgggggtaaaccctaccccgtaaacgtctagtaactactagtcagtcgactacgtacgtaaggttacggaaggtccggacctagtacgtaaaggtctacgtacgggactgggttaaccggagtttccggtaagggacctaaattacctttacaccgttactacctaacacggttacagtaccggtaacgggttccgagggtaacccctaaggttacgtaaacggttttacgtttaccgaacctttaaccggtttactaaaccgg

SEQ ID NO: 310374 - DNA, 561 bp, Homo sapiens
  misc_feature: GZ8MTXP02IZDTN.51.78.H01.1.454.CMB.2.raw
  modified_base (199)..(199): a, c, t, g, unknown or other
  misc_feature (199)..(199): n is a, c, g, or t
  modified_base (225)..(225): a, c, t, g, unknown or other
  misc_feature (225)..(225): n is a, c, g, or t
  modified_base (279)..(279): a, c, t, g, unknown or other
  misc_feature (279)..(279): n is a, c, g, or t
  modified_base (354)..(354): a, c, t, g, unknown or other
  misc_feature (354)..(354): n is a, c, g, or t
  modified_base (460)..(460): a, c, t, g, unknown or other
  misc_feature (460)..(460): n is a, c, g, or t
tcagcgatcgtatacacgaccggtgctcgatttagtgtgagtagtttgggtttggggaggagtcagtctcagtcaggacacagcatggacatgagggtccccgctcagctcctggggctcctgctactctggctccgaggtgccagatgtgacatccagatgacccagtctccatcctccctgtctgcatctgtagganacagagtcaccatcacttgccggganaagtcagagcattagcagctaatttaaatggtatcagcagagaccagggaaacncccctaacctcctgatctatgatgcatcaagtttggaaagtcgggtaccagtcaaggttcagtgcagtggatcgnggacagtactttcacttcacacctatcagctagtgtgaccgacttaggaagttatttcgactaacttactatcgttacaaagagtaacgttaccacgtaacccctntaaacgccttactaccgtttacggacggtaacgggaaccgtaaggggtaggaaacgtaacgttaaaccgaaaacggtaaaccgtggtacggtacccgtacg

SEQ ID NO: 310375 - DNA, 700 bp, Homo sapiens
  misc_feature: GZ8MTXP02IVAMN.51.78.H01.1.454.CMB.2.raw
  modified_base (201)..(201): a, c, t, g, unknown or other
  misc_feature (201)..(201): n is a, c, g, or t
  modified_base (308)..(308): a, c, t, g, unknown or other
  misc_feature (308)..(308): n is a, c, g, or t
tcagcgatcgtatacacgaccggtgctcgatttagtgtgagtagtttgggtttggggaggagtcagtctcagtcaggacacagcatggacatgagggtccccgctcagctcctggggctcctgctactctggctccgaggtgccagatgtgacatccagatgacccagtcctccatccctccctgtctgcatctgtagganacagagtccaaccatcacgttggccgggacaagtcaagacgctaagttagctaagtacttaattttaaagtggtactacgacgacaagacgaaccgaagggaaaccncccccttaaactcctagtactctatgatgactactacgtaagttacggaacggttccgggtaccctagtaccgtaaaggttcgaggttcggacgtaggtaggtacttaccggtaggggtaaactaggtttaactttacccgacttacccgtaccaacctacttaccgaagtccgtaggttcggtacgaccgtacgttaaggtaaacgtttacgttttacgaacctttaaccgttaccgttaactacggtaacctaaacgtaacggttaaacgtttaccctaaacccgttacccgtacgtacgtaccttaccgttaccgggttacgggaacggtaacgggaaccgtacggtaggaacgaacgtaaccgaaaacgtacgtacggtcggactacg

SEQ ID NO: 310376 - DNA, 693 bp, Homo sapiens
  misc_feature: GZ8MTXP02FK6VE.51.78.H01.1.454.CMB.2.raw
  modified_base (230)..(230): a, c, t, g, unknown or other
  misc_feature (230)..(230): n is a, c, g, or t
tcagcgatcgtatacacgaccggtgctcgatttagtgtgagtagtttgggtttgggcacgaccggtgctcgatttagtgtgagtagtttgggtttgggcacgaccggtgctcgatttagtgtgagtagtttgggtttggggaggagtcagtctcagtcaggacacagcatggacatggacgggtccccgctcagcctccgtggggctcctgctactctggctccgaggtnccagatgtgacatccaagactcgacccagtcctcactccctcctgtctgcatcgtaggagagacagactccacatcctacgtcggccggacaagtcaagactactaagttacgactaacgttacttaaattttaaagtggtaataccgaagacgaaacgtaccggaaaccgaaacggggtaaacccgtacccccttaaaccttccgtagtaacttacgttaagtcggtaatcgtacctaaacgttaaccgtaagggtttaaccgggtaaacgggttccggtaaaccctaagttaccggtaaacggttgaagggtcgtagtagggtagtaccgttaggacgggtaacttaacgttcttaccaacttccgtaaacctaccgtaagtccgaaagtccgtaggttaccgacgtacccggtaattaaggtaacgtttatttaccgaaaactttacctttacgtaaacg

SEQ ID NO: 310377 - DNA, 717 bp, Homo sapiens
  misc_feature: GZ8MTXP02F1EZZ.51.78.H01.1.454.CMB.2.raw
tcagcgatcgtatacacgaccggtgctcgatttagtgtgagtagtttgggtttgggcacgaccggtgctcgatttagtgtgagtagtttgggtttgggcacgaccggtgctcgatttagtgtgagtagtttgggtttggggaggagtcagtctcagtcaggacacagcatggacatgacgggtccccgctcagctccgtggggtctcctgctactctggctccgaggtcgccagatgtgacatccagatcgacccagtcctccactccctcctgtctgctagtcgtaggtaaggagacgaagtacgtaccaacctactacctacgttcggacccgggtactaaacggtcgaagtacgactaaagttacgactaacgttactttaaagttttaaacgtgtaactacgtagacgtaaggacggtaaccgaaacggggtaaaccctacccccgttaaccgtcgtacgtaattacgtaacgtagtacgtacgacttacgttaccgttaaacggtttaacggtaaacgggttacgggtacccgtacgttacggttaaacggttacgtacgggtacgtacggtacgggttaggtacgttacggtacggtacgtacgttacttactaccgttacctacctaactactacgtacgtacgtacgtacggtactacgggggtaacctaggtaacgttacgttacgtacgttaacttaacgttaaccg

SEQ ID NO: 310378 - DNA, 564 bp, Homo sapiens
  misc_feature: GZ8MTXP02JDJH1.51.78.H01.1.454.CMB.2.raw
  modified_base (270)..(270): a, c, t, g, unknown or other
  misc_feature (270)..(270): n is a, c, g, or t
  modified_base (284)..(284): a, c, t, g, unknown or other
  misc_feature (284)..(284): n is a, c, g, or t
  modified_base (312)..(312): a, c, t, g, unknown or other
  misc_feature (312)..(312): n is a, c, g, or t
  modified_base (353)..(353): a, c, t, g, unknown or other
  misc_feature (353)..(353): n is a, c, g, or t
  modified_base (461)..(461): a, c, t, g, unknown or other
  misc_feature (461)..(461): n is a, c, g, or t
  modified_base (492)..(492): a, c, t, g, unknown or other
  misc_feature (492)..(492): n is a, c, g, or t
  modified_base (512)..(512): a, c, t, g, unknown or other
  misc_feature (512)..(512): n is a, c, g, or t
  modified_base (521)..(521): a, c, t, g, unknown or other
  misc_feature (521)..(521): n is a, c, g, or t
tcagcgatcgtatacacgaccggtgctcgatttagtgtgagtagtttgggtttgggcacgaccggtgctcgatttagtgtgagtagtttgggtttgggcacgaccggtgctcgatttagtgtgagtagtttgggttggggaggagtcagtctcagtcaggacacagcatggacatgagggtccccgctcagctcctggggctcctgctactctggctccgaggtgccagatgtgacatccagatcgacccagtctccatccctcctgtcngcatctaggagganacagacgtacaccatcacgttgccgganaacgtcagagactattagctagtacttaatttaatggtatnagacagacgaccgaaggggaaacctccccgtaaacctccgtagacttactatagactgactactacgtaagtttacggaaacgttcgggacctagtacgtaaacgttnaaggttgagtagtgtactgtaggactaagtnttcactctaacacatcgaancgagttacncgtacgaacgtagtaacgttacttagaccttacttaacgtacg

SEQ ID NO: 310379 - DNA, 561 bp, Homo sapiens
  misc_feature: GZ8MTXP02HNM22.51.78.H01.1.454.CMB.2.raw
  modified_base (202)..(202): a, c, t, g, unknown or other
  misc_feature (202)..(202): n is a, c, g, or t
  modified_base (314)..(314): a, c, t, g, unknown or other
  misc_feature (314)..(314): n is a, c, g, or t
  modified_base (318)..(318): a, c, t, g, unknown or other
  misc_feature (318)..(318): n is a, c, g, or t
  modified_base (394)..(394): a, c, t, g, unknown or other
  misc_feature (394)..(394): n is a, c, g, or t
  modified_base (417)..(417): a, c, t, g, unknown or other
  misc_feature (417)..(417): n is a, c, g, or t
  modified_base (421)..(421): a, c, t, g, unknown or other
  misc_feature (421)..(421): n is a, c, g, or t
tcagcgatcgtatacacgaccggtgctcgatttagtgtgagtagtttgggtttggggaggagtcagtctcagtcaggacacagcatggacatgagggtccccgctcagctcctggggctcctgctactctggctccgaggtgccagatgtgacatccagatcgacccagtcctccatccctccctgtctgcatctgtagganacagatccaccatcacgttgccgggacaagtcagagcatagcagattaatttaaatggtatacagcaagacgaaccgaagggaaacctcccctaaactcctagatactagtnagtnactactactaaagttaggaaaggtccggggtacccagtactaaagggttcaggtgagtaggtaggattcgaggganagtacttacactcacaccagtanaganagtgtacgtacgtacgtagtaagttagttatactaactactatactacaacagtactactacgtacctactactactactacgtacggacggacggacgtaaggagtaagaacgtaacgaaacgtacgtacgtcgacgcg

SEQ ID NO: 310380 - DNA, 621 bp, Homo sapiens
  misc_feature: GZ8MTXP02JLZMQ.51.78.H01.1.454.CMB.2.raw
  modified_base (323)..(323): a, c, t, g, unknown or other
  misc_feature (323)..(323): n is a, c, g, or t
  modified_base (328)..(328): a, c, t, g, unknown or other
  misc_feature (328)..(328): n is a, c, g, or t
  modified_base (331)..(331): a, c, t, g, unknown or other
  misc_feature (331)..(331): n is a, c, g, or t
  modified_base (562)..(562): a, c, t, g, unknown or other
  misc_feature (562)..(562): n is a, c, g, or t
tcagcgatcgtatacacgaccggtgctcgatttagtgtgagtagtttgggtttgggcacgaccggtgctcgatttagtgtgagtagtttgggtttgggcacgaccggtgctcgatttagtgtgagtaggtttgggtttggggaggagtcagtctcagtcaggacacagcatggacatgacgggtccccgctcagctccgtggggctcctgctactctggctccgaggtcgccagtatgtgacatccagatcgacctagtcctccactccctcctgtctgcatctaggtaggacacgagactcactatctacgttcggccgganacgtnagnactagtacgctaagtactttaaacgttaagtgtactacgagcaggacgaaccggtaacggaaacctaccccgtactccgtatacttactagttacgctagtactaacgttacgttaaagtttacgggtaaacgggttccgggtaccctaaggttaccgtaaaggtttcgaacgggttgacgtacgggtagtacgttcggtacggtatacgtacttcgtactctaccacctntacgacgtacgtacgtcgtacgacgtaagtacgtaacttactacgtactacgtactacg

SEQ ID NO: 310381 - DNA, 652 bp, Homo sapiens
  misc_feature: GZ8MTXP02F6TFL.51.78.H01.1.454.CMB.2.raw
  modified_base (242)..(242): a, c, t, g, unknown or other
  misc_feature (242)..(242): n is a, c, g, or t
  modified_base (330)..(330): a, c, t, g, unknown or other
  misc_feature (330)..(330): n is a, c, g, or t
  modified_base (355)..(355): a, c, t, g, unknown or other
  misc_feature (355)..(355): n is a, c, g, or t
tcagcgatcgtatacacgaccggtgctcgatttagtgtgagtagtttgggtttgggcacgaccggtgctcgatttagtgtgagtagtttgggtttggggaggagtcagtctcagtcaggacacagcatggacatgagggtccccgctcagctcctggggctcctgctactctggctccgaggtgccagatgtgacatccagatgacccagtctccatccctccctgtctgcatctgtagganacagacgtcaccatcacttggccggacaagtcagagctattagcagtactaatttaaatggtatcagcaagacgaaccgaagggaacnccccctaactccccagatactatanattcgctactacctaaagtttaggaaagttcggggaccctagtacgaaggttcgaagtggactgtaggatcgagggacagtacttaccacttctaccacctagtaccgagtacgtaaggttcgtacgtaaccgtaccgttaaggtaaaagttaccgtttttaaacgaaaccctttaaacctttaaccgttaaacgttaacgtaaacccgtaaaacgtaacggttaaaccgttaaccctaaacccggttacccctaaccgtaccggttacccgtaccggttacccggtttacccgggg

SEQ ID NO: 310382 - DNA, 564 bp, Homo sapiens
  misc_feature: GZ8MTXP02FHBEH.51.78.H01.1.454.CMB.2.raw
tcagcgatcgtatacacgaccggtgctcgatttagtgtgagtagtttgggtttgggggctctgggagaggagccccagccctgagattcccaggtgtttccattcagtgatcagcactgaacacagaggactcaccatggagttgggactgagctggattttccttttggctattttaaaaggtgtccagtgtgaagtgctactggtggagtctgggggagcctggtacagcctggcaggtccctgagactctcctgtgcagcctctggattcacctttgatgattatgccatgcacgtgggtccggcaagcctccgaaggggaacgggcctgggagtgggtctcgacgtattagttggaattaggtggtacgtatagcctagtgcgactcgtgtaggaaggcctatccacatctccagacgacaacgaccaaagaacctcccagtactcgtagacaaaagtcgaaacaggtctgaagagctaggacggaccacggtccttaggtacttacgcgaccgaacaaaaacgcccgaaaaggaccaaacgacgaccgtaggtaaaccc

SEQ ID NO: 310383 - DNA, 525 bp, Homo sapiens
  misc_feature: GZ8MTXP02JR9ML.51.78.H01.1.454.CMB.2.raw
  modified_base (255)..(255): a, c, t, g, unknown or other
  misc_feature (255)..(255): n is a, c, g, or t
  modified_base (346)..(346): a, c, t, g, unknown or other
  misc_feature (346)..(346): n is a, c, g, or t
  modified_base (361)..(361): a, c, t, g, unknown or other
  misc_feature (361)..(361): n is a, c, g, or t
  modified_base (472)..(472): a, c, t, g, unknown or other
  misc_feature (472)..(472): n is a, c, g, or t
tcagcgatcgtatacacgaccggtgctcgatttagtgtgagtagtttgggtttgggcacgaccggtgctcgatttagtgtgagtagtttgggtttgggcacgaccggtgctcgatttagtgtgagtagtttgggtttggggaggagtcagtctcagtcaggacacagcatggacatgagggtccccgctcagctcctggggctcctgctactctggctccgaggtgccagatgtgacatccagatgacccagtcnccatccctccctgtctgcatctgtaggagacagagtcaccatcactgccggcaagtcagagcattagcagctatttaatggtatcagcagngaccgaaagggaacncccctaactcctagactactatgatgacataccagtttcgaaagtcgggtaccagtacaaggttcacgtggctacgggtgtatcgtaggacagtatttacactctacaccntcgagcagtcgtgacgtaaccgtagaacgtctttagaccgtaactacgtaacg

SEQ ID NO: 310384 - DNA, 586 bp, Homo sapiens
  misc_feature: GZ8MTXP02JKFSI.51.78.H01.1.454.CMB.2.raw
  modified_base (200)..(200): a, c, t, g, unknown or other
  misc_feature (200)..(200): n is a, c, g, or t
  modified_base (281)..(281): a, c, t, g, unknown or other
  misc_feature (281)..(281): n is a, c, g, or t
tcagcgatcgtatacacgaccggtgctcgatttagtgtgagtagtttgggtttggggaggagtcagtctcagtcaggacacagcatggacatgagggtccccgctcagctcctggggctcctgctactctggctccgaggtgccagatgtgacatccagatgacccagtcctccatcctccctgtctgcatctgtagganacagagtcaccatcacttggccgggacaagtcagagcattagcagctatttaaatggtatcagcagagaccaagggaaacncccctaaactctagatctatgatgcatacctaatttagggaaagtccggggtaccatacgaaggttcaaggttggctaggtggaatcgtaggggactagtactttacactcctacacctatcgagctagtgtggcaacgttaggaacgttattttacgacctaaactttactaagttacgtaacaaactagtaacttaacgaccgtttaccccagtaacgcttaccgtcggttaccgggacgggtaacgggaaccgtaaggggtagaacgaactaccgaaaaacggtcgtaggtcggactaccgg

SEQ ID NO: 310385 - DNA, 631 bp, Homo sapiens
  misc_feature: GZ8MTXP02JQ5ZJ.51.78.H01.1.454.CMB.2.raw
  modified_base (205)..(205): a, c, t, g, unknown or other
  misc_feature (205)..(205): n is a, c, g, or t
  modified_base (251)..(251): a, c, t, g, unknown or other
  misc_feature (251)..(251): n is a, c, g, or t
  modified_base (303)..(303): a, c, t, g, unknown or other
  misc_feature (303)..(303): n is a, c, g, or t
  modified_base (450)..(450): a, c, t, g, unknown or other
  misc_feature (450)..(450): n is a, c, g, or t
  modified_base (466)..(466): a, c, t, g, unknown or other
  misc_feature (466)..(466): n is a, c, g, or t
  modified_base (516)..(516): a, c, t, g, unknown or other
  misc_feature (516)..(516): n is a, c, g, or t
  modified_base (568)..(568): a, c, t, g, unknown or other
  misc_feature (568)..(568): n is a, c, g, or t
  modified_base (619)..(619): a, c, t, g, unknown or other
  misc_feature (619)..(619): n is a, c, g, or t
  modified_base (629)..(629): a, c, t, g, unknown or other
  misc_feature (629)..(629): n is a, c, g, or t
tcagcgatcgtatacacgaccggtgctcgatttagtgtgagtagtttgggtttggggaggagtcagtctcagtcaggacacagcatggacatggacgggtcccccgctcagctcctggggctcctgctactctggctccgaggtgccagatgtgacatccagatcgacccagtcctccatccctcctgtctgcatctggtagganacaggactccaccatcacgttggccggacaagtcagagctatacgnacgtattaattaaagttggatcagaccaaggacgaaccgaaggggtaaaccncccccgttaaacctctagtacttactatagtacttggaccttaataccgttaaaggtttacgggaaaggttcccccggggtacccaagttacgtaaaggttcgaggttgcgagggtacgtagtcgtaggggaactacgtattaaccncctttacacccgaacncttaccgagtaccgtagtggtacgaccgtacgtaggtaattaacgttttnaaccttaactttaacgtactacgtaacaaacgtgtaacgttacaaccctccntactcgtactcggtacggacggtacggaacgtagacgaagactacgaacgntcggcgtacncg

SEQ ID NO: 310386 - DNA, 652 bp, Homo sapiens
  misc_feature: GZ8MTXP02INO2G.51.78.H01.1.454.CMB.2.raw
  modified_base (289)..(289): a, c, t, g, unknown or other
  misc_feature (289)..(289): n is a, c, g, or t
  modified_base (314)..(314): a, c, t, g, unknown or other
  misc_feature (314)..(314): n is a, c, g, or t
tcagcgatcgtatacacgaccggtgctcgatttagtgtgagtagtttgggtttggggggagaggagccccagccctgagattcccaggtgtttccattcagtgatcagcactgaacacagaggactcaccatggagttgggactgagctggtatttttccttttggcttaattttaaaaggtgtccagtgtgaagtgctactggtggagtcgtgggggagcctggtacagcctggcacggtccctgagactctcctgtgcagcctcgtgacttctacttgatgtattancgccatcgactacgtgggtcccganaacgcctacggaaggggacggtcgtagggaggtcggtctacgtacgttagttaggtacggaagttagggtaggttacgtaagtacgtacccgttaagtcgggacgtaacttcgtggttacgggaaacgggtccctagttaccaacctacgtcctaccgaagacgaaaccaaccgaacccgaaacgtaaacctcccgtagtactacgtacgactaaaatcggaaactagtctagagagacgtacggacgtacgacgttcgttacgttacgtaccgtaggaaccgaaacgaaaacgaccgaagaacctaacgacgtacgtacgtacctagtaacgtaccg

SEQ ID NO: 310387 - DNA, 793 bp, Homo sapiens
  misc_feature: GZ8MTXP02IH05M.51.78.H01.1.454.CMB.2.raw
  modified_base (231)..(231): a, c, t, g, unknown or other
  misc_feature (231)..(231): n is a, c, g, or t
tcagcgatcgtatacacgaccggtgctcgatttagtgtgagtagtttgggtttggggaggagtcagtctcagtcaggacacagcatggacatgagggtcccccgctcagctcctggggctcctgctactctggctccgaggtgccagatgtgacatccagatcgacccagtcctccatcctccctgtctgctatctgtaggagacagagtccaccatcacgttggccgganaagtcagacgctaattagactagtacttaatttaaagtggtatacgaagacaaggacgaacccggaagggaaaccctcccccttaaacctcctagtaacttcttaagtagtatcgacctaaacttaccgtaaaggtttacggggaaacggttcccggggtacccctagtaaccgtaaggtttcgaacgggttcggtacggtaaggttacggtaaacgttccgggtacgggggtaactaacgggtttaacctttaccctaaaccttcccgttaacccaacccgtacttaccgaacgtaccgttaggtacggttacgaccgtaaccgttaaggttaaacgtttacgttttaccgtaaccttaaccttaaccgttaacgttacgtaaaccgtaaacgtaacggttaacgtttaacccgtaaccgtaaccccctaacgtaccgttaccgttccggttaaaccggtttccggggaaacggggttaaccgggaaaccggtaacggggttaaggaacgtaaccgaaaacggtaaaaccggtaacggtttacggtaacggtcgttaaccg

SEQ ID NO: 310388 - DNA, 648 bp, Homo sapiens
  misc_feature: GZ8MTXP02GXAF1.51.78.H01.1.454.CMB.2.raw
  modified_base (286)..(286): a, c, t, g, unknown or other
  misc_feature (286)..(286): n is a, c, g, or t
  modified_base (307)..(307): a, c, t, g, unknown or other
  misc_feature (307)..(307): n is a, c, g, or t
tcagcgatcgtatacacgaccggtgctcgatttagtgtgagtagtttgggtttgggggggagaggagccccagccctgagattcccaggtgtttccattcagtgatcagcactgaacacagaggactcaccatggagttgggactgagctggtattttccttttggcttaattttaaaaggtgtccagtgtgaagtgctactggtggagtcgtgggggagcctggtacagcctggcaggtccctgagactctctgtgcagcctctggattcacctttgatgattangccatcgcacgtgggtccganaagctaccggaggggacggtccgtgggacggtgggtctacgtacgttagttaggttagaataggtggtatatacggccttaagtcggggacgacttcgtagggtacgggaaacgggtcctaagttccaacctacgttccaccgagaacgaccaaaccgaccaaacgaacccttacccagtaactccgtagaaaccgtaaataggtaaacacggtctagggaacgtaggacttagggaaaccgacgtaacgtcggtacctttaggtaaactttacgcggaacaaaccgaaaacgacccgaaaggaccaaaacgacgcgttaacggtaacctacgttaaaagg

SEQ ID NO: 310389 - DNA, 622 bp, Homo sapiens
  misc_feature: GZ8MTXP02I1X5C.51.78.H01.1.454.CMB.2.raw
  modified_base (503)..(503): a, c, t, g, unknown or other
  misc_feature (503)..(503): n is a, c, g, or t
  modified_base (531)..(531): a, c, t, g, unknown or other
  misc_feature (531)..(531): n is a, c, g, or t
  modified_base (589)..(589): a, c, t, g, unknown or other
  misc_feature (589)..(589): n is a, c, g, or t
tcagcgatcgtatacacgaccggtgctcgatttagtgtgagtagtttgggtttgggggctctgggagaggagccccagccctgagattcccaggtgtttccattcagtgatcagcactgaacacagaggactcaccatggagttgggactgagctggattttccttttggcttattttaaaaggtgtccagtgtgaagtgctacgtggtggagtcgtgggggagcctggtacagcctggcaggtccctgagactctcctgtgcagcctctggattcactttgatgattatgccatgcacgtcgggtccggcaagcctaccgaggggaacgggccgttaggaggttggggtcctacgtacggtttaacgtttaggttgggtaaaattacggttagggttaacgttaagttagggtacccttaagttcgggaccgtacgttcggtaggttacgggaaacgggtcgtattcaacctatctaccgagacgaacaacgcaagttaccnccctagtactctacataaaatcgaaacngtcgagacgagctaggacggactaacgggtcttaaggactttaccgaggacccaaaanaaacgcgaaacgacaacgtacgacgtacgtaac

SEQ ID NO: 310390 - DNA, 720 bp, Homo sapiens
  misc_feature: GZ8MTXP02G7N55.51.78.H01.1.454.CMB.2.raw
tcagcgatcgtatacacgaccggtgctcgatttagtgtgagtagtttgggtttggggggagaggagccccagccctgagattcccaggtgtttccattcagtgatcagcactgaacacagaggactcaccatggagttgggactgagctggtattttcctttggcttaattttaaaaggtgtccagtgtgaagtgctacgtggtggagtcgtgggggagccgtggtacagcctggcaggtccctgagacctctcctgtcgcacgcctcgtggtacttcctacctttgattgtattatcgaccagtcgctacggtcggggtcccgacgaacgccgtccggaaggggacggtccgtgggtacggttcggggtcctacgtaacgtttaagtttagggttaggtaaacgttagggttaggttaagttaacgtacgtacccgttaagtcgggaccggtacgttcggttagggacgggtaaacggggccgtaaacttcccaaccgtacttacccgaccgaaaggaaccgaaaccgaaacccgacctaaacgtaacccttacccgtagttaacctcgtaacgaactaaaagtacggaactaagtcgaaggaagtacgtacgtagggaaccgtacgtaccggttactttagtaacttacgtacgaaccgaaacgaaacgaccgaaacgaacgaacgtacggtactacggtaactacgaaagtttaccg

SEQ ID NO: 310391 - DNA, 529 bp, Homo sapiens
  misc_feature: GZ8MTXP02IIO3U.51.78.H01.1.454.CMB.2.raw
  modified_base (288)..(288): a, c, t, g, unknown or other
  misc_feature (288)..(288): n is a, c, g, or t
  modified_base (305)..(305): a, c, t, g, unknown or other
  misc_feature (305)..(305): n is a, c, g, or t
  modified_base (355)..(355): a, c, t, g, unknown or other
  misc_feature (355)..(355): n is a, c, g, or t
  modified_base (370)..(370): a, c, t, g, unknown or other
  misc_feature (370)..(370): n is a, c, g, or t
  modified_base (388)..(388): a, c, t, g, unknown or other
  misc_feature (388)..(388): n is a, c, g, or t
tcagcgatcgtatacacgaccggtgctcgatttagtgtgagtagtttgggtttgggggctctgggagaggagccccagccctgagattcccaggtgtttccattcagtgatcagcactgaacacagaggactcaccatggagttgggactgagctggattttccttttggctattttaaaaggtgtccagtgtgaagtgctactggtggagtcgtgggggaggcctggtacagcctggcaggtccctgagactctcctgtgcagcctctgattcactttgatgattangccatgcagtgggccgnaagctcgagggaggctggagtggtctcgagtattagtgatagtggtatangctatgacgactgtngaggcatcacatctcagnaacacgacaagacctcctgtactctagacaaactgaaactagtcgtagaagtgacgtaggacggacgtacggtaccttagtaaactttccgagtaccgaacgtaaaacgcccgaaaggacaacgacgtacgtacggtaaac

SEQ ID NO: 310392 - DNA, 605 bp, Homo sapiens
  misc_feature: GZ8MTXP02IPIS7.51.78.H01.1.454.CMB.2.raw
  modified_base (564)..(564): a, c, t, g, unknown or other
  misc_feature (564)..(564): n is a, c, g, or t
tcagcgatcgtatacacgaccggtgctcgatttagtgtgagtagtttgggtttgggggctctgggagaggagccccagccctgagattcccaggtgtttccattcagtgatcagcactgaacacagaggactcaccatggagttgggactgagctggtattttcctttggcttattttaaaaggtgtccagtgtgaagtgctactggtggagtcgtgggggagcctggtacagcctggcacggtccctgagactctcctgtgcagcctcgtggacttcacctttgatgtattatgccagtcgacacgtcggggtcccgacaagcctaccgaggggaacgggccgtggaggtcggggtctcgtacggttaatttaggtaggaaattaggtaggtaagtatcgtccgtaagtcggacggtacttcgtgtaggaaacggggtccctattacccgactatcccgtaccaagacaacaaccggaccaaacgtaacctccctagtaactcgtagaacaaatacggaactagtcagacgagctaggaacgacgacggtcttagtacttacnggacaacaaaacgtccgaaaggccaaagcgtcgtagtaacc

SEQ ID NO: 310393 - DNA, 640 bp, Homo sapiens
  misc_feature: GZ8MTXP02HMFH6.51.78.H01.1.454.CMB.2.raw
  modified_base (515)..(515): a, c, t, g, unknown or other
  misc_feature (515)..(515): n is a, c, g, or t
  modified_base (575)..(575): a, c, t, g, unknown or other
  misc_feature (575)..(575): n is a, c, g, or t
tcagcgatcgtatacacgaccggtgctcgatttagtgtgagtagtttgggtttgggcacgaccggtgctcgatttagtgtgagtagtttgggtttgggcacgaccggtgctcgatttagtgtgagtagtttgggtttggggaggagtcagtctcagtcaggacacagcatggacatgacgggtccccgctcagctccgtggggctcctgctactctggctccggaggtcgccagatgtgacatccagatcgacccagtcctaccactccctccctgtctgcactcgtaggtaggacacgagacgtaccaactactcctacgttcggaccggtacaagtcgagtacactaagtacgactacgttacttaatttaaagtgtatacgtagacaagacggaaaccgaaaggtaaaccctacccccgttaaacttccgagtaactcttaatacgtagtacacgttaacgttacgttaaaggtttaagggaacggttcggtaccctagttacgtaacggtnaggttcgacagggtagtacgtcggaaggtactagttacttaccgacttctacaaccgttntacgatacgtacgtcgaccgtacgttaacgagttaacgttcttacgtaacctaacgtttacgacg

SEQ ID NO: 310394 - DNA, 664 bp, Homo sapiens
  misc_feature: GZ8MTXP02G32EQ.51.78.H01.1.454.CMB.2.raw
  modified_base (255)..(255): a, c, t, g, unknown or other
  misc_feature (255)..(255): n is a, c, g, or t
  modified_base (257)..(257): a, c, t, g, unknown or other
  misc_feature (257)..(257): n is a, c, g, or t
tcagcgatcgtatacacgaccggtgctcgatttagtgtgagtagtttgggtttggggggagaggagccccagccctgagattcccaggtgtttccattcagtgatcagcactgaacacagaggactcaccatggagttgggactgagctggtattttccttttggcttattttaaaaggtgtccagtgtgaagtgctactggtggagtcgtgggggagcctggtacagcctggcaggtccctgagctctcctgtncncgcctctgattctacttgatgtattatcgcctatcgctacgtcgggtccgactaacgcgtaccggaggggacggtccgtagggacgggttggtactacgtaacgttagttaggttaggaagttaggtaggttagtaacgtacgtaccttagtcggtacgtacgttcgtagggtacgggaacggggtacctattacccgaacgttactccaccgaagacgaaaccgaccgtaccaaacgtacctcccgtgttaaacctctacgaaactaaagtcgaaacgtagtcgaagacggtacgacgtacggacggtaccgtacggttactttaggtactacgtacggacaaaaccgtaaacgcccgaaaggctaaacggtacgtaccggttagtaacctactaagttaacccgg

SEQ ID NO: 310395 - DNA, 664 bp, Homo sapiens
  misc_feature: GZ8MTXP02F7W7C.51.78.H01.1.454.CMB.2.raw
  modified_base (268)..(268): a, c, t, g, unknown or other
  misc_feature (268)..(268): n is a, c, g, or t
  modified_base (348)..(348): a, c, t, g, unknown or other
  misc_feature (348)..(348): n is a, c, g, or t
tcagcgatcgtatacacgaccggtgctcgatttagtgtgagtagtttgggtttgggggctctgggagaggagccccagcccctgagattcccaggtgtttccattcagtgatcagcactgaacacagaggactcaccatggagttgggactgagctggattttccttttggctattttaaaaggtgtccagtgtgaagtgctactggtggagtcgtgggggagcctggtacagcctggcaggtccctgagactctcctgtgcagcctntggattcactttgatgattatgccatgcactgggtccggacaagcctaccgaggggaacgggccgtgggaggtggggtcncgtacgttagttaggttgaataggtggtagttataggccttagtggccgacttcgtggtagaaacgggggcctattccgacctactccgtacccaggaacgacaaccggaccaaacgtaaacctccccgtagttaacttcgtacgtaacaaaacgtacgtaaccgaagttaccgtggaagaacggtccgttagggaaacgggacccgtaccggggtacccgtttaaggttaacgtttaccggttaggacccgaaaacggaaaaaccggaccccgaaaggggaaccaaaaccggacgaccgggtttaggttaaaccc

SEQ ID NO: 310396 - DNA, 602 bp, Homo sapiens
  misc_feature: GZ8MTXP02HWBW9.51.78.H01.1.454.CMB.2.raw
  modified_base (295)..(295): a, c, t, g, unknown or other
  misc_feature (295)..(295): n is a, c, g, or t
  modified_base (488)..(488): a, c, t, g, unknown or other
  misc_feature (488)..(488): n is a, c, g, or t
tcagcgatcgtatacacgaccggtgctcgatttagtgtgagtagtttgggtttgggggctctgggagaggagcccccagccctgagattcccaggtgtttccattcagtgatcagcactgaacacagaggactcaccatggagttgggactgagctggtattttccttttggcttaagttttaaaaggtgtccagtgtgaagtgctatggtggagtcgtgggggagcctggtacagcctggcaggtccctgacgactctcctgtgcagcctctggattcctactttgatgattangccatgccagtcggtccgacaagcctacgaggggaacggtctgggagtgggtcctcgacgttatttaggttagtaataggttggtaacgttatcggtcctagtggaccgtagtcgtaggtaggacggggctacttcaaccattccaccgagacgaaccaccgacgtaaacaccttcctagtacttcgtacganaaaactagaacctgtacaggagtagacgtggaacgaccgacggttacttaggttaactacgtgacccgaaagaaaaccgcggaaaacggcaaacgtacgtcgtacggttaaacc

SEQ ID NO: 310397 - DNA, 711 bp, Homo sapiens
  misc_feature: GZ8MTXP02G1HLG.51.78.H01.1.454.CMB.2.raw
tcagcgatcgtatacacgaccggtgctcgatttagtgtgagtagtttgggtttgggggctctgggagaggagccccagccctgagattcccaggtgtttccattcagtgatcagcactgaacacagaggactcaccatggagttgggactgagctggtattttccttttggcttaattttaaaaggtgtcctagtgtagaagtgctagtggtggagtcggtgggggacgtccgtggtacagccgtggcgacggtcctgacgtacctctcgtgtcgcacgcctgtgattcctacttgatagtattatcgcctagtcgcgtacggtcgggtccgacgaacgtccgtacgggaaggggacgggcgtagggaggtcggtctacgtacgttaagttaggtagaagttgtaggtatatacgctagtcggacgtacgtcgtaggtacgggaacggtccctaaataccctaaccgtaactttccccgaaacgaaacgaaaccgaaacccgaacccgaaaccgtaaacgtaaccccttcctaaggttactacgtacgtaaaactaagaaaccgaaacgtacgttacgaaggaacgtacgacgtaaacggggaaccggtacccgtacggtttaccttaggtttaaactcgaaccggaacgaaaacggaaaaccgacccgaaaacgggaccctaaagacggttaaccgttacggttaaaacc

SEQ ID NO: 310398 - DNA, 699 bp, Homo sapiens
  misc_feature: GZ8MTXP02JBZUZ.51.78.H01.1.454.CMB.2.raw
  modified_base (294)..(294): a, c, t, g, unknown or other
  misc_feature (294)..(294): n is a, c, g, or t
tcagcgatcgtatacacgaccggtgctcgatttagtgtgagtagtttggggtttgggggggagaggagccccagccctgagattcccaggtgtttccattcagtgatcagcactgaacacagaggactcaccatggagttgggactgagctggtattttcctttggcttaattttaaaaggtgtccagtgtgaagtgctacgtggtggagtcgtgggggagcctggtacagcctggcacggtcctgacgactctcctgtgcacgcctctggtacttcctactttgatgtattancgccatcgctacgtggggtcccgactaaacgccgtaccggaaggggaacgggtccgtagggacgggttcggtacctacgtacgttagttaggtagaacgtaggttggtaagtaagtcgacttagtcggcgtacttcgtgaagggaacgggtcctattaccaaccgtattaccgccaaaggacgaaaccaaccgaacaaacgtaccttccgtagttaactccgtaagaaactaaagtacgaaacgtagtacgaggacggagtacgaggaacggtaccgtacggttccgtttagtaacgttaccggtaaacggaacaaaacccgaaaaacggtacccgaaaagggaacctaaaaccgaacggtttcggtaaccggtttaactaaaccgttaaaaggtttaaacccgg

SEQ ID NO: 310399 - DNA, 731 bp, Homo sapiens
  misc_feature: GZ8MTXP02F4E8P.51.78.H01.1.454.CMB.2.raw
  modified_base (201)..(201): a, c, t, g, unknown or other
  misc_feature (201)..(201): n is a, c, g, or t
  modified_base (264)..(264): a, c, t, g, unknown or other
  misc_feature (264)..(264): n is a, c, g, or t
  modified_base (284)..(284): a, c, t, g, unknown or other
  misc_feature (284)..(284): n is a, c, g, or t
tcagcgatcgtatacacgaccggtgctcgatttagtgtgagtagtttgggtttggggaggagtcagtctcagtcaggacacagcatggacatgagggtccccgctcagctcctggggctcctgctactctggctccgaggtgccagatgtgacatccagatgacccagtctccatccctccctgtctgcattctgtagganacagacgtcaccatcacttggccgggcaaggtcagagcattagcagactatttaaatggtatnagcagagaccagggaaaccncccctaaactcctagatctatgatgactataccgtaatttacggggaaaacgttcggggtacccctagttacgtaacgggtttcaaggttgggccgaaggttcggggaacgttccggggttagggaaccgtaagggttactttttacccgaaactttccctaccgaaaccctacggttcccaaaggccgtaaggtcgggttccggaccgtacccgttaaaggtaaaccggtttagttttcggaaacccttaaaccggtttacttaaaccgttccgggttaacccaaaaggtaacgttaaacggttaccgtaacccggtttaaacccccttcggaaacgttcctacccggtttacggtttacccggggaacggggttacgggaaaaccggtagggtaggaacgtaaacgaaccggaaaacggtaaccgtttggtacggaaccgttacg

SEQ ID NO: 310400 - DNA, 612 bp, Homo sapiens
  misc_feature: GZ8MTXP02GPU0S.51.78.H01.1.454.CMB.2.raw
  modified_base (271)..(271): a, c, t, g, unknown or other
  misc_feature (271)..(271): n is a, c, g, or t
  modified_base (292)..(292): a, c, t, g, unknown or other
  misc_feature (292)..(292): n is a, c, g, or t
  modified_base (339)..(339): a, c, t, g, unknown or other
  misc_feature (339)..(339): n is a, c, g, or t
  modified_base (513)..(513): a, c, t, g, unknown or other
  misc_feature (513)..(513): n is a, c, g, or t
  modified_base (518)..(518): a, c, t, g, unknown or other
  misc_feature (518)..(518): n is a, c, g, or t
tcagcgatcgtatacacgaccggtgctcgatttagtgtgagtagtttgggtttgggggctctgggagaggagccccagccctgagattcccaggtgtttccattcagtgatcagcactgaacacagaggactcaccatggagttgggactgagctggtattttcctttggcttaattttaaaaggtgtccagtgtgaagtgctactggtggagtcgtgggggagcctggtacagccgtggcacggtccctgagactctcctgtgcagcctntggattcactttgatgattangccatgcacgtcgggccgacaagctaccggaggggacggcctagggngtggtctcgtacgttagttagtgtaatggtaggtacgttatacggtcctagtcggcgtaactcgtagggtacggaaacggggtcctattccaacctactccgtaccaagggacaaccaaccggaccaaacggtaacccttcccgtagttactacgtagacctaaagtcgaaacncgttnaggagagtcgagacgacgtacggtcctttagtactttacgcggaccaaacgaaaacgacccgtaaaggaccaacggagtacccggtagtaaccc

SEQ ID NO: 310401 - DNA, 765 bp, Homo sapiens
  misc_feature: GZ8MTXP02FF93U.51.78.H01.1.454.CMB.2.raw
  modified_base (201)..(201): a, c, t, g, unknown or other
  misc_feature (201)..(201): n is a, c, g, or t
  modified_base (228)..(228): a, c, t, g, unknown or other
  misc_feature (228)..(228): n is a, c, g, or t
  modified_base (290)..(290): a, c, t, g, unknown or other
  misc_feature (290)..(290): n is a, c, g, or t
tcagcgatcgtatacacgaccggtgctcgatttagtgtgagtagtttgggtttggggaggagtcagtctcagtcaggacacagcatggacatgagggtccccgctcagctcctggggctcctgctactctggctccgaggtgccagatgtgacatccagatcgacccagtctccatcctccctgtctgcatctggtagganacagagtccaccatcacttggccgganaagtcagagcattagcagtcttaattaaatggtatcagacaggaacgaccgaagggaaaccncccctaaacctccgtgactctagtgatcgactaacttaccgtaaagtttacgggaaacggtcccggggtacccctagtacgtaaggtttccgaaggttgggactagggtacgggtaattccgggtaggggtaaactacgggttaactttttacccgaaacctttcccgtaaccgaacccctattacccgaaaggcctaaagggtttcgtaccgggacccgtaacccgttaagggtaaacgtttaaacggtttttccgaaaccctttaaacccgttttacccgtaacttacggttaaaccctaaaacggtaacgttaaccggtttaacccaaccggttaccccctacgtacggtacccttaccgttaccgggtttaccgggggaccggggaaaacgggttaccggaaaaggggttccggtaaaagaccgttaaaaccgaaaaacggtaccgttggggtaaccggtctaaacccggg

SEQ ID NO: 310402 - DNA, 610 bp, Homo sapiens
  misc_feature: GZ8MTXP02I4SYK.51.78.H01.1.454.CMB.2.raw
  modified_base (295)..(295): a, c, t, g, unknown or other
  misc_feature (295)..(295): n is a, c, g, or t
tcagcgatcgtatacacgaccggtgctcgatttagtgtgagtagtttgggtttgggggctcctgggagaggagccccagccctggagattcccgaggtgtttccattccagtgatcagcactgaacacagaggactcaccatggagttgggactgagctggtattttccttttggcttagttttaaaggtgtccagtgtgaagtgctacgtggtggagtcgtggggagcctggtacagcctggcaggtccctgagactctctgtgcagctctggattcactttgatgtatttacncgactagtcgcgtacggtcggtaccgtactaacgtccgtacggtaggggtacgggtcgtgggtacggtcgggtacctacgtaacgttacgttaggtacgtaacgttaggtaggttacgtaagtccgtacgtagtcggacgtacttcggtagtacgggaacggtctactaccactagtccacgacgacaacaacgacaaactcctctagtactcacgaacaaactcgaacgtcgtacgagacgacgcgagacgtacgtacgtcttagtactacgacgacgaagaacgtaacgaacgcaacgacgtacgtaacgtac

SEQ ID NO: 310403 - DNA, 608 bp, Homo sapiens
  misc_feature: GZ8MTXP02G8OPA.51.78.H01.1.454.CMB.2.raw
  modified_base (229)..(229): a, c, t, g, unknown or other
  misc_feature (229)..(229): n is a, c, g, or t
  modified_base (317)..(317): a, c, t, g, unknown or other
  misc_feature (317)..(317): n is a, c, g, or t
  modified_base (502)..(502): a, c, t, g, unknown or other
  misc_feature (502)..(502): n is a, c, g, or t
  modified_base (543)..(543): a, c, t, g, unknown or other
  misc_feature (543)..(543): n is a, c, g, or t
tcagcgatcgtatacacgaccggtgctcgatttagtgtgagtagtttgggtttgggcacgaccggtgctcgatttagtgtgagtagtttgggtttgggcacgaccggtgctcgatttagtgtgagtagtttgggtttggggaggagtcagtctcagtcaggacacagcatggacatgagggtccccgctcagctccgtggggctcctgcctactctggctccgaggtcnccagatgtgacatccagatcgaccagtctccatccctcctgtctcgctatctaggtaagacgacagacgtcacatcagttcgccgganaagtcaagacgctaagtacgctaacgtacttaaatttaagtcgtatacagcaacggacgaaccgaaacgggtaaaccctacccctaacgtctagaacttctagtcatcgactaacttacgtaaagttcgggaaacggttcggtaccctaagttaccgtaaaggttcagggtcgagtaggggtaanccgttggaggtaccagttacttccacttcgaccaccgttanacgagtcgtacgtacgcgtaacgtaacgtagtaacgtttactacgtaacctttaacgtacgtacg

SEQ ID NO: 310404 - DNA, 590 bp, Homo sapiens
  misc_feature: GZ8MTXP02IIOXS.51.78.H01.1.454.CMB.2.raw
  modified_base (259)..(259): a, c, t, g, unknown or other
  misc_feature (259)..(259): n is a, c, g, or t
  modified_base (264)..(264): a, c, t, g, unknown or other
  misc_feature (264)..(264): n is a, c, g, or t
  modified_base (285)..(285): a, c, t, g, unknown or other
  misc_feature (285)..(285): n is a, c, g, or t
  modified_base (305)..(305): a, c, t, g, unknown or other
  misc_feature (305)..(305): n is a, c, g, or t
  modified_base (483)..(483): a, c, t, g, unknown or other
  misc_feature (483)..(483): n is a, c, g, or t
tcagcgatcgtatacacgaccggtgctcgatttagtgtgagtagtttgggtttggggggagaggagccccagccctgagattcccaggtgtttccattcagtgatcagcactgaacacagaggactcaccatggagttgggactgagctggtatttttccttttggcttattttaaaaggtgtccagtgtgaagtgctactggtggagtcgtggggggagcctggtacagcctggcaggtccctgagctctcctgtgcngcctntggattctacttgatgattangcctatgcacgtcgggccgnaacgctccggagggacggctgggaggtgggtactcgagtattaggtagtaataggtgtatatagcttagcggacgtactcgtaggtaggaacggggtccctattaccactactctaccaagacgaacgaacaccgaaacgaacctcctagtacttcagacaaagtagaaacgtacgtnaggaagacgctaggacgacgacggttcttagttactacgtcggaacaaccgaaaacgaccgaaaggaaccaacgacgtacgtacggtaacctacgtaaacttaacgg

SEQ ID NO: 310405 - DNA, 636 bp, Homo sapiens
  misc_feature: GZ8MTXP02FM39Y.51.78.H01.1.454.CMB.2.raw
tcagcgatcgtatacacgaccggtgctcgatttagtgtgagtagtttgggtttgggggctctgggagaggagccccagccctgagattcccaggtgtttccattcagtgatcagcactgaacacagaggactcaccatggagttgggactgagctggtattttccttttggcttattttaaaaggtgtccagtgtgaagtgctactggtggagtcgtgggggagcctggtacagcctggcaggtccctgagactctcctgtgcagcctctggtacttccacctttgatgtattatcgccatcgcacggtcggggtccgacaacgccgtaccggaggggaacgggccgtaggggtaggttcggggtctacgtacggttagtttaggttaggaattaggtaggtactatcgcctagtcggaccgtacctggtacggacgggtaccggtacttacctaccgtactactaccgacgaacgaaccgaaaccgaacctaaacgaaccgttaccctcgtaatactagacaaataacgtaaccgagtacgtacgagagacgtagacggacgacggtccttagtacgttactacgacgacgaaaacgaacgaacgaacgaacgacgtacgtacggtacttaaacg

SEQ ID NO: 310406 - DNA, 625 bp, Homo sapiens
  misc_feature: GZ8MTXP02I590M.51.78.H01.1.454.CMB.2.raw
  modified_base (287)..(287): a, c, t, g, unknown or other
  misc_feature (287)..(287): n is a, c, g, or t
  modified_base (328)..(328): a, c, t, g, unknown or other
  misc_feature (328)..(328): n is a, c, g, or t
tcagcgatcgtatacacgaccggtgctcgatttagtgtgagtagtttgggtttgggcacgaccggtgctcgatttagtgtgagtagtttgggtttggggaggagtcagtctcagtcaggacacagcatggacatgagggtccccgctcagctcctggggctcctgctactctggctccgaggtgccagatgtgacatccagatgacccagtctccatcctccctgtctgctatctgtaggagacagatcaccatcacttgccggacaagtcagagctattagccgtnttaatttaaatggtatcagcaagacgaccgaagggaaaccncccctaaacgtccagatctatcgatcgactatacctaaagtttagggaaaacgttcggggtaccctaagtaccgtaaagggttcaaggtgagtaggtaggtaactcgtagggaactagtactttacactctacaacctatccaagtacctaagtcgttgaccgtaactaggaaacgtttgtttaacaaccttaaaactttaccaacgttacggtaaaccaaactaacggtaacgtttaaaccgaaccgtaaccccttacaccgtacttaccggtaccgtttaacggggaacccgggg

SEQ ID NO: 310407 - DNA, 619 bp, Homo sapiens
  misc_feature: GZ8MTXP02JFEB0.51.78.H01.1.454.CMB.2.raw
tcagcgatcgtatacacgaccggtgctcgatttagtgtgagtagtttgggtttgggggggagaggagccccagccctgagattcccaggtgtttccattcagtgatcagcactgaacacagaggactcaccatggagttgggactgagctggattttcctttggctattttaaaaggtgtccagtgtgaagtgctactggtggagtcgtgggggagcctggtacagcctggcaggtccctgagactctcctgtgcagcctcgtggacttctacctttgatgtattatcgccatgctacgtggggccgcaagccgtccgaggggacggcgtggaggtgggtctcgacgttagttagttggaataggtggttatagtacgtccttagtcggcggtactcgtgtaggaacggggtccgtatttaccaacgtactccgtaccagaacgaacgtaaaccgaccaaacgtaaccttcccgtagtactcgtacgactaaagacgactaagtacctaggacgtagctaggaacgcgaccggtcttacggttacttacgtagaccgaacgaaaacgcccgaaacggaacgaaacgacgtacgtaggtacctaactaaacgtttaacgg

SEQ ID NO: 310408 - DNA, 610 bp, Homo sapiens
  misc_feature: GZ8MTXP02HOP73.51.78.H01.1.454.CMB.2.raw
  modified_base (227)..(227): a, c, t, g, unknown or other
  misc_feature (227)..(227): n is a, c, g, or t
  modified_base (400)..(400): a, c, t, g, unknown or other
  misc_feature (400)..(400): n is a, c, g, or t
  modified_base (431)..(431): a, c, t, g, unknown or other
  misc_feature (431)..(431): n is a, c, g, or t
tcagcgatcgtatacacgaccggtgctcgatttagtgtgagtagtttgggtttggggaggagtcagtctcagtcaggacacagcatggacatgagggtccccgctcagctcctggggctcctgctactctggctccgaggtgccagatgtgacatccagatgacccagtcctccatcctccctgtctgcatctggtaggagacagacgtcaccatcacttggccggnaagtcagagactatagcagtcttaatttaaagtggtatcgagtcaaggacgaaccgaagggaaacctccccgtaacctcctagactctatggatcgacacttaccgtaaagtttacggggaaacggtccgggtaacccagttacgtaaaggttcaggttggcgtagggttagntcggaggactagtacttcactctacactacncgagtctaaggttgcgacctacgtaaggtactttacgtttagtaacctacttacgtacgtacgtacaaagtacgtaacgtaacgtacctacctacgaactcgtacgttacggttaccgggacgggtaacggaccgtaagggcgtaacgactaacggaaacgtacgtggtacggctaacg

SEQ ID NO: 310409 - DNA, 674 bp, Homo sapiens
  misc_feature: GZ8MTXP02JH99I.51.78.H01.1.454.CMB.2.raw
  modified_base (266)..(266): a, c, t, g, unknown or other
  misc_feature (266)..(266): n is a, c, g, or t
  modified_base (299)..(299): a, c, t, g, unknown or other
  misc_feature (299)..(299): n is a, c, g, or t
  modified_base (325)..(325): a, c, t, g, unknown or other
  misc_feature (325)..(325): n is a, c, g, or t
tcagcgatcgtatacacgaccggtgctcgatttagtgtgagtagtttgggtttgggggctctgggagaggagccccagccctgagattcccaggtgtttccattcagtgatcagcactgaacacagaggactcaccatggagttgggactgagctggtatttttccttttggcttaattttaaaaggtgtccagtgtgaagtgctacgtggtggagtcgtgggggagcctggtacagcctggcaggtccctgacgactctcctgtncagcctctggtacttcacgtttgatgtatttancgcctagtgactacggtcgggtccgnaacgctaccggaggggacgggtcgtgggagtcggtctacgacgttagttaggttggaattaggtaggtagttagtcgtccgtaaggtcgacgggtacttagtggtaggtaaacggggtcctacttccgaaccctagttacccacccgaaggaaccgaacccgaaacggtaacccaaacggtaaacccttcccgttaagtaaccttcgaacggtaacaaaacgttcggaaactcggtacgtaggaaggagtcgtaagggaaccggtacgtaccggttaccgttagttacgttacgacgaccgaacgaaaacgacccgtaaagaccgtaaaccgaggtcttaacggtaacc

SEQ ID NO: 310410 - DNA, 561 bp, Homo sapiens
  misc_feature: GZ8MTXP02HDG07.51.78.H01.1.454.CMB.2.raw
  modified_base (201)..(201): a, c, t, g, unknown or other
  misc_feature (201)..(201): n is a, c, g, or t
  modified_base (414)..(414): a, c, t, g, unknown or other
  misc_feature (414)..(414): n is a, c, g, or t
tcagcgatcgtatacacgaccggtgctcgatttagtgtgagtagtttgggtttggggaggagtcagtctcagtcaggacacagcatggacatgagggtcccccgctcagctcctggggctcctgctactctggctccgaggtgccagatgtgacatccagatgacccagtcctccatcctccctgtctgcatctgtagganacagagtcaccatcacttggccggcaagtcagagcattagcagtctaatttaaatggtatcagcagagaccaagggaaacgcccctaaacctcctagatctatgatgcatacctaagtttaggaaaggtccggggtaccctagtacgtaaaggttcaaggttggcgtaggtggatcgtagggacagtacttcactctacacatcagcagtcgngcgactagaagttattgactacttactatgtacaacgtagaacgttaacaccgtacccctcaacgtccttacgtaccggtttacgggacgggtaacggaaccgtaagggagaagactaaacgaaaacgtaacgttggacggactacg

SEQ ID NO: 310411 - DNA, 703 bp, Homo sapiens
  misc_feature: GZ8MTXP02JAJWK.51.78.H01.1.454.CMB.2.raw
tcagcgatcgtatacacgaccggtgctcgatttagtgtgagtagtttgggtttgggcacgaccggtgctcgatttagtgtgagtagtttgggtttggggaggagtcagtctcagtcaggacacagcatggacatgagggtccccgctcagctccgtggggctcctgctactctggctccgaggtgccagatgtgacatccagatcgacccagtcctccatccctccctgtctgcatcgtagtaggagacagacgtccacatcacgttcggaccggacaagtcgaagacgcctaatttacggacagtactttaaagtttaaagtcggtaatacgagtacgacggtaacgaacccgaaacggggaaaccctaccccttaaacctccgtagacttactaagtcgtatacgactacgttaaccgtaaagtttacggggaaacggttccggggtaccctaagtacgtaaacggttcgaaggtcggagttaagggtcgtacgtacggtaggaacctagttactttaccaacgttcctaccaaacgtacgttacgaacgtcgtacgttacggtacggtaccgtaaccgttagtaaaagtttcgttttaacaaccgtttaaacttacgttaacgtacgtaaaccgtaaaggacgttaacctaaccgtaacccgtacccctagaaccgttcctacggttacgttaaccgggg

SEQ ID NO: 310412 - DNA, 646 bp, Homo sapiens
  misc_feature: GZ8MTXP02JU1YE.51.78.H01.1.454.CMB.2.raw
  modified_base (261)..(261): a, c, t, g, unknown or other
  misc_feature (261)..(261): n is a, c, g, or t
  modified_base (320)..(320): a, c, t, g, unknown or other
  misc_feature (320)..(320): n is a, c, g, or t
tcagcgatcgtatacacgaccggtgctcgatttagtgtgagtagtttgggtttgggcacgaccggtgctcgatttagtgtgagtagtttgggtttgggcacgaccggtgctcgatttagtgtgagtagtttgggtttggggaggagtcagtctcagtcaggacacagcatggacatgagggtccccgctcagcctccgtggggctcctgctactcgtggctccgaggtcgccagatgtgacatccagatcgacccagtccnccatccctccctgtcctgctatctggtagagacagacgtcaccatcacgttcggccggnaagtcagacgctaattagactagtactttaattaaagtgtatacgagcgaagacgaccgaaacggggaacctaccccctaactccgtagacttactagtgactcgactagtccgtaaaggtttacgggaaacggttccgggaccctaggttaaccgtaacggttacgtaaggtcggtactagggggttagacgtttcggaacggggtaacctaaggtttacctttaccaccgttaccttacccgaaaccttattaccgaaacggtcgtaggtccgtacggacctaacgtagtaacgtttacttcgaacctttaacggttactaccg

SEQ ID NO: 310413 - DNA, 638 bp, Homo sapiens
  misc_feature: GZ8MTXP02H4VG8.51.78.H01.1.454.CMB.2.raw
tcagcgatcgtatacacgaccggtgctcgatttagtgtgagtagtttgggtttgggggctctgggagaggagccccagccctgagattcccaggtgtttccattcagtgatcagcactgaacacagaggactcaccatggagttgggactgagctggattttccttttggctattttaaaaggtgtccagtgtgaagtgctactggtggagtcgtgggggaggcctggtacagcctggcaggtccctgagactctcctgtgcagcctctggattcacctttgatgattatgccatgcacgtgggccgcaagctaccgaggggacggccgtgggagtgggtctctacgttattagtgaataggtggtagtatgtcctagtggcgtactcgtggtacggaacggggtccatttcccgaacctatcccgttacccgaaggaacgaaacccgaaaccggcccaaaaggtaaacccttccccgttaaggtaactttccgaggaacctaaaagtcgaaaactacgttctaaggaggacgtcgtaaggacggaacgtaccggttacctttaggttaaacttcgacgtaccgaaacgtaaaaacggccccgaaaagggcccaaaacggcgtacgtaacggttaacc

SEQ ID NO: 310414 - DNA, 654 bp, Homo sapiens
  misc_feature: GZ8MTXP02JOESQ.51.78.H01.1.454.CMB.2.raw
tcagcgatcgtatacacgaccggtgctcgatttagtgtgagtagtttgggtttgggggggagaggagccccagccctgagattcccaggtgtttccattcagtgatcagcactgaacacagaggactcaccatggagttgggactgagctggtattttcctttggcttattttaaaaggtgtccagtgtgaagtgctactggtggagtcgtgggggagcctggtacagcctggcaggtccctgagactctcctgtgcagcctcgtggtattccacctttgatgtattatcgcctatcgcacggtcggggtaccgacaacgccgtacggaaggggacggccgtgggaggttcgggtctacgtacgttagttaggttaggaattaggtagtaagtatacggaccttagtcgggaccgtacttcggtcggtagggaacggggcctattacccgaacttactccacgaagaacgaacaccgacaaacgtacctccgtatactccgtagaactaaagtcgaaactcgttacgaggaagtacgcgtaacggaacggtaccgacgggttcctttaaggtaccttacgcggtaaaccgaaacgaaaacggacccgaaaggaaccaaaaggcgtacgtacggtaaactacgtaaagtaacccg

SEQ ID NO: 310415 - DNA, 640 bp, Homo sapiens
  misc_feature: GZ8MTXP02F1LYO.51.78.H01.1.454.CMB.2.raw
  modified_base (286)..(286): a, c, t, g, unknown or other
  misc_feature (286)..(286): n is a, c, g, or t
  modified_base (616)..(616): a, c, t, g, unknown or other
  misc_feature (616)..(616): n is a, c, g, or t
tcagcgatcgtatacacgaccggtgctcgatttagtgtgagtagtttgggtttgggcacgaccggtgctcgatttagtgtgagtagtttgggtttggggaggagtcagtctcagtcaggacacagcatggacatgacgggtccccgctcagctccgtggggctcctgctactctggctccgaggtgccagatgtgacatccagatcgacccagtctccactccctcctgtctgcatcgtagtaggagacagacgtcaccagtcacgttcggccggacaagtcaagngtacaattacgctagtactttaatttaaagtggtactcgagacaagacgaaaccggtaaacgggaaaccctcccctaactccccgtagtaactacgtactagacgtcgacgtaacttaccgttaaagtttacggggaacgttacggggtaccagttacgtaaggttcagggtcgagtagtaggactacggtaaggtactaagtactttacacttacctacctaactatccgaagcgtaaggtcgtacggaacgtacgtaagtacgttactttacgaactttacgttactacgtaacgtacaaacgtgtaaacgtaaccacgttaccctanaacgtcgtaaccttggtaaccggg

SEQ ID NO: 310416 - DNA, 748 bp, Homo sapiens
  misc_feature: GZ8MTXP02IAZ6Y.51.78.H01.1.454.CMB.2.raw
  modified_base (189)..(189): a, c, t, g, unknown or other
  misc_feature (189)..(189): n is a, c, g, or t
  modified_base (329)..(329): a, c, t, g, unknown or other
  misc_feature (329)..(329): n is a, c, g, or t
tcagcgatcgtatacacgaccggtgctcgatttagtgtgagtagtttgggtttgggcacgaccggtgctcgatttagtgtgagtagtttgggtttgggcacgaccggtgctcgatttagtgtgagtagtttgggttggggaggagtcagtctcagtcaggacacagcatggacatggagggtcccccgntcagctccgtggggcctcctgctactcgtggcctccggaggtcgccagactgtgaacatccagatcgacccagtcctcccactccctccctgtcctgacatctaggaagagacagatcaccattcacgttcggcccgganaaagtcgaagagtacctaaagttacgacctagtactttaaagtttaaaagttggtaactaccgagaccgaaggacgaacccggaaaacggggaaaccctccccccgttaaaacgtcccgtagtaaacttaccgttaagtagtaagttacggactaacgttaaaccgttaaaggttttacggggaaaacgggttccggggttaccctaagttacggtaaacggtttccgaaggtttcgggaccgtaagggtcggttaacgtacggtacggggtaacctaaggtttacctttaccgtaaccttacccgtacctaaccttaaacgtaccgtaaggtaccgttacggtcggtaaccgtaaccgtaaccgttaacgtaacggtttaacgtttaccgtaacctttaaaccgttttaaccctaccg

SEQ ID NO: 310417 - DNA, 689 bp, Homo sapiens
  misc_feature: GZ8MTXP02GK0C2.51.78.H01.1.454.CMB.2.raw
  modified_base (258)..(258): a, c, t, g, unknown or other
  misc_feature (258)..(258): n is a, c, g, or t
  modified_base (319)..(319): a, c, t, g, unknown or other
  misc_feature (319)..(319): n is a, c, g, or t
  modified_base (513)..(513): a, c, t, g, unknown or other
  misc_feature (513)..(513): n is a, c, g, or t
tcagcgatcgtatacacgaccggtgctcgatttagtgtgagtagtttgggtttgggggggagaggagccccagccctgagattcccaggtgtttccattcagtgatcagcactgaacacagaggactcaccatggagttgggactgagctggtatttcctttggctatttaaaggtgtccagtgtgaagtgctactggtggagtcgtgggggagccgtgggtacagccgtggcacggtccctgagactctcctgtgcngcctgtggattctactttgatgtactttatcgacctagtcgcctacggtcggggtcccganaacggcctacccggaaggggacgggtcccgtggggtacgggtttcggggtcttacggtacgtttaagtttagggttaggtaagttgggtagttacgtaatacgtccttagtcggccggtaattccgtagggtagggaacgggtcctattcccactactccgtaccaaggaacaacgaccgtaccaaacgtaccncccttgtacttcgacgtaaccgtaaagtacgaactacgtcgaggagtagacccgtaggaccgtaacgtccgggttacttaggttacgtacgtacggaaccccggaagtaaaaaccggcctaaacggggaaccaacgacgttacgtacgggtttaactaacctaaacggttaaccgg

SEQ ID NO: 310418 - DNA, 648 bp, Homo sapiens
  misc_feature: GZ8MTXP02IDU4B.51.78.H01.1.454.CMB.2.raw
  modified_base (202)..(202): a, c, t, g, unknown or other
  misc_feature (202)..(202): n is a, c, g, or t
  modified_base (231)..(231): a, c, t, g, unknown or other
  misc_feature (231)..(231): n is a, c, g, or t
  modified_base (342)..(342): a, c, t, g, unknown or other
  misc_feature (342)..(342): n is a, c, g, or t
  modified_base (409)..(409): a, c, t, g, unknown or other
  misc_feature (409)..(409): n is a, c, g, or t
  modified_base (417)..(417): a, c, t, g, unknown or other
  misc_feature (417)..(417): n is a, c, g, or t
  modified_base (421)..(421): a, c, t, g, unknown or other
  misc_feature (421)..(421): n is a, c, g, or t
  modified_base (425)..(425): a, c, t, g, unknown or other
  misc_feature (425)..(425): n is a, c, g, or t
tcagcgatcgtatacacgaccggtgctcgatttagtgtgagtagtttgggtttggggaggagtcagtctcagtcaggacacagcatggacatgagggtccccgctcagctcctggggctccctgctactctggctccgaggtgccagatgtgacatccagatcgacccagtctccatccctccctgtctgcatctgtagganacagagtccacatccagttcggccggganaagtcaaggagctattgacagtacttaaatttaaagtggtaatacgagacgaaggaacgaacccgaaggggaaaaccctacccccgttaacctcctagtactactagtagntacgactaacttaccgtaagtttaggggaaaggttccccgggacctagtacgtaagttcgaggtcgngaaggtgntcgngganattatctatctacacatcagcgtagtcgtacgccgtacgtagttagttactttagaacttaacgtttaccattcaacaaagtacgtaacttaccgtaacccgtaccctacgtacgtcctttaccggtacgtttccgggggaaccggggtaacgggtaacggtaacggttagggaaacgttaacgaaaccgtaaaaccggacggttgggaacggttctaaccgg

SEQ ID NO: 310419 - DNA, 693 bp, Homo sapiens
  misc_feature: GZ8MTXP02IT1D6.51.78.H01.1.454.CMB.2.raw
  modified_base (253)..(253): a, c, t, g, unknown or other
  misc_feature (253)..(253): n is a, c, g, or t
  modified_base (275)..(275): a, c, t, g, unknown or other
  misc_feature (275)..(275): n is a, c, g, or t
  modified_base (296)..(296): a, c, t, g, unknown or other
  misc_feature (296)..(296): n is a, c, g, or t
  modified_base (322)..(322): a, c, t, g, unknown or other
  misc_feature (322)..(322): n is a, c, g, or t
tcagcgatcgtatacacgaccggtgctcgatttagtgtgagtagtttgggtttgggggctctgggagaggagcccccagccctgagattcccaggtgtttccattcagtgatcagcactgaacacagaggactcaccatggagttgggactgagctggtatttttccttttggcttaattttaaaaggtgtccagtgtgaagtgctacgtggtggagtcgtgggggacgcctggtacagcctggcaggtcccngagtcctctctgtcgcagcctntggattctacttgatgattangaccagtgctacgtcggggacccgtnaacggtccgtccggaaggggaacgggtcccgttagggacggttcgggtcctaacgtacgtttagtttacgttaggtaattaggttaggttaagttaactcggtacccttaagtcggaccgtacttcgtgggtacgaacggggtccgtactccgaaccacgttccacgagacgaaccaacccgaccaaagtacccttcccgtagtactacgtacgaacgtaaactagaccaaggttcgtaaacggggagtacggtacgtaacggaaccgggtaaccgtacccgggttactttacggttacctttacggacgaaccgaaaacgtaaaaccggaacgaacggaacccaacgtacgtacgtttaacggtaaaccg

SEQ ID NO: 310420 - DNA, 673 bp, Homo sapiens
  misc_feature: GZ8MTXP02HAQAN.51.78.H01.1.454.CMB.2.raw
  modified_base (255)..(255): a, c, t, g, unknown or other
  misc_feature (255)..(255): n is a, c, g, or t
  modified_base (272)..(272): a, c, t, g, unknown or other
  misc_feature (272)..(272): n is a, c, g, or t
  modified_base (297)..(297): a, c, t, g, unknown or other
  misc_feature (297)..(297): n is a, c, g, or t
  modified_base (384)..(384): a, c, t, g, unknown or other
  misc_feature (384)..(384): n is a, c, g, or t
  modified_base (456)..(456): a, c, t, g, unknown or other
  misc_feature (456)..(456): n is a, c, g, or t
  modified_base (472)..(472): a, c, t, g, unknown or other
  misc_feature (472)..(472): n is a, c, g, or t
tcagcgatcgtatacacgaccggtgctcgatttagtgtgagtagtttgggtttgggcacgaccggtgctcgatttagtgtgagtagtttggggtttgggggaggagtcagtctcagtcaggacacagcatggacatgacgggtccccgctcagctccgtggggctcctgctactctggctccgaggtcgccagatgtgacatccagatcgacccagtcctccacttccctccctgtctgctatcgtaggtagganacgagataccacgatcncgttcggccggtacaaagtcaacgngtactatacgctagtactttaagtttaaagttggtactacgagacgagaaccgaacgaaaccggggtaacctacccctactccgtanacgttacatacgatacgctattacgtaaaggtttagggaacggttcccgggacttacgtaagttacgtacgngtacgagtgtagtcgnggtacgactacgttctactactccaaactcctagtacgacgtacgtacggtacgtccgtaacgttacgtaagtaacggtttactttaacggaaccctttaaacggtttacctacggttaaactaacctaacggtaacttaacccgtaacttaacccgaccccggtataccgtaaccgttccgtaaacgggtttaccggggg

SEQ ID NO: 310421 - DNA, 679 bp, Homo sapiens
  misc_feature: GZ8MTXP02GD24Z.51.78.H01.1.454.CMB.2.raw
  modified_base (229)..(229): a, c, t, g, unknown or other
  misc_feature (229)..(229): n is a, c, g, or t
  modified_base (577)..(577): a, c, t, g, unknown or other
  misc_feature (577)..(577): n is a, c, g, or t
tcagcgatcgtatacacgaccggtgctcgatttagtgtgagtagtttggggtttgggggggagaggagccccagccctgagattcccaggtgtttccattcagtgatcagcactgaacacagaggactcacatggagttgggactgagctggtattttcctttggcttaatttaaaggtgtccagtgtgaagtgctacgtggtggagtcggtgggggacgcctggtacngccgtggcaggtccctgacgtactctccgtgtcgcacgtcctgtggtacttctacctttgatgtattatcgcctatcgctacgtcggggtaccgagaacgccgtaccggaaggggacggtccgtaggggtacgtcggggtcctaccgtaagtttaagttaggtaggaagttagggtagtagtaatacggccttaagtcgggcgtacgttcgtaggggtacggaaccggggtcgtacttacccaaacgtacttacccgtacgaaaggaaccgaacccgaaacggaacccctaaaagtaacccttccgttagtaactccaggtaactaagtacaacgtagtacgagaggntacgtggaaccgacgtcggtatttaggtacttcgaggaccaacggtaaaacgccgaaaacgaactaacgacggttcgtacggtaatacccgtaagttaacgg

SEQ ID NO: 310422 - DNA, 704 bp, Homo sapiens
  misc_feature: GZ8MTXP02I6W6E.51.78.H01.1.454.CMB.2.raw
  modified_base (320)..(320): a, c, t, g, unknown or other
  misc_feature (320)..(320): n is a, c, g, or t
tcagcgatcgtatacacgaccggtgctcgatttagtgtgagtagtttgggtttgggggctctgggagaggagccccagccctgagattcccaggtgtttccattcagtgatcagcactgaacacagaggactcaccatggagttgggactgagctggtattttcctttggcttattttaaaaggtgtccagtgtgaagtgctacgtggtggagtcgtgggggaggtccgtggtacgacgccgtggctacgggtcccctaggacgtaccttcctccgtggtcgccacgcccttcgtggtacttcctactttgatgtaattngccatcgctcgtcgggtccgacaacgccgtacggaaggggacgggtccgtgggaggtcgggtcctacgtaacggttagtttaggtagtaagtaggttaggtaacgttagtacgtaccttagtcggtaccgtacgttcgtagggtacgggaaacggggtaccgtacttacccgaacctacgttacccgaccgaagaacgaaacccgaaaccgacccgtaaaacgtacccttacccgtagttaacctacgtacgaaactaaaagtacgaaacgtgttacgaggataacggctaagggaacggtaccgaacggttccttaagtacctcgtacgacgtaaacgaaaacgacccgaaaggtacccaaagtaccgtacgtacggtaaacg

SEQ ID NO: 310423 - DNA, 680 bp, Homo sapiens
  misc_feature: GZ8MTXP02GAE3J.51.78.H01.1.454.CMB.2.raw
  modified_base (228)..(228): a, c, t, g, unknown or other
  misc_feature (228)..(228): n is a, c, g, or t
  modified_base (295)..(295): a, c, t, g, unknown or other
  misc_feature (295)..(295): n is a, c, g, or t
  modified_base (311)..(311): a, c, t, g, unknown or other
  misc_feature (311)..(311): n is a, c, g, or t
tcagcgatcgtatacacgaccggtgctcgatttagtgtgagtagtttggggtttgggggggagaggagccccagccctgagattcccaggtgtttccattcagtgatcagcactgaacacagaggactcaccatggagttgggactgagctggtattttcctttggctattttaaaaggtgtccagtgtgaagtgctactggtggagtcgtgggggagccgtggtacngcctggcaggtccctgagactctcctgtgcagcctgtggattcgacctttgatgtattatgcctagngcgacgtgggtcccgnaagcctacgaggggacggtccgtgggagtcggtctcgacgttataggttgaatggtgtagtatcgcctagtcggacgtactgtagtaggaacgggtccgtacttaccgacctagtcctaccgaaggaacgaaccaaccggaccaaacggaaccttcccgtattactccgtagaccctaaagtacgaaactgtaccgaggtacgagtacgtacggaacgggtaccgacgggttacccgttaggtttaaccgttaacccggttacgggaacccgtaaaccgtaaaaacgggaccccgtaaaaggggaaacccttaaaccggaggttaacccgtttacggggtaaaccttaaccgtaaaaggtttaacccgg

SEQ ID NO: 310424 - DNA, 676 bp, Homo sapiens
  misc_feature: GZ8MTXP02GIC4A.51.78.H01.1.454.CMB.2.raw
  modified_base (267)..(267): a, c, t, g, unknown or other
  misc_feature (267)..(267): n is a, c, g, or t
  modified_base (289)..(289): a, c, t, g, unknown or other
  misc_feature (289)..(289): n is a, c, g, or t
  modified_base (313)..(313): a, c, t, g, unknown or other
  misc_feature (313)..(313): n is a, c, g, or t
  modified_base (571)..(571): a, c, t, g, unknown or other
  misc_feature (571)..(571): n is a, c, g, or t
tcagcgatcgtatacacgaccggtgctcgatttagtgtgagtagtttgggtttgggggggagaggagccccagccctgagattcccaggtgtttccattcagtgatcagcactgaacacagaggactcaccatggagttgggactgagctggtattttccttttggcttaattttaaaaggtgtccagtgtgaagtgctactggtggagtcgtgggggagcctggtacagcctggcaggtccctgacgactctcctgtgcagtcctntggacttcactttgatgattancgcatgctacgtcggggtcccganaacgtccgtaccggaaggggaacggggtccgtagggtacgggttcgggtcttaccgtaacggttgtttaaggtttagggaaattagggttaggggttaagtaagttacggtaccctttaagtcgggtcgggtaacttcggtagttacgggggaacgggtccctactttaccgacctactcctacccgaagaacgaacgaaccgtaaccaaacgtaacctcccgtagtactcgtacgaactaaatcgaaacgcgtacgnggaacgtgacgtaggacgaacgtcggtcttaggtaacttacgacgacgaaacgaaaacgaccgaagaacgaaacgacgacgttacgtaactacgaacgttaacgg

SEQ ID NO: 310425 - DNA, 674 bp, Homo sapiens
  misc_feature: GZ8MTXP02IPQDC.51.78.H01.1.454.CMB.2.raw
  modified_base (264)..(264): a, c, t, g, unknown or other
  misc_feature (264)..(264): n is a, c, g, or t
  modified_base (281)..(281): a, c, t, g, unknown or other
  misc_feature (281)..(281): n is a, c, g, or t
  modified_base (288)..(288): a, c, t, g, unknown or other
  misc_feature (288)..(288): n is a, c, g, or t
tcagcgatcgtatacacgaccggtgctcgatttagtgtgagtagtttgggtttgggggctctgggagaggagccccagccctgagattcccaggtgtttccattcagtgatcagcactgaacacagaggactcaccatggagttgggactgagctggtattttccttttggcttattttaaaaggtgtccagtgtgaagtgctactggtggagtcgtgggggagcctggtacagcctggcaggtccctgagactctcctgtgcngctctgattcactttgntgattancgccatgcacgtcgggtccgcaagctccggaggggacgggcctgggagtcgggtctacgacgttattaggttggaattaggttggttagttataggtcctaagtggaccggtacttcgtagggtacgggaaacggggtcctattccaaccattccctacgacgacgaacaaacccggaccaaacgacccttaccccgtgttaacttcgtacgaactaaaagtcaaaaccgtagtaccttagggaaacggacggtacggtaacggaccggtacccgtaccggttaccgtttaacggttaacgtttaccgtaccggtaaccgaaaaccgtaaaaccggaacccggtaaacggaaacccgaaacgtaccggtacgttaacggtaaaccg

SEQ ID NO: 310426 - DNA, 725 bp, Homo sapiens
  misc_feature: GZ8MTXP02H7BBD.51.78.H01.1.454.CMB.2.raw
  modified_base (308)..(308): a, c, t, g, unknown or other
  misc_feature (308)..(308): n is a, c, g, or t
  modified_base (368)..(368): a, c, t, g, unknown or other
  misc_feature (368)..(368): n is a, c, g, or t
tcagcgatcgtatacacgaccggtgctcgatttagtgtgagtagtttgggtttgggggctctgggagaggagccccagcccctgagattcccaggtgtttccattcagtgatcagcactgaacacagaggactcaccatggagttgggactgagctggtattttccttttggacttaattttaaaaggtgtccagtgtgaagtgctagtggtggagtcggtgggggacgcctggtacagccgtggcacggtccctgacgtacctctcctgtgccacgccctgtgtacttcctactttgactgtattancgcctagtgccgtacggtcgggtccgactaacgccgtaccggaagggacggtcgtagggngtcggtctacgtacgttagttagtaggtaagtaggttacggtaagtatcggtccttaagccgggtacgtacttcgtagggtacgggtaaaccgggtcctacgtttaccgaaacccgtcttaacccgttaccgaacggaaacgaacccgaaacccgtaacccgaaacgttaaacccgttcccgttaacggttacttacgtaacgaacgtaaacgtacgtaaactacggttacgaagaacggacgtacggttaacggaacggttaccgtaaccggttctttaacggtacgtttacgacgaaccgaaacgaaaaccgacggaaaacgacgaaaaccgtcgtacgtttaaccggtaaaccg

SEQ ID NO: 310427 - DNA, 841 bp, Homo sapiens
  misc_feature: GZ8MTXP02H9133.51.78.H01.1.454.CMB.2.raw
  modified_base (261)..(261): a, c, t, g, unknown or other
  misc_feature (261)..(261): n is a, c, g, or t
  modified_base (287)..(287): a, c, t, g, unknown or other
  misc_feature (287)..(287): n is a, c, g, or t
tcagcgatcgtatacacgaccggtgctcgatttagtgtgagtagtttgggtttgggggctctgggagaggagccccagccctgagattcccaggtgtttccattcagtgatcagcactgaacacagaggactcaccatggagttgggactgagctggtattttcctttggctattttaaaaggtgtccagtgtgaagtgctactggtggagtcgtgggggagcctggtacagcctggcaggtccctgagctctcctgtgcngcctcgtgattcacttgatgtattangccatgcacgtgggtccgacaagctaccgaggggacgggcctgggaggtcggtactcgtacgttagtttaggttaggtaaagttagggttagggttaaagttaacgtacggggttaccccgtttaagttaccggggtccgggttaacccgttcgggtttacggggtaacgggggtaaaacgggggtccccgtaaacggtttaccccgaaaccctacgttccccgttaccccggaacggaaaccgaaacccgaaaacccggaaaccccgtaaaccgttaaacccccggttcccccttaagggttaaccttaccgttaaaccggaactaaaaaacgttcggaaaacccgttaggttaccgtagggtaacggaaggtcccggttaaagggaaccgggtaaacccggtacccggggtttaaacccgttttagggttaaaaccgttttaacccggtacgggtaaacccggaaaaacccgaaaaaccgggtaaccccgaaaaacgggggtaacccctaaaacccggaacgggttacccgtttaacgggggtttaaaaccc

SEQ ID NO: 310428 - DNA, 675 bp, Homo sapiens
  misc_feature: GZ8MTXP02JL7MC.51.78.H01.1.454.CMB.2.raw
  modified_base (237)..(237): a, c, t, g, unknown or other
  misc_feature (237)..(237): n is a, c, g, or t
tcagcgatcgtatacacgaccggtgctcgatttagtgtgagtagtttgggtttggggaggagtcagtctcagtcaggacacagcatggacatgagggtccccgctcagctcctggggctcctgctactctggctccgaggtgccagatgtgacatccagatgacccagtctccatcctccctgtctgcatcgtgtaggagacagacgtccaacctatacctacgttcggacccgtanaacgtcgagacgactaagttacgactagtacttaaatttaagttggtactcgagacgaagaacgaaccggaagggtaaaccctaccccctaacctcgagtacttacgtagtgactcgactaacgttaccgttaagtttaaggggtaacggtccccggggttaacccagttacgtaacggttcgaaggttcggacgtagggtcggtacgttacggtacggactagttaccttactactactaccactatcgagctaggtcgtcgacgtacgtagaacgtttattcgaacttaacttactaacgttgaacgaatacggttaacttaccgtacccgtacctaccgtacgtacctacgtccggttaaccgggacggggtaaacggtaccgtaaggggtagaacgtaacgtaacgtaaacgtacgtcggtacggacttaaccg

SEQ ID NO: 310429 - DNA, 711 bp, Homo sapiens
  misc_feature: GZ8MTXP02GEVLP.51.78.H01.1.454.CMB.2.raw
  modified_base (250)..(250): a, c, t, g, unknown or other
  misc_feature (250)..(250): n is a, c, g, or t
  modified_base (325)..(325): a, c, t, g, unknown or other
  misc_feature (325)..(325): n is a, c, g, or t
  modified_base (355)..(355): a, c, t, g, unknown or other
  misc_feature (355)..(355): n is a, c, g, or t
tcagcgatcgtatacacgaccggtgctcgatttagtgtgagtagtttgggtttggggaggagtcagtctcagtcaggacacagcatggacatgagggtcccccgctcagctccgtggggcctcctgctactctggctccgaggtgccagatgtgacatccgagatcgaacccagtcctccactccctccctgtctgactatcgtaggtaaggacgacgagacgtaccactatctacgttcgggccggganaacgtcagactcagttacgatagtactttaaatttaagttggactagagacaaggaccgaacgaacggtaacccncccctaaccgtcgataccgtatatgactanaccttaacgtacgttaaggttaaacgggaaccggttccggtaacccctagtacgtaacggtttagcgggttacgcggttgggtaggtaaacgttcgggtaaccgggagttaaccttacggtttaccctaccgttaaccctaccgtaaaccctatacgtacggtacgtgggtacggtaccgtaacccgtggttaaacgtaaggtttctttacgtaaacctaacttacgtacctacgtaaccgtaactacgtaaccgttacgaccgttaccacgtactccgttccggttacgttaccggggacgtaaccggggaacgtacgggtagaacgtaacgtaacgaaactcgcggtactcgac

SEQ ID NO: 310430 - DNA, 610 bp, Homo sapiens
  misc_feature: GZ8MTXP02IB7IX.51.78.H01.1.454.CMB.2.raw
  modified_base (297)..(297): a, c, t, g, unknown or other
  misc_feature (297)..(297): n is a, c, g, or t
  modified_base (510)..(510): a, c, t, g, unknown or other
  misc_feature (510)..(510): n is a, c, g, or t
  modified_base (518)..(518): a, c, t, g, unknown or other
  misc_feature (518)..(518): n is a, c, g, or t
tcagcgatcgtatacacgaccggtgctcgatttagtgtgagtagtttgggtttgggggctctgggagaggagcccccagcccctgagattcccaggtgtttccattcagtgatcagcactgaacacagaggactcaccatggagttgggactgagctggtattttccttttggcttattttaaaaggtgtccagtgtgaagtgctatggtgagtcgtggggagcctggtacagcctggcaggtccctggacgactctcctgtgcagccctcgtggattccgtaccttgatgattatnccatgccacggtgggtccgactaagccgtacggaggggaacgggccgttagggaggtcggggttacctacggtaacgttaagtttaaggttaggtaaattagggtaggttaacgttagttacgtcctaagttcgccggtatcgtagtgaacgggtccattccactatctaccagaacacaaaccgactaaacgtaacctcctagacttcgtanaacaaganaacgagtagagagagagagacgacgacgtacgttacgtacgtacgtacgacgaacgaaacgaacgaacgacgaacgacgtacgtacgtaacg

SEQ ID NO: 310431 - DNA, 664 bp, Homo sapiens
  misc_feature: GZ8MTXP02IU0NY.51.78.H01.1.454.CMB.2.raw
  modified_base (232)..(232): a, c, t, g, unknown or other
  misc_feature (232)..(232): n is a, c, g, or t
  modified_base (261)..(261): a, c, t, g, unknown or other
  misc_feature (261)..(261): n is a, c, g, or t
  modified_base (268)..(268): a, c, t, g, unknown or other
  misc_feature (268)..(268): n is a, c, g, or t
tcagcgatcgtatacacgaccggtgctcgatttagtgtgagtagtttgggtttgggggctctgggagaggagccccagccctgagattcccaggtgtttccattcagtgatcagcactgaacacagaggactcaccatggagttgggactgagctggtattttcctttggctattttaaaaggtgtccagtgtgaagtgctacgtggtggagtcgtgggggagcctggtacngcctggcaggtccctgagtctctcctgtncagcctntggacttcacctttgatgtattatgccatgcacgtgggccgacaagcgtaccgaggggaacggccgtggacggtcgggtcctacgtacggttagtttaggtaggtaaattggttaggtaacttagtacggtcctaatcgggaccgtactcgtgggtacgggaacggggtcccgtaattccaaccgtacttcccgtaccgaacgtaacgaaccgaaaccgtacccaaacggtaaacccttcccgtagtaacttccgtacgaacaaaacgtagaacctaaggttccgtaggaacgtaggtcgtaggtaaacgggcttaaccggggtcctttaaggtacgtttacgacgtaccgaaagaaaacgcccgtaaacggacaacgacgtcgtaacggttaacc

SEQ ID NO: 310432 - DNA, 655 bp, Homo sapiens
  misc_feature: GZ8MTXP02IZCM8.51.78.H01.1.454.CMB.2.raw
  modified_base (328)..(328): a, c, t, g, unknown or other
  misc_feature (328)..(328): n is a, c, g, or t
tcagcgatcgtatacacgaccggtgctcgatttagtgtgagtagtttgggtttgggcacgaccggtgctcgatttagtgtgagtagtttgggtttggggaggagtcagtctcagtcaggacacagcatggacatgagggtccccgctcagctccgtggggctcctgctactctggctccgaggtgccagatgtgacatccagatcgacccagtcctccatccctcctgtctgcatcgtggtaggagacagagtccaccatccacgttggccggacaagtcaagacgactaattagacagtactttaaagtttaaagttggtaatacgnggtaaccaaggaaaccggaaacccggaaaacggggaaaccctaccccccttaaacttcccccgtagtacgttactaagtcgattcgactaacgtacgtaaagtttacgggaaagttcggtaccagtaccgtaagtcgaggtcgacaggttagacgttcgtaagggactaaggttactttacgaaccttcaacctaccataccgaagaccgtgttacgacgtaccgtacgtagtaatactttcgaaaccttaacttacaacttcgaactaaacgtagtaacctaacgtacccgtaccctactacgtcctaaccgttcgttaaccgggg

SEQ ID NO: 310433 - DNA, 744 bp, Homo sapiens
  misc_feature: GZ8MTXP02HL507.51.78.H01.1.454.CMB.2.raw
  modified_base (229)..(229): a, c, t, g, unknown or other
  misc_feature (229)..(229): n is a, c, g, or t
tcagcgatcgtatacacgaccggtgctcgatttagtgtgagtagtttgggtttgggcacgaccggtgctcgatttagtgtgagtagtttgggtttgggcacgaccggtgctcgatttagtgtgagtagtttgggttggggaggagtcagtctcagtcaggacacagcatggacatggacgggtccccgctcagctccgtggggctcctgctactctggctccgaggtcnccagatgtgacatccagatacgacccagtcctcctactccctcctgtctcgcagtctaggtaggagacgaacgtacgtccaacctataccgtaacgttcgggaccggtactaaacgtcgaaggacgacgtaaagttacgactaacggttaactttaaacgtttaaagtgtatacgagacaagacgaaccgaaagggaaaccctacccccgtaaactccgagtaactccgtaatgtacgagtactaacgttaacgttaaggtttaacgggaaacggttcgggtaccctaattaacggtaaacggtttcgaaagggttcggaactacggggttaggtaacgttacgggtaaacgggtaacttaaacggtttaccttaccgtaactttacccgtaaaccaacccttacgttaacgaaacggtccgttaagggttccgtaacggtaaccggttaaaccttaaacggtacggttttaaccgtttaacgaaacccttttaacgttttaaacccgtaaacgg

SEQ ID NO: 310434 - DNA, 631 bp, Homo sapiens
  misc_feature: GZ8MTXP02GOYRD.51.78.H01.1.454.CMB.2.raw
  modified_base (200)..(200): a, c, t, g, unknown or other
  misc_feature (200)..(200): n is a, c, g, or t
  modified_base (226)..(226): a, c, t, g, unknown or other
  misc_feature (226)..(226): n is a, c, g, or t
tcagcgatcgtatacacgaccggtgctcgatttagtgtgagtagtttgggtttggggaggagtcagtctcagtcaggacacagcatggacatgagggtccccgctcagctcctggggctcctgctactctggctccgaggtgccagatgtgacatccagatgacccagtctccatccctccctgtctgcatctgtagganacagagtcaccatcacttggccgggnaagtcagagcattagcagcttaatttaaatggtatcagcagagaccgaaggaacgcccctaactcctgatctatgtatgactactaccgtaaagtttagggaaaggttccggggtacccctagtacgtaaggttacaagggttcggcgtaggtagggtacttcggtaggggaacaggttactttccacttctaccaacctatcaagctaaggtcgtcgaccgtacctaggtaagtttacgtttagaaccttaaactttaacgtacgttacgtaacaacgtaaggtaaacgtttaccaaccgttaccccctatactccgttactaccggtttaccggacggggtacggaaccggtaagggtaggaacgtaacgtaacgaaaccgtaagtgtaccgggtactaccgg

SEQ ID NO: 310435 - DNA, 647 bp, Homo sapiens
  misc_feature: GZ8MTXP02IMGVN.51.78.H01.1.454.CMB.2.raw
  modified_base (233)..(233): a, c, t, g, unknown or other
  misc_feature (233)..(233): n is a, c, g, or t
  modified_base (301)..(301): a, c, t, g, unknown or other
  misc_feature (301)..(301): n is a, c, g, or t
  modified_base (324)..(325): a, c, t, g, unknown or other
  misc_feature (324)..(325): n is a, c, g, or t
tcagcgatcgtatacacgaccggtgctcgatttagtgtgagtagtttgggtttggggaggagtcagtctcagtcaggacacagcatggacatgagggtccccgctcagctcctggggctcctgctactctggctccgaggtgccagatgtgacatccagatcgacccagtcctccatccctccctgtctgcatctggtaggagacagagtcaaccatcacgttcggccggganaagtccagagctagtagctagtacttaatttaaagtgtaatcagcaagaacgaaccgaagggaaaccnccccctaacctcctagactctannatgacatacgtaagttaggaaaggtccgggtaccagtacgtaaaggttcaggtcgcgagtggacttcgtagggacagttaacttcctactacctaccgaacataccgagaccgtaggtcgtacgaccgtaaccgttaagtaagtttaactttacgtaaccttaaacttaccgttaactacgtaactaaacgtaagtaacgtttaaccacccgttaccctatacgtactttaccgtacggtttaccggggacgggtaccggtaaaccgtaaggggacgtaaacgtactaaaaccggtaaaacgtagtcggtacgtacgtaccg

SEQ ID NO: 310436 - DNA, 598 bp, Homo sapiens
  misc_feature: GZ8MTXP02FO70Z.51.78.H01.1.454.CMB.2.raw
  modified_base (199)..(199): a, c, t, g, unknown or other
  misc_feature (199)..(199): n is a, c, g, or t
  modified_base (285)..(285): a, c, t, g, unknown or other
  misc_feature (285)..(285): n is a, c, g, or t
  modified_base (444)..(444): a, c, t, g, unknown or other
  misc_feature (444)..(444): n is a, c, g, or t
tcagcgatcgtatacacgaccggtgctcgatttagtgtgagtagtttgggtttggggaggagtcagtctcagtcaggacacagcatggacatgagggtccccgctcagctcctggggctcctgctactctggctccgaggtgccagatgtgacatccagatgacccagtctccatcctccctgtctgcatctgtagganacagagtcaaccatcacttggccgggcaagtcagagcattagcagtacttaattaaattggtatcagcagacgaccgaaggaaccncccctaactcctagactctatgatcgactataccgtaagtttaggaacggtccgggtacccatacgtaagttcaggtgcgtaggtggtactcgtagggactagtacttacacttcgtacaacatcgacgctaggtgtcgaccgtacgtagtaaacgttntttacgaacttaacttacgtactacgtaacaaacgtaacggttaactaacctaccgtaccctagtaccgtacttaccgtacggttaccggacgggtaacggaaccgaagggtacgaaagtaacgtaacgaaaacgtcgtacggcgtaacgtccg

SEQ ID NO: 310437 - DNA, 676 bp, Homo sapiens
  misc_feature: GZ8MTXP02FJ6XS.51.78.H01.1.454.CMB.2.raw
  modified_base (289)..(289): a, c, t, g, unknown or other
  misc_feature (289)..(289): n is a, c, g, or t
  modified_base (316)..(316): a, c, t, g, unknown or other
  misc_feature (316)..(316): n is a, c, g, or t
tcagcgatcgtatacacgaccggtgctcgatttagtgtgagtagtttgggtttgggcacgaccggtgctcgatttagtgtgagtagtttgggtttgggcacgaccggtgctcgatttagtgtgagtagtttgggtttggggaggagtcagtctcagtcaggacacagcatggacatgagggtccccgctcagctccgtggggctcctgctactctggctccgaggtgccagatgtgacatccagatcgacccagtcctccatccctccctgtctgcatcgtagtagganacagacgtcacatcacgttggccgganaagtcagagctaagttagcaagtacttaaatttaaagttggtatacgagacaagacggaaaccgaaacggggtaaaaccgtccccccttaaactccgtagtaacttactaatagtacttacgacctaaactttaccgtaaaggttttaacgggggaaacgggttccggggtaaaccccaagtttacggaaacggtttcgaagggttcggactaagggtagtaacgttcgggtacgggaactacggtactttaacgaccgttacctaccaacctagttacccgaagtaccgtagtcggtccgaccgtaacgtaggttaaaaccttagttttacgaaacccgtttaaacgttactttaaccg

SEQ ID NO: 310438 - DNA, 588 bp, Homo sapiens
  misc_feature: GZ8MTXP02G3L11.51.78.H01.1.454.CMB.2.raw
  modified_base (187)..(187): a, c, t, g, unknown or other
  misc_feature (187)..(187): n is a, c, g, or t
  modified_base (279)..(279): a, c, t, g, unknown or other
  misc_feature (279)..(279): n is a, c, g, or t
  modified_base (315)..(315): a, c, t, g, unknown or other
  misc_feature (315)..(315): n is a, c, g, or t
  modified_base (323)..(323): a, c, t, g, unknown or other
  misc_feature (323)..(323): n is a, c, g, or t
  modified_base (360)..(360): a, c, t, g, unknown or other
  misc_feature (360)..(360): n is a, c, g, or t
  modified_base (520)..(520): a, c, t, g, unknown or other
  misc_feature (520)..(520): n is a, c, g, or t
tcagcgatcgtatacacgaccggtgctcgatttagtgtgagtagtttgggtttgggcacgaccggtgctcgatttagtgtgagtagtttgggtttgggcacaaccggtgctcgatttagtgtgagtagtttgggttggggaggagtcagtctcagtcaggacacagcatggacatgagggtccccgntcagctccgtggggctcctgctactctggcctccgaggtcgccagatgtgacatccagatcgacccagtctccatccctcctgtctagcatntgtagagacagacacacatcacgttcggacccgganaacggtanagagtatagtacgactagttattaatttaagtcgtanacagacgaacgacgtaaccgaaacggaacctaccctacgtcagtactatagtgatacactaacgtacgtaaggtacgggtaacggtcgactagtacgtacgtcgaggtcgagtaggtcgaacgtaggtaacgactattacgtccactacctaacacgtancgtacgtacgtacgtacgtacgtacgtaacgtacgtacgttacttacgtaacgttaacttaacgtacg

SEQ ID NO: 310439 - DNA, 521 bp, Homo sapiens
  misc_feature: GZ8MTXP02FH97X.51.78.H01.1.454.CMB.2.raw
  modified_base (232)..(232): a, c, t, g, unknown or other
  misc_feature (232)..(232): n is a, c, g, or t
  modified_base (276)..(276): a, c, t, g, unknown or other
  misc_feature (276)..(276): n is a, c, g, or t
  modified_base (510)..(510): a, c, t, g, unknown or other
  misc_feature (510)..(510): n is a, c, g, or t
tcagcgatcgtatacacgaccggtgctcgatttagtgtgagtagtttgggtttggggaggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagngcattagcagctattaaatggtatcagcagagaccagggaaacncccctaaacctcctgatctaatgaatgcataccaagttttggaaaagtcggggtaccccagtcaaagggttcagttggcagtggatcgtgggacagatttcactctcacatcagcagtgtgcgactagaatattttgactaattactactgtacaacagtacgttacacgtaccctcaacgtctctacgtttcggcggtaacgggaccaaggtagaacgatacgaaaaccgtangtacggctacg

SEQ ID NO: 310440 - DNA, 631 bp, Homo sapiens
  misc_feature: GZ8MTXP02F57JE.51.78.H01.1.454.CMB.2.raw
  modified_base (262)..(262): a, c, t, g, unknown or other
  misc_feature (262)..(262): n is a, c, g, or t
  modified_base (284)..(284): a, c, t, g, unknown or other
  misc_feature (284)..(284): n is a, c, g, or t
tcagcgatcgtatacacgaccggtgctcgatttagtgtgagtagtttgggtttgggggggagaggagccccagccctgagattcccaggtgtttccattcagtgatcagcactgaacacagaggactcaccatggagttgggactgagctggattttcctttggcttattttaaaaggtgtccagtgtgaagtgctactggtggagtcgtgggggagcctggtacagcctggcaggtccctgagactctcctgtgcagcctntggtattcaccttgatgattangccatcgctacgtcgggtccgacaagcctacgaggggaacggccgtggggacgtcgggtctcgtaacgttagtttacggtaggaagtaggtgtaagtacgtacgcccgttaagtcgggcgaacttcgagtaggaacggggcctagttacccaaccgtactactcgaagtacgacaaccgacaaacgtaacctacccgtagtactactagaacaaagtgaaacctagtctagagacgtacgaggacggaccgtacggtaccttggtaacttacgtacggaaccacgtaaaaaccggcgtaaaacggcaaaacgtacggtacgtacggtaactaccgtaagttaaccgg

SEQ ID NO: 310441 - DNA, 667 bp, Homo sapiens
  misc_feature: GZ8MTXP02FHX97.51.78.H01.1.454.CMB.2.raw
  modified_base (184)..(184): a, c, t, g, unknown or other
  misc_feature (184)..(184): n is a, c, g, or t
  modified_base (227)..(227): a, c, t, g, unknown or other
  misc_feature (227)..(227): n is a, c, g, or t
  modified_base (242)..(242): a, c, t, g, unknown or other
  misc_feature (242)..(242): n is a, c, g, or t
  modified_base (251)..(251): a, c, t, g, unknown or other
  misc_feature (251)..(251): n is a, c, g, or t
  modified_base (325)..(325): a, c, t, g, unknown or other
  misc_feature (325)..(325): n is a, c, g, or t
  modified_base (352)..(352): a, c, t, g, unknown or other
  misc_feature (352)..(352): n is a, c, g, or t
tcagcgatcgtatacacgaccggtgctcgatttagtgtgagtagtttgggtttgggcacgaccggtgctcgatttagtgtgagtagtttgggtttggggaggagtcagtctcagtcaggacacagcatggacatgagggtccccgctcagctcctggggctcctgctactctggctccgaggtnccagatgtgacatccagatgaccagtctccatcctccctgtcngcatctgtagagacngagtcaccntcgacttcgccgggcagtcagagcattagcagactaattaaattggtatcgagctagacgaccgaggggaaacncccccgtaactcccctagactctagtnactgcaactaccaagttttagggaaaacggttcgggggtacccaagtaccgaaacgggtttacagggttacggactaaggggttcggaaacttccgtacgggggtactaaacggttgtttaacccgtaaccttccgttaaccgaaccgtaccgttaccgaaacggtcccaagggttccgttaggcccgtaaaccctagtaaaaccggttacttttacggaacccttttaaactaaacctaccgtaacgttacccaaagtaagtacggttaaccacgttaccccgcgtaaccgcttaccgtacgtttacccggggg

SEQ ID NO: 310442 - DNA, 689 bp, Homo sapiens
  misc_feature: GZ8MTXP02IOLRE.51.78.H01.1.454.CMB.2.raw
  modified_base (233)..(233): a, c, t, g, unknown or other
  misc_feature (233)..(233): n is a, c, g, or t
  modified_base (278)..(278): a, c, t, g, unknown or other
  misc_feature (278)..(278): n is a, c, g, or t
  modified_base (323)..(323): a, c, t, g, unknown or other
  misc_feature (323)..(323): n is a, c, g, or t
tcagcgatcgtatacacgaccggtgctcgatttagtgtgagtagtttgggtttgggcacgaccggtgctcgatttagtgtgagtagtttgggtttgggcacgaccggtgctcgatttagtgtgagtagtttgggtttggggaggagtcagtctcagtcaggacacagcatggacatggacgggtccccgctcacgctccgtggggcctccgtgctactcgtggctccgagtcnccagatgtgacatccagatcgaccagtctaccatccctcctgtcngcatcgtagagagacagacgtaccacatactacgttcgaccgganaacgcgaagacgactaagtacgacctaaagttcctttaaagttttaaacgtggtaactacgacgacgtaacgaccggtaaaccgaaaccggggtaaaccctacccccttaaccgtctacggtactacgtacgatacgtacgacttaacgttaacgtaaggtttaacgggaaacggttccgggtacctaagttacgttaacggttcctaaagggtccgtaagtacgggtagtaccgtacggtacggtaacttacgttactttaccgactttacccactaactacgtacctagtacgttacggtacgtcgttaaccgaacgttaacgtaaacgtttcttaaaccgacgtttaaactttacggtaaccg

SEQ ID NO: 310443 - DNA, 633 bp, Homo sapiens
  misc_feature: GZ8MTXP02GKRS7.51.78.H01.1.454.CMB.2.raw
  modified_base (265)..(265): a, c, t, g, unknown or other
  misc_feature (265)..(265): n is a, c, g, or t
  modified_base (352)..(352): a, c, t, g, unknown or other
  misc_feature (352)..(352): n is a, c, g, or t
  modified_base (504)..(504): a, c, t, g, unknown or other
  misc_feature (504)..(504): n is a, c, g, or t
tcagcgatcgtatacacgaccggtgctcgatttagtgtgagtagtttgggtttgggggggagaggagccccagccctgagattcccaggtgtttccattcagtgatcagcactgaacacagaggactcaccatggagttgggactgagctggtattttccttttggcttaattttaaaaggtgtaccagtgtagaagtgctacgtggtggagtcgtgggggagccgtggtacagcctggcacggtccctgacgactctcctgtcncacgtcctcgtaggtacttcctactttgactgtattatcgccatcgcctacgtgggtccgacaacgcgtaccggagggacggtccgnggtacgtggtctacgtagttagttaaggtaggtaatggtacgtagtaacgtacgtccttaagtcggtacgacgttcggtagtacggaaacgggtcctaacttccactacgtcaccgaagaccgacgacgaacaactaacctccgtagtaacnctaagaacaatacgaacgtaggttcaagaggactaggacgaacgtaccgacgttactagtactacgtacgaccgaaacgaacgtacgtaaggaactacgacggtctaacgttacaagttacgtaaccgg

SEQ ID NO: 310444 - DNA, 603 bp, Homo sapiens
  misc_feature: GZ8MTXP02JB8L4.51.78.H01.1.454.CMB.2.raw
  modified_base (258)..(258): a, c, t, g, unknown or other
  misc_feature (258)..(258): n is a, c, g, or t
  modified_base (266)..(266): a, c, t, g, unknown or other
  misc_feature (266)..(266): n is a, c, g, or t
  modified_base (280)..(280): a, c, t, g, unknown or other
  misc_feature (280)..(280): n is a, c, g, or t
  modified_base (287)..(287): a, c, t, g, unknown or other
  misc_feature (287)..(287): n is a, c, g, or t
tcagcgatcgtatacacgaccggtgctcgatttagtgtgagtagtttgggtttggggggagaggagccccagccctgagattcccaggtgtttccattcagtgatcagcactgaacacagaggactcaccatggagttgggactgagctggtattttcctttggcttattttaaaaggtgtccagtgtgaagtgctactggtggagtcgtgggggagcctggtacagcctggcaggtccctgagactctcctgtcgcncgcctcgngtactcctacttgntgtattncgcagtcgcgcggtcggccgacgtacgcgacggagggtacggtcgtggtggtcggtactacgtagttataggtagtaacgttagtagtagtagtacgtcgtagtcgtacgtacgtgtacggtaggacgtctactaccgactacgtcctacgaagacaaaccgaccgactaaacgtacctcgtagtactgtaacgaactaagtacgaatacgacgtagaagtaccgtgacgtacgacgtacgtacgttacgttacgtacgtacgacgaacgaacgaacgaacgaacgacgacgtacgtacgtacgtacgtacgtacg

SEQ ID NO: 310445 - DNA, 601 bp, Homo sapiens
  misc_feature: GZ8MTXP02HWFZ3.51.78.H01.1.454.CMB.2.raw
  modified_base (271)..(271): a, c, t, g, unknown or other
  misc_feature (271)..(271): n is a, c, g, or t
  modified_base (279)..(279): a, c, t, g, unknown or other
  misc_feature (279)..(279): n is a, c, g, or t
  modified_base (339)..(339): a, c, t, g, unknown or other
  misc_feature (339)..(339): n is a, c, g, or t
  modified_base (462)..(462): a, c, t, g, unknown or other
  misc_feature (462)..(462): n is a, c, g, or t
  modified_base (476)..(476): a, c, t, g, unknown or other
  misc_feature (476)..(476): n is a, c, g, or t
  modified_base (515)..(515): a, c, t, g, unknown or other
  misc_feature (515)..(515): n is a, c, g, or t
  modified_base (523)..(523): a, c, t, g, unknown or other
  misc_feature (523)..(523): n is a, c, g, or t
tcagcgatcgtatacacgaccggtgctcgatttagtgtgagtagtttgggtttgggggctctgggagaggagccccagccctgagattcccaggtgtttccattcagtgatcagcactgaacacagaggactcaccatggagttgggactgagctggtattttccttttggcttaattttaaaaggtgtcagtgtgaagtgctacgtggtggagtcgtgggggacgcctggtacagcctggcgtacggtccctgacgacttctcctgtacncagccctntggtattcctactttggatagtattagtcgaccctagtgacctacgggtcgggtccgaanacgtccgtaccggaggggacggtcgtggacggtggtacctcgtacgttattaggttagaatacggttgtaagtatacgtcgtaagtcgtacgtactcgtagtacggacggtcgtacttacacncgtcctacgagaanaccgtacacaaacgtacctcctagacttcgagacaagtnaacgagtnagagacgagtcgaacggtacgaccgtattcgtaatcgtacgacgagaaacgtcgaaggtaccagtacgtcgtagtacc

SEQ ID NO: 310446 - DNA, 726 bp, Homo sapiens
  misc_feature: GZ8MTXP02G865E.51.78.H01.1.454.CMB.2.raw
  modified_base (282)..(282): a, c, t, g, unknown or other
  misc_feature (282)..(282): n is a, c, g, or t
  modified_base (329)..(329): a, c, t, g, unknown or other
  misc_feature (329)..(329): n is a, c, g, or t
  modified_base (634)..(634): a, c, t, g, unknown or other
  misc_feature (634)..(634): n is a, c, g, or t
tcagcgatcgtatacacgaccggtgctcgatttagtgtgagtagtttgggtttgggcacgaccggtgctcgatttagtgtgagtagtttgggtttgggcacgaccggtgctcgatttagtgtgagtagttttggggtttggggaggagtcagtctcagtcaggacacagcagtggacatggacgggtcccccgctcagctccgtggggctcctgctactctggctccgaggtcgccagatgtagacatccaagatcgacccagtctccactccctcctgtcngcatctagtagaagacagactcaaccatccacgttcggcccggtaanaacgtcgaagacgctaaagttacgcgtaaacgtactttaaaagtttaaaattggtactacgaacgccaaaggacgaacccggtaaaaggggaaaccctacccccgttaaacctcttaagtaactccttagtagacgttacgtaacctacgttaaccgtaaaggtttaacggggtaaaaggtccgggttaaacccaagttaacccgttaaggtaccgtaagggtcggtactaggggttagtaccgttggaacgggtaactaacgtttacttaaccgtacgtacgttacccgaaaactacccgttanacggtaacgtcggtacgtaaccggtaccaaaacgtttaacgtaaaaggtttcctttaaccggtaaacctttaaccgtttaaacggtaacccg

SEQ ID NO: 310447 - DNA, 757 bp, Homo sapiens
  misc_feature: GZ8MTXP01D35F9.21.22.B11.1.454.CMB.2.raw
  modified_base (199)..(199): a, c, t, g, unknown or other
  misc_feature (199)..(199): n is a, c, g, or t
  modified_base (233)..(233): a, c, t, g, unknown or other
  misc_feature (233)..(233): n is a, c, g, or t
  modified_base (263)..(263): a, c, t, g, unknown or other
  misc_feature (263)..(263): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctgggaccccccggnagaggtcacatctcttgtctggagcaactccaanagtacggaataattatgttattcgtggtancagacaacctcccgaaggaactccggacccccaaactccctacactaccgaagaagaataatcgacgccgccctacgacgggtccctgaccgtacttcctcgtcggtcctaccgaaagttctcggcctaccctcgaccgtcccctccgtacgaccctatcgaggtcgggccgttcccgggtaccggaaggtacgttagggacggtccttacgtaacctttaacgtttaccgttggggtacgtaccgtaacgttacccgggaaaccggggaacccgtaaccgtaaaccgtaagggttacgggggtaaacttaccggaaaaccgttaaacggttccggttaaggggttacggggtttccgggggttttagggggttaccggggtttacccggggggaacggggttaaaccggggttaaaccccgtaaaacgggttccgggtaaccccggttccggtaacgggttacccgtaacccgggttaacccccggtaaaggg

SEQ ID NO: 310448 - DNA, 562 bp, Homo sapiens
  misc_feature: GZ8MTXP01D1M13.21.22.B11.1.454.CMB.2.raw
  modified_base (198)..(198): a, c, t, g, unknown or other
  misc_feature (198)..(198): n is a, c, g, or t
  modified_base (323)..(323): a, c, t, g, unknown or other
  misc_feature (323)..(323): n is a, c, g, or t
  modified_base (343)..(343): a, c, t, g, unknown or other
  misc_feature (343)..(343): n is a, c, g, or t
  modified_base (456)..(456): a, c, t, g, unknown or other
  misc_feature (456)..(456): n is a, c, g, or t
  modified_base (507)..(507): a, c, t, g, unknown or other
  misc_feature (507)..(507): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctgggacccccggnagagggtcaccatctcttgttctggagcaactccaacatacggaattaaattatgtattctggtatcagcaactcccaggaatcggacccccaaatcctcatccagaagaataatcagcggcctnaggggtcctgaccgattctntggctccaaagtctggccacctcacgccctcctagacccatcgaggtcgggcctccgggtccgaggactggaggctagacttagttactggggtcgcaatccgaacggggacncaaacgagtggggatacgaacaatcgtgaggtcgggtttgggtgttcgggnggacggggaacccaaagtggtaacccgtcgtagggttaccaacggccccgaaggg

SEQ ID NO: 310449 - DNA, 530 bp, Homo sapiens
  misc_feature: GZ8MTXP01EQLJH.21.22.B11.1.454.CMB.2.raw
  modified_base (198)..(198): a, c, t, g, unknown or other
  misc_feature (198)..(198): n is a, c, g, or t
  modified_base (260)..(260): a, c, t, g, unknown or other
  misc_feature (260)..(260): n is a, c, g, or t
  modified_base (438)..(438): a, c, t, g, unknown or other
  misc_feature (438)..(438): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctgggacccccggnagagggtcaccatctcttgttctggagcaactccaacatcggaataattatgtattctgtancagcaactcccaggaaatcggaccccccaaaactcctcatccagaggaaataatcagcggcctcagggggtccctgaccgattctctggctccaaaagtctggcacctcagcctccctgacccatcagtgggctccggtcgaggatgaggctgactattactggtgcatcgacgggcncaaacatgggatgaacaatctgaggtcggtttggggtgttcgggcggagggacccaaagtgaacccgtcctagggttccaagccccgaaggg

SEQ ID NO: 310450 - DNA, 554 bp, Homo sapiens
  misc_feature: GZ8MTXP01CKW0C.21.22.B11.1.454.CMB.2.raw
  modified_base (201)..(201): a, c, t, g, unknown or other
  misc_feature (201)..(201): n is a, c, g, or t
  modified_base (449)..(449): a, c, t, g, unknown or other
  misc_feature (449)..(449): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagcccaccctcagcgtctgggaccccccgggnagagggtcaccatctcttgttctggagcaactccaacatcggaataattatgtattctggtatcagcaactcccaggaatcggacccccaaatcctcatccagagaataatcagccggccctcgagggggtccctgaccgtattcctctggcctccaaagtctggccacctcacgcctccctgacccatcaggtcgggctccggtcgaggatgaggctgacttattactggtcgctatcgaacgggcncaacagtgggatgaacaatcgtagagggtcgggtttgggtacgttcgggacgggagggaccctaaacgtggaacccgttccgtagggttccaagccccgtaaggg

SEQ ID NO: 310451 - DNA, 524 bp, Homo sapiens
  misc_feature: GZ8MTXP01AI7ZS.21.22.B11.1.454.CMB.2.raw
  modified_base (264)..(264): a, c, t, g, unknown or other
  misc_feature (264)..(264): n is a, c, g, or t
  modified_base (344)..(344): a, c, t, g, unknown or other
  misc_feature (344)..(344): n is a, c, g, or t
  modified_base (423)..(423): a, c, t, g, unknown or other
  misc_feature (423)..(423): n is a, c, g, or t
  modified_base (439)..(439): a, c, t, g, unknown or other
  misc_feature (439)..(439): n is a, c, g, or t
  modified_base (444)..(444): a, c, t, g, unknown or other
  misc_feature (444)..(444): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctgggacccccgggcagagggtcaccatctcttgttctggaggcaactccaacatcggaagtaattatgtattctggtancagcaactcccaggaatcggacccccaaactcctcatccagagaataatcagcggccctcaggggtccctgaccgattcnctggctccaaagtctggcacctcacgccctcctgaccatcaggtgggctccgggtccgaggatgaggctgactattacnggtgcatcgacgggcncaacngtgggatgaacaatctgaggtcgggttgggtgttcgggcggagggaccaaagtgaacccgtcaggttcaacgcccgaagg

SEQ ID NO: 310452 - DNA, 591 bp, Homo sapiens
  misc_feature: GZ8MTXP01DHAUE.21.22.B11.1.454.CMB.2.raw
  modified_base (264)..(264): a, c, t, g, unknown or other
  misc_feature (264)..(264): n is a, c, g, or t
  modified_base (468)..(468): a, c, t, g, unknown or other
  misc_feature (468)..(468): n is a, c, g, or t
  modified_base (486)..(486): a, c, t, g, unknown or other
  misc_feature (486)..(486): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtcgtcgggacccccggcagagggtcaccatctcttgttctggagcaactccaacatacggaataattatgtattctggtancagcaactcccaaggaactcggaccccccaaaactcctacatacccaagaacggaaataatcaagccggcccctcgacgggggttcccctaggacccgtatttcctcgtggccttacccaaaagttctggaccctaacctcacgcccctccctagacccatcaggtcgggctcccgggtacgaggatgaggctagactattacnggtgacatcgacgggacncaacgagtaggggatacgaacaagtcgtggagggtcgggttgggtggtcgggccgggttagggaacccaaacgtgaacccgttcgaggttcaacggcccgtaagg

SEQ ID NO: 310453 - DNA, 559 bp, Homo sapiens
  misc_feature: GZ8MTXP01DWCPQ.21.22.B11.1.454.CMB.2.raw
  modified_base (201)..(201): a, c, t, g, unknown or other
  misc_feature (201)..(201): n is a, c, g, or t
  modified_base (415)..(415): a, c, t, g, unknown or other
  misc_feature (415)..(415): n is a, c, g, or t
  modified_base (450)..(450): a, c, t, g, unknown or other
  misc_feature (450)..(450): n is a, c, g, or t
tcagtcgtcgctcgcacgaccggtgctcgatttagacgacagctcaggggagcttcagctgtggtagagaagacaggactcaggacaatctccagcatggccggcttccctctcctcctcacccctcctcactcactgcgcagggtcctgggcccagtctgtgctgactcagccaccctcagcgtctgggaccccccgggnagagggtcaccatctcttgttctggagcaactccaacatcggaagttaattatgtattctggtatcagcaactcccaggaatcggaccccccaaactccctcatccagaaggaataatcagccggccctcgacgggggtccctgaccgtattcctctggcctccaaagtctggcacctcacgccctcctgaccatcaggtggctccggtcgagntgagctagactattactggtcgcatcgacgggacncaaacgagtgggatgacaatcgtggaggtcgggtttgggtggttcgggacgggttagggaacccaaagttcgaacccggttccgtagggttcctaacggccccgaaggg

SEQ ID NO: 310454 - DNA, 575 bp, Homo sapiens
  misc_feature: GZ8MTXP01C6WY1.21.22.B11.1.454.CMB.2.raw
  modified_base (235)..(235): a, c, t, g, unknown or other
  misc_feature (235)..(235): n is a, c, g, or t
  modified_base (290)..(290): a, c, t, g, unknown or other
  misc_feature (290)..(290): n is a, c, g, or t
  modified_base (418)..(418): a, c, t, g, unknown or other
  misc_feature (418)..(418): n is a, c, g, or t
  modified_base (442)..(442): a, c, t, g, unknown or other
  misc_feature (442)..(442): n is a, c, g, or t
tcagtcgtcgctcgcacgaccggtgctcgatttagacgacagctcagggcagcttcagctgtggtagagaagacaggactcaggacaatctccagcatggccggcttccctctcctcctcaccctcctcactcactgcgcagggtcctgggcccagtctgtgctgactcagccaccctcagcgtctcgggacccccggcagagggtcaccatctctgttctggagcaactccaanatcggaagtaattatgtattctggtatcagcaactcccaggatggcccccaaacncctcatccagagaatatcagccgcctcaggggtccctgaccccgattctctggcctaccaagtctcgccaccctcacgccctcctgaccatcaggtggcctcggtacaggatgagctgactattacgngtgcagtccgacgggcacaaacgngttggggaatcggaacctaaagttccttagggaacgcggttaagggtttcggggttcgggtttcggggaccggggttaacggggaaaccctaaacggtcggaaccccggttcgttaacgggccgtaacccggg

SEQ ID NO: 310455 - DNA, 571 bp, Homo sapiens
  misc_feature: GZ8MTXP01ERMV2.21.22.B11.1.454.CMB.2.raw
  modified_base (199)..(199): a, c, t, g, unknown or other
  misc_feature (199)..(199): n is a, c, g, or t
  modified_base (261)..(261): a, c, t, g, unknown or other
  misc_feature (261)..(261): n is a, c, g, or t
  modified_base (294)..(294): a, c, t, g, unknown or other
  misc_feature (294)..(294): n is a, c, g, or t
  modified_base (330)..(330): a, c, t, g, unknown or other
  misc_feature (330)..(330): n is a, c, g, or t
  modified_base (430)..(430): a, c, t, g, unknown or other
  misc_feature (430)..(430): n is a, c, g, or t
  modified_base (451)..(451): a, c, t, g, unknown or other
  misc_feature (451)..(451): n is a, c, g, or t
  modified_base (458)..(458): a, c, t, g, unknown or other
  misc_feature (458)..(458): n is a, c, g, or t
  modified_base (530)..(530): a, c, t, g, unknown or other
  misc_feature (530)..(530): n is a, c, g, or t
tcagtcgtcgctcgcacgaccggtgctcgatttagacgacagctcaggggagcttcagctgtggtagagaagacaggactcaggacaatctccagcatggccggcttccctctcctcctcacccctcctcactcactgcgcagggtcctgggcccagtctgtgctgactcagccaccctcagcgtctgggacccccggnagagggtcacatctcttgttctggagcaactccaacatcggaataattatgtattctggtancagcaactcccaggaatcggacccccaactccncatccagagaataatcagccgcctcgacgggtcccngaccgacttctcgtggctccaaagttctggccacctcacgccctcctgacccatcgaggtcgggcctccgggtcgaggatggaaggctagacttattacngggtgcaatcggaacgggacncaaacgngtgggatggaacagtcgtaggacgggtcgggtttgggtcggttcgggacggggttacggacccgttaaacgnggtaacccggttccgtaggttccgaacggttcccgaacggg

SEQ ID NO: 310456 - DNA, 664 bp, Homo sapiens
  misc_feature: GZ8MTXP01CZ6RR.21.22.B11.1.454.CMB.2.raw
  modified_base (51)..(51): a, c, t, g, unknown or other
  misc_feature (51)..(51): n is a, c, g, or t
  modified_base (79)..(79): a, c, t, g, unknown or other
  misc_feature (79)..(79): n is a, c, g, or t
  modified_base (494)..(494): a, c, t, g, unknown or other
  misc_feature (494)..(494): n is a, c, g, or t
  modified_base (572)..(572): a, c, t, g, unknown or other
  misc_feature (572)..(572): n is a, c, g, or t
  modified_base (582)..(582): a, c, t, g, unknown or other
  misc_feature (582)..(582): n is a, c, g, or t
tcagtcgtcgctcgcacgaccggtgctcgatttagacgacagctcaggggncttgagcgtgtcgagagagacagtaccngagactactctcgagctagtcggccgtcttcctacctaccctaccaccaaccctccgtagtacgtcgtacgtcgtcgtcgttcggtttccgtacggtaccttaggtttacgttaggctaccttagcgtaccgacgaccgtaccgtggtcggtcggtaccggtccggggaccggatacgggtacgtaccacgtcgtcgttcgtcgtacgacgacacctaacgtacgaagtcgttaacggtaactttatcgttagttcgttgactacacgacgtaaccgtacgtaccgagtaccgacccaactacgcgaagtacggagaaggtataacgtcgtcgtacgtacgaccgttaggacgcctcgtagttaccgtcggagactaaccattaacgcaacgtacctgaaaccacgtccacgtancagtcgagacgtagagagtagacgtacgacgactactatacgtcgtagactacgacgacgacgagagtagagtacganacgtacgtgngtggttcggtacgttcggttagcgttaacggttacttacgtaacgtacgtaacgtacgacgttaccgtaacgttaaccgtcg

SEQ ID NO: 310457 - DNA, 532 bp, Homo sapiens
  misc_feature: GZ8MTXP01DKIPD.21.22.B11.1.454.CMB.2.raw
  modified_base (323)..(323): a, c, t, g, unknown or other
  misc_feature (323)..(323): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctgggacccccggcagagggtcaccatctcttgttctggaggcaactccaaacatcggaagtaattatgtattctggtatcagcaactcccaggaatcggcccccaaactcctcatccagagaataatcagcggccctnacggggtccctgaccgtattctctggctccaaagtctggccacctcacgccctccctgacccatcaggtcgggctccgggtccgaggactgaggctgactattactggtgcagtcgacgggacgcaacatgggatgacaatctgaggtcggttgggtgttcgggcggttggacccgaatggaacccgtctaggttcaagccccgaaggg

SEQ ID NO: 310458 - DNA, 657 bp, Homo sapiens
  misc_feature: GZ8MTXP01A1MGA.21.22.B11.1.454.CMB.2.raw
  modified_base (198)..(198): a, c, t, g, unknown or other
  misc_feature (198)..(198): n is a, c, g, or t
  modified_base (234)..(234): a, c, t, g, unknown or other
  misc_feature (234)..(234): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctgggacccccggnagagggtcaccatctcttgtctggagcaactccaanatcggaagtaattatgtattctggtatcagcaactcccaggaatcggaccccccaaatcctcatccagagaataatcagccgccctgacggggtccctgaccgtattcctctggcctccgaaagtctggccacctcacgccctccctgacccatcgaggtcgggcctccgggtacgaggactggacggtctaggaacttattaccgtgggtcgctaagtccggaacgggggaccacgaaaccgtaaggttcgggggaacttacgggaaaccctaaagttcccgtaggggttaacggggtccgggggttttgggggtacggtttccgggggaccggggaacgggggttaaacccctaaaacgggtccgggtaaacccccggttccggttaacgggacccgtaaccggcccccgggtaaacgggg

SEQ ID NO: 310459 - DNA, 560 bp, Homo sapiens
  misc_feature: GZ8MTXP01EM17W.21.22.B11.1.454.CMB.2.raw
  modified_base (347)..(347): a, c, t, g, unknown or other
  misc_feature (347)..(347): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagcccaccctcagcgtctgggacccccggtagagggtcaccatctcttgttctggaggcaactccaacatcggaagtaattatgtattctggtatcagcaactcccaaggaatcggacccccaaactcctcatccagagaaataatcagccgccctcgagggtccctgaccgattccnctgctccaagtctggcacctcacgccctcctgaccatcagtcggctccgggtccgaggtactgaggctagactattactgtggcatccgacgggcacaacagtagggatgaacaagttcgtaaggaggttcggggttgggttcgttcggggacgggacgggaccaaacgttggaccccgttcgtaacggtccgacgtccccgaacgggtcccg

SEQ ID NO: 310460 - DNA, 526 bp, Homo sapiens
  misc_feature: GZ8MTXP01A2SV7.21.22.B11.1.454.CMB.2.raw
  modified_base (199)..(199): a, c, t, g, unknown or other
  misc_feature (199)..(199): n is a, c, g, or t
  modified_base (348)..(348): a, c, t, g, unknown or other
  misc_feature (348)..(348): n is a, c, g, or t
  modified_base (425)..(425): a, c, t, g, unknown or other
  misc_feature (425)..(425): n is a, c, g, or t
  modified_base (442)..(442): a, c, t, g, unknown or other
  misc_feature (442)..(442): n is a, c, g, or t
  modified_base (467)..(467): a, c, t, g, unknown or other
  misc_feature (467)..(467): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctgggaccccccggnagagggtcaccatctcttgtctggagcaactccaacatcggaagtaattatgtattctggtatcagcaactcccaggaatcggacccccaaatcctcatcccagacgaataatcagccggccctcgagggggtcccctgaccgacttcnctggcctcaaagtctggcacctcacgcctccctgacccatcaggtcgggctccggtcgagatgaggctgactatacnggtgcatccgacgggcnctaacgatgggatgacaatctaggnggtcggttggtcggtcgggacggacggaccaacgtcgaaccgtcgtggcaacgccgaag

SEQ ID NO: 310461 - DNA, 544 bp, Homo sapiens
  misc_feature: GZ8MTXP01BHH2E.21.22.B11.1.454.CMB.2.raw
  modified_base (199)..(199): a, c, t, g, unknown or other
  misc_feature (199)..(199): n is a, c, g, or t
  modified_base (414)..(414): a, c, t, g, unknown or other
  misc_feature (414)..(414): n is a, c, g, or t
  modified_base (431)..(431): a, c, t, g, unknown or other
  misc_feature (431)..(431): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctgggaccccccggnagagggtcaccatctcttgtctggagcaactccaacatcggaataattatgtattctggtatcagcaactcccaggaatcggacccccaaactcctcatccagagaataatcagcggcctcgaggggtccctgaccgattctctggctccaaagtctggcacctcagccctcctgaccatcagtggctccggtagagatgaggctgactattacnggtgcatcgacgggacncaacagtgggatgacaatcgtgaggtcggttgggtaggttccgggacgggacggggaaacccaaacggttcggaaccccgttccgtagggttaccaacggttcccccgaaggg

SEQ ID NO: 310462 - DNA, 539 bp, Homo sapiens
  misc_feature: GZ8MTXP01D439F.21.22.B11.1.454.CMB.2.raw
  modified_base (263)..(263): a, c, t, g, unknown or other
  misc_feature (263)..(263): n is a, c, g, or t
  modified_base (407)..(407): a, c, t, g, unknown or other
  misc_feature (407)..(407): n is a, c, g, or t
  modified_base (444)..(444): a, c, t, g, unknown or other
  misc_feature (444)..(444): n is a, c, g, or t
  modified_base (448)..(448): a, c, t, g, unknown or other
  misc_feature (448)..(448): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctgggacccccggcagagggtcaccatctcttgttctggaggcaactccaacatcggaagtaattatgtattctggtancagcaactcccaggaatcggcccccaaatcctcatccagagaataatcagcggcctcgacggggtccctgaccgattctctggcctccaaagtctggccacctcacgccctccctgacccatcaggtcgggctccggtcgaggntggaggctgactattactgggtgcatcgacggggacncaangtgggatgacaatctggagtcgggttgggtgttcggcgggttagggacccaaagtcgaacccggttcctagggttccaacgccccgaaggg

SEQ ID NO: 310463 - DNA, 552 bp, Homo sapiens
  misc_feature: GZ8MTXP01AS8A6.21.22.B11.1.454.CMB.2.raw
  modified_base (198)..(198): a, c, t, g, unknown or other
  misc_feature (198)..(198): n is a, c, g, or t
  modified_base (425)..(425): a, c, t, g, unknown or other
  misc_feature (425)..(425): n is a, c, g, or t
  modified_base (442)..(442): a, c, t, g, unknown or other
  misc_feature (442)..(442): n is a, c, g, or t
  modified_base (449)..(449): a, c, t, g, unknown or other
  misc_feature (449)..(449): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctgggacccccggnagagggtcaccatctcttgttctggagcaactccaacatcggaagtaattatgtattctggtatcagcaactcccaggaatcggcccccaaatcctcatccagaggaataatcagcggccctgagggggtcccctgaccgattctctggctcccaaagtctggccacctcagccctccctgacccatcaggtcgggctccggtcgaggactgaggctgactattacnggtgcatcgacggggcncaaacgngtgggatcgaacagtcgtggaggtcgggttgggtcggttcgggacgggacgggaaccctaaacgtcggtaacccgtcgtacgggttaccaacggccccgaagg

SEQ ID NO: 310464 - DNA, 611 bp, Homo sapiens
  misc_feature: GZ8MTXP01BDG00.21.22.B11.1.454.CMB.2.raw
  modified_base (198)..(198): a, c, t, g, unknown or other
  misc_feature (198)..(198): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctgggacccccggnagagggtcaccatctcttgttctggagcaactccaacatcggaataattatgtattctggtatcagcaactcccaaggaatcggacccccaaactcctcactccagaggaataatcagccggccctcgacgggggtcccctgaccgtatttccgtcgtcggcctccgaaagttctggccaccctcacgccctccctagaccatcgaggtcgggccttccggtccggaggatggacggtctgtaaccttagttaccgtggtcggacctagtccggaacggggtaccacgaaacgtaggtggggaaattcggaaactaagtcgtaggacgggtcgggtttaggggtcggttaccggggcggacgggttaccctaaacgtcggaacccgtcgtagggacctaacggcccgtaacgg

SEQ ID NO: 310465 - DNA, 553 bp, Homo sapiens
  misc_feature: GZ8MTXP01DERCB.21.22.B11.1.454.CMB.2.raw
  modified_base (289)..(289): a, c, t, g, unknown or other
  misc_feature (289)..(289): n is a, c, g, or t
  modified_base (528)..(528): a, c, t, g, unknown or other
  misc_feature (528)..(528): n is a, c, g, or t
  modified_base (530)..(530): a, c, t, g, unknown or other
  misc_feature (530)..(530): n is a, c, g, or t
  modified_base (543)..(543): a, c, t, g, unknown or other
  misc_feature (543)..(543): n is a, c, g, or t
  modified_base (552)..(552): a, c, t, g, unknown or other
  misc_feature (552)..(552): n is a, c, g, or t
tcagtcgtcgctcgcacgaccggtgctcgatttagacgacagctcagggtggggtcaaaaacccggggaggggtctgatttgcatggatggactctcccctctcagagtacgaagagagggagagatctgggggaagctcagcttcagctgtggtagagaagacaggactcaggacaatctccagcatggccggcttccctctcctcctcaccctctcactcactgcgcagggtcctgggcccagtctgtgctgactcagcccaccctcagcgtctcgggacccccggnagagggtcaccatctcttgttctggaggcaactccaacatcggaaagtaattatcgtattctggtatcaagcaactcccaagggaaactcggaccccccaaaatccctacactccaagaaggaaataaatcaacgccggacccccaacgggggttccccacggaacccgatttcctcgttcgggcttccaaagtcctcggccacctcacgtcctccctgccaatcagtggctcggtcgngnttgaagctgactnttactgttnc

SEQ ID NO: 310466 - DNA, 522 bp, Homo sapiens
  misc_feature: GZ8MTXP01CNSJO.21.22.B11.1.454.CMB.2.raw
  modified_base (452)..(452): a, c, t, g, unknown or other
  misc_feature (452)..(452): n is a, c, g, or t
  modified_base (488)..(488): a, c, t, g, unknown or other
  misc_feature (488)..(488): n is a, c, g, or t
tcagtcgtcgctcgcacgaccggtgctcgatttagacgacagctcaggggagattcagctgtggtagagaagacaggactcaggacaatctccagcatggccggcttccctctcctcctcaccctcctcactcactgcgcagggtcctgggcccagtctgtgctgactcagccaccctcagcgtctgggaccccccggcagagggtcaccatctcttgttctggaggcaactccaacatcggaataattatgtattctggtatcagcaactcccaggaatcggcccccaaactcctcatccagaggaataatcagccggccctcacgggggtccctgaccgattctctggcctccaaagttctggcaccctcagccctccctgacccatcaggtgggctccggtccgaggatggaggctgacttattacgtggtgcatcgacgggcgcaacngtgggatgacatctgaggcggttggtgtcgggcggnggaccaaagtgccgtctaggttcaacgcccaagg

SEQ ID NO: 310467 - DNA, 593 bp, Homo sapiens
  misc_feature: GZ8MTXP01BKGSR.21.22.B11.1.454.CMB.2.raw
  modified_base (198)..(198): a, c, t, g, unknown or other
  misc_feature (198)..(198): n is a, c, g, or t
  modified_base (261)..(261): a, c, t, g, unknown or other
  misc_feature (261)..(261): n is a, c, g, or t
  modified_base (483)..(483): a, c, t, g, unknown or other
  misc_feature (483)..(483): n is a, c, g, or t
  modified_base (490)..(490): a, c, t, g, unknown or other
  misc_feature (490)..(490): n is a, c, g, or t
  modified_base (507)..(507): a, c, t, g, unknown or other
  misc_feature (507)..(507): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctgggacccccggnagagggtcaccatctcttgtctggagcaactccaacatcggaagtaattatgtattctggtancagcaactcccaaggaactccggacccccaaaactccctacactccaagaaggaaataatcagccggccctcgacggggtccctgaccgtacttctctggccctacctaaagtcgtcggcctacctccacgccctccctgaccatcgaggtcgggcctcccggtacggaggtatggacggtcttacgaacgttattactgggtcgctataccggacgggacncaaacgngtggatagacaattcgngacggtcgggttgggtacggtcgggacgggttacggaaccctaaacgttcggaacccgtcgtagggttccaacgaacccgtaacgg

SEQ ID NO: 310468 - DNA, 557 bp, Homo sapiens
  misc_feature: GZ8MTXP01BMY88.21.22.B11.1.454.CMB.2.raw
  modified_base (200)..(200): a, c, t, g, unknown or other
  misc_feature (200)..(200): n is a, c, g, or t
  modified_base (441)..(441): a, c, t, g, unknown or other
  misc_feature (441)..(441): n is a, c, g, or t
  modified_base (447)..(447): a, c, t, g, unknown or other
  misc_feature (447)..(447): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctgggaccccccgggnagagggtcaccatctcttgtctggaggcaactccaacatcggaagtaattatgtattctggtatcagcaactcccaggaatcggcccccaaactcctcatccagagaataatcagcgccctcgacggggtccctgaccgattctctggctccaaagtctggccacctcacgccctcctgacccatcaggtggctccggtcgaggatgaggctgactattactgggtgcatcgacggggacncaaacngtgggatgaaccaagtctggagggtcgggtttggggtcggttccgggcggggttacgggttacccaaacgtcggaacccgttcgtagggttccaacggttccccgaaggg

SEQ ID NO: 310469 - DNA, 590 bp, Homo sapiens
  misc_feature: GZ8MTXP01AIWXQ.21.22.B11.1.454.CMB.2.raw
  modified_base (423)..(423): a, c, t, g, unknown or other
  misc_feature (423)..(423): n is a, c, g, or t
  modified_base (440)..(440): a, c, t, g, unknown or other
  misc_feature (440)..(440): n is a, c, g, or t
  modified_base (458)..(458): a, c, t, g, unknown or other
  misc_feature (458)..(458): n is a, c, g, or t
  modified_base (463)..(463): a, c, t, g, unknown or other
  misc_feature (463)..(463): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctcgggacccccggcagagggtcaccatctcttgttctggaggcaactccaacatcggaagttaattatgtattctggtatcagcaactcccaaggaactcggacccccaaactccctacactccaagaggaaataatcagccggccctgacgggtccctgaccgtacttctctggcctccaaagtctcggcaccctcacgccctcctgacccatcgaggtcgggcctccggtcgaggntgaggctgactattacngggtgcagtcgacggacncaacngtcgggataggactaagttcgtaggaggtcgggtttaggggtcggttccgggggacgggttacggggaaccctaaacggttcggaacccgtttccggaaggggttccaacgggccccgttaacgggg

SEQ ID NO: 310470 - DNA, 611 bp, Homo sapiens
  misc_feature: GZ8MTXP01AKFD5.21.22.B11.1.454.CMB.2.raw
  modified_base (264)..(264): a, c, t, g, unknown or other
  misc_feature (264)..(264): n is a, c, g, or t
  modified_base (385)..(385): a, c, t, g, unknown or other
  misc_feature (385)..(385): n is a, c, g, or t
  modified_base (452)..(452): a, c, t, g, unknown or other
  misc_feature (452)..(452): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctgggacccccgggcagagggtcaccatctcttgttctggaggcaactccaacatcggaagtaattatgtattctggtancagcaactcccaggaatcggacccccaaatcctcatccagaggaataatcagccggccctgaggggtcccctgaccgtattctctggcctaccaaagtctggccaccctcacgcccttccngacccatcaggtcgggcctccgggtccgagggactggacggtctgaacttagttacctgggggtacncgtagtaccggaacgggacacgaaacgtaggtgggtaatacgaactagtcgaggttacgggtcgggttgggtacgggtcggggacggggttaacgggaaccctaaaggtccggtaacccggttccggtacgggttaccgaaccggaacccggtaacggg

SEQ ID NO: 310471 - DNA, 554 bp, Homo sapiens
  misc_feature: GZ8MTXP01ALUV9.21.22.B11.1.454.CMB.2.raw
  modified_base (259)..(259): a, c, t, g, unknown or other
  misc_feature (259)..(259): n is a, c, g, or t
  modified_base (442)..(442): a, c, t, g, unknown or other
  misc_feature (442)..(442): n is a, c, g, or t
  modified_base (465)..(465): a, c, t, g, unknown or other
  misc_feature (465)..(465): n is a, c, g, or t
  modified_base (472)..(472): a, c, t, g, unknown or other
  misc_feature (472)..(472): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctcgggacccccggcagagggtcaccatctcttgtctggagcaactccaacatcggaatattatgtatctggtancagcaactcccaggaatcggcccccaaatcctcatccagaggaataatcagccggcccctgacgggggtcccctgacccgtattcctctggcctccgaaagtcctggccaccctcacgccctccctgacccatcgaggtcgggcctccgggtcgaaggctggacgggtcctgaacttattacngggttcgacatccgaacggggcncaaacgngtgggatgaacagtctggaggtcgggttgggtgtcgggcggagggaccctaagtgaacccgtcgtaggccaacgcccgaagg

SEQ ID NO: 310472 - DNA, 572 bp, Homo sapiens
  misc_feature: GZ8MTXP01BEY0G.21.22.B11.1.454.CMB.2.raw
  modified_base (200)..(200): a, c, t, g, unknown or other
  misc_feature (200)..(200): n is a, c, g, or t
  modified_base (460)..(460): a, c, t, g, unknown or other
  misc_feature (460)..(460): n is a, c, g, or t
  modified_base (479)..(479): a, c, t, g, unknown or other
  misc_feature (479)..(479): n is a, c, g, or t
tcagtcgtcgctcgcacgaccggtgctcgatttagacgacagctcaggggagcttcagctgtggtagagaagacaggactcaggacaatctccagcatggccggcttccctctcctcctcacccctcctcactcactgcgcagggtcctgggcccagtctgtgctgactcagccaccctcagcgtctgggaccccccggnagagggtcaccatctcttgttctggagcaactccaacatcggaagtaattatgtattctggtatcagcaactcccaaggaatcggcccccaaatcctcactccagaggaaataactcaagccggccctcgacgggggtcccctggacccgtattcctacgtggccttccaaaagttctcggccaccctcacgtccctcccctagaccctatcaggtcgggcctccgggtccgaggatggaggctagactattactgggtnctatcgacgggcacgaacngtgggatgacatcgtgaggtcggttgggtcgtcgggcgggacgggaaccaacggtcgaaccggtccgtagggttaccaacggttccccgaagg

SEQ ID NO: 310473 - DNA, 602 bp, Homo sapiens
  misc_feature: GZ8MTXP01BDSZG.21.22.B11.1.454.CMB.2.raw
  modified_base (199)..(199): a, c, t, g, unknown or other
  misc_feature (199)..(199): n is a, c, g, or t
  modified_base (260)..(260): a, c, t, g, unknown or other
  misc_feature (260)..(260): n is a, c, g, or t
  modified_base (449)..(449): a, c, t, g, unknown or other
  misc_feature (449)..(449): n is a, c, g, or t
  modified_base (476)..(476): a, c, t, g, unknown or other
  misc_feature (476)..(476): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctcgggacccccggnagagggtcaccatctcttgtctggagcaactcaacatcggaataattatgtattctggtancagcaactcccaggaactcggacccccaaactcctcactccagaggaaataatcagccggcctcgacggggtccctgaccgtacttctacgtggcctccaaagtcctggcctaccctcacgtcccctccctagaccctatcgaggtcgggcctccgggtcgaggtatggacggtctagacttattacgngggtcgactatccgaacgggcacaaanggttgggactgaacgaatcgtaggaggtcgggtttggggtacgttccggggacgggacggggaacccaaacggttccgggaacccgttacccggttagggaccgtaaccggaaccccgtaaccggg

SEQ ID NO: 310474 - DNA, 572 bp, Homo sapiens
  misc_feature: GZ8MTXP01EAZMP.21.22.B11.1.454.CMB.2.raw
  modified_base (199)..(199): a, c, t, g, unknown or other
  misc_feature (199)..(199): n is a, c, g, or t
  modified_base (234)..(234): a, c, t, g, unknown or other
  misc_feature (234)..(234): n is a, c, g, or t
  modified_base (256)..(256): a, c, t, g, unknown or other
  misc_feature (256)..(256): n is a, c, g, or t
  modified_base (328)..(328): a, c, t, g, unknown or other
  misc_feature (328)..(328): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctcgggacccccggnagagggtcaccatctcttgtctggagcaactcaanatcggaatatatgtatctgtancagcaactccaggatcgacccccaaactcctacactccagaagaataatcagccggcctcgacggggtcccngaccgtacttctcgtggctaccgaaagtctcggccacctcacgccctcctgacccatcgaggtcgggcctccgggtcgaggtatggaggctagaacttagttactggtcgctagtcgaacggggacacaacgagtgggataggacaagtcgaaggcggtcgggtttagggtggtacggggcgggaacggaacctaaaccggtcggaacccgttacggtagggaccctaaccggcccgtaacggg

SEQ ID NO: 310475 - DNA, 577 bp, Homo sapiens
  misc_feature: GZ8MTXP01AC5BL.21.22.B11.1.454.CMB.2.raw
  modified_base (428)..(428): a, c, t, g, unknown or other
  misc_feature (428)..(428): n is a, c, g, or t
  modified_base (451)..(451): a, c, t, g, unknown or other
  misc_feature (451)..(451): n is a, c, g, or t
  modified_base (459)..(459): a, c, t, g, unknown or other
  misc_feature (459)..(459): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctgggacccccggcagagggtcaccatctcttgtctggaggcaactccaacatcggaatattatgtattctggtatcagcaactcccaggaatcggcccccaaactcctcatccagaggaataatcagcggccctcgacggggtccctgaccgtattctctggcctccaaagtctggcaccctcacgccctcctgacccatcaggtcgggcctccgggtcgaggatggaggctgacttattacngggtcgacagtcgaaccggggcncgaaacgngtggggtaatggaactaatccgtggttacggtcggggtttggggtcggttccgggacggggttaacgggaccctaaacgtcggaacccgttccgtagggttccaacggccccgaaggg

SEQ ID NO: 310476 - DNA, 535 bp, Homo sapiens
  misc_feature: GZ8MTXP01DHLH5.21.22.B11.1.454.CMB.2.raw
  modified_base (200)..(200): a, c, t, g, unknown or other
  misc_feature (200)..(200): n is a, c, g, or t
  modified_base (412)..(412): a, c, t, g, unknown or other
  misc_feature (412)..(412): n is a, c, g, or t
  modified_base (428)..(428): a, c, t, g, unknown or other
  misc_feature (428)..(428): n is a, c, g, or t
  modified_base (444)..(444): a, c, t, g, unknown or other
  misc_feature (444)..(444): n is a, c, g, or t
  modified_base (494)..(494): a, c, t, g, unknown or other
  misc_feature (494)..(494): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctgggaccccccgggnagagggtcaccatctcttgttctggaggcaactccaacatcggaagtaattatgtattctggtatcagcaactcccaggaatcggacccccaaatcctcatccagaggaataatcagccggccctcgaggggtcccctgaccgacttcctctggcctccaaaagtctggcaccctcacgccctcctgacccatcagtgggctccggtcaggntgagctgactattacnggtgcatcgacgggcncaaacagtgggaatgaactaatctggagtcgggttgggtgtcgggacggngggaaccaagtcgaacccgttcagggttcaacgcccgaagg

SEQ ID NO: 310477 - DNA, 646 bp, Homo sapiens
  misc_feature: GZ8MTXP01CI5UA.21.22.B11.1.454.CMB.2.raw
  modified_base (200)..(200): a, c, t, g, unknown or other
  misc_feature (200)..(200): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtcgtgggaccccccggnagagggtcaccatctcttgttctggaggcaactccaacatcggaagtaaattatgtattctggtatcagcaactcccaggaatcgccccaaactcctcatccagagaataatcacgccggcctgacggggtccctagaccgtacttctacgtcggcctaccaaaagttctcggcctaaccctcaccgtccctccccgtagaccccattccgaaggttcgggccttccccgggtaccgaagggtatcgggacggtctcgtaaccttagttaaccgtgggtcgactagtaccgacgggggaaccacgaataaggttggggaactcgaaaccgtaaattccgttagggacggggttcggggtttagggtcgggttccgggacggggaacgggttaaacccaaacgttcggaaccccggttcgtaagggttccaacggcccccggtaagg

SEQ ID NO: 310478 - DNA, 551 bp, Homo sapiens
  misc_feature: GZ8MTXP01ASI76.21.22.B11.1.454.CMB.2.raw
  modified_base (258)..(258): a, c, t, g, unknown or other
  misc_feature (258)..(258): n is a, c, g, or t
  modified_base (432)..(432): a, c, t, g, unknown or other
  misc_feature (432)..(432): n is a, c, g, or t
  modified_base (453)..(453): a, c, t, g, unknown or other
  misc_feature (453)..(453): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctgggaccccccggcagagggtcaccatctcttgttctggagcaactcaacatcggaatatatgtattctgtancagcaactcccaggaactcggacccccaaactcctcatccagaggaataatcagcggccctcgacggggtccctgaccgattcctctggcctccaaagtctggccacctcacgcctccctgacccatcaggtgggcctccgggtccgaggactggacggcttgacttattacgnggttcgactatcgacgggacncaaacgagtgggatgaacaatcgtggagtcgggttgggtcgtcgggcgggttagggaccaaacgtggaacccgtcgagggttcaacgccccgtaaggg

SEQ ID NO: 310479 - DNA, 659 bp, Homo sapiens
  misc_feature: GZ8MTXP01DEK8Z.21.22.B11.1.454.CMB.2.raw
  modified_base (237)..(237): a, c, t, g, unknown or other
  misc_feature (237)..(237): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtcgtcgggacccccggcagagggtcaccatctcttgttctggagcaactccaanatcggaagttaattatgtattctggtatcagcaactcccaggaactccggacccccaaactcctacatccaagagaaataatcaacgccggccctcgacgggtccctgaccgtacttctctggtcctaccaaaagttctcggcctaaccctccaccgccccttcccgtacgaccctatccgtaggtccggggccctcccgggttaccgaagggtagttacggaacgggtcctacggtaaccttaagtttaaccgtggggttcgaacccgtaagtacccggaaccgggggaccacgtaaacgacggttgggaatacggaaacaagttcgtagggagggttcgggttggggtcggttacggggacgggacgggaaccctaaacgtcgtaacccgtacggtacggacctaacggcccgtaaccgg

SEQ ID NO: 310480 - DNA, 646 bp, Homo sapiens
  misc_feature: GZ8MTXP01EYRHP.21.22.B11.1.454.CMB.2.raw
  modified_base (200)..(200): a, c, t, g, unknown or other
  misc_feature (200)..(200): n is a, c, g, or t
tcagtcgtcgctcgcacgaccggtgctcgatttagacgacagctcagggggagcttcagctgtggtagagaagacaggactcaggacaatctccagcatggccggcttccctctcctcctcaccctcctcactcactgcgcagggtcctgggcccagtctgtgctgactcagtcaccctcagcgtcgtgggacccccggnagagggtcaccatctcttgtctggagcaactcaacatcggaataattatgtattctggtatcagcaactcccaggaatcggacccccaaactcctcactccaagaggaaataatcacgcggccctagacgggggtccctagaccgtacttctacgtggcctaccgaaagtcctcggcctaccctcgacgtcccctcccgtcgaacccacttcgacggtcggggcctccgggtccggaaggattggaacgggtctaggtaacttaacgttacctggggtacgtacaaccgttacggaaaccgggggaccacgaaacgtaaggttggggaatacgaacaaacgttcggtaggagggtccggggtttggggttacggttacgggggacgggaacgggaacctaaacggcgtaaacccggtcgtacgggactaaccggccccgtaacggg

SEQ ID NO: 310481 - DNA, 589 bp, Homo sapiens
  misc_feature: GZ8MTXP01E4AM5.21.22.B11.1.454.CMB.2.raw
  modified_base (333)..(333): a, c, t, g, unknown or other
  misc_feature (333)..(333): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctgggacccccggcagagggtcaccatctcttgttctggaggcaactcaacatcggaagtaattatgtattctggtatcagcaactcccaggaatcggacccccaaactcctcatccagagaataatcagccgcctcgacggggtcccngaccgactttcctctggcctaccgaaaagtctggccactcacgccctccctgaccatcgaggtcgggcctccgggtcgaggatgaggctgaacttattacgtggtgcaagtcgacggggaccacaaacgtagtggggataggaaccaagttcgtggagggtccgggtttaggggtcggttccggggacgggacggggttaaaccctaacggtcggtaaccccgtacgtacgggttaccgaacggccccgtaacggg

SEQ ID NO: 310482 - DNA, 731 bp, Homo sapiens
  misc_feature: GZ8MTXP01C9NT4.21.22.B11.1.454.CMB.2.raw
  modified_base (199)..(199): a, c, t, g, unknown or other
  misc_feature (199)..(199): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctcgggacccccggnagagggtcacatctcttgttctggagcaactccaacatacggaataattatgtattctggtatcagcaactccaggaactcggaccccaaactcctcactccagagaaatactcagccggcctcgacgggtccctgaccgtacttcctacgtggcctaccaaaacgtcgtcggcctaacccttcgaccgtcccctacccgtcgaaccctaattccgaacgggttccggggtcccgttccccggggtacccggtaagggtacgttcgggaacgggtacgttccggtaaactttacgtttaaccgttggggttacggacttaaccgtaccggaaacccgggggaacaacccgaaaacgtacgggttacgggggaattacggaaacccgtaaagttcccggtagggttaacggtcgggggtttcggggtttacgggttcggggaccggggttaaacggggaaccccttaaaacggtccggtaacccggttcccggtaacgggttacccgtaaccgggaaccccgtaaacccgggg

SEQ ID NO: 310483 - DNA, 597 bp, Homo sapiens
  misc_feature: GZ8MTXP01DH7NZ.21.22.B11.1.454.CMB.2.raw
  modified_base (200)..(200): a, c, t, g, unknown or other
  misc_feature (200)..(200): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctgggaccccccgggnagagggtcaccatctcttgttctggaggcaaactccaacatcggaagttaattatgtattctggtatcagcaactcccaaggaatcggacccccaaactcctcatccagaggaataatcagcggccctgacggggtccctgaccgattctctggcctccgaaagtctggccaacctcacgtccctccctgacccatcaggtcgggctccgggtcgaggactggaggctagacttattacctgggtacgctaatcgaccgggacgcaaacgagtgggactagacctaatcgtggagggtccgggttggggttcggttccgggacggggagggaaccccgtaaaacgtcggtaaccccggttacccgtagggttaccctaacggaacccccgtaagggg

SEQ ID NO: 310484 - DNA, 556 bp, Homo sapiens
  misc_feature: GZ8MTXP01CB82F.21.22.B11.1.454.CMB.2.raw
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagcccaccctcagcgtctgggaccccccgggcagagggtcaccatctcttgttctggaggcaactccaacatcggaagtaattatgtattctggtatcagcaactcccaggaatcggcccccaaatcctcatccagagaataatcagcggccctcgacgggggtccctgaccgtattcctcgtggcctccaaaagttctgggccaccctcacgcccctccctgacccatcaggtcgggctccgggccgaggactgaggctgactagttactgggtgccagtcgacgggacgcaacagtgggatgaacaagtcgtgaggtcgggttgggtcggtcggggacgggggaccaaacgtcggaccgtcgtaggtcgacgcccgaaggtcccg

SEQ ID NO: 310485 - DNA, 551 bp, Homo sapiens
  misc_feature: GZ8MTXP01ATJ3Z.21.22.B11.1.454.CMB.2.raw
  modified_base (199)..(199): a, c, t, g, unknown or other
  misc_feature (199)..(199): n is a, c, g, or t
  modified_base (417)..(417): a, c, t, g, unknown or other
  misc_feature (417)..(417): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctgggaccccccggnagaggttcaccatctcttgttctggagcaactccaacatcggaagttaattatgtattctggtatcagcaactcccaggaatcggacccccaaatcctcatccagagaataatcagcgccctcgacggggtccctgaccgacttcctcgtggcctccaaagttctcggccacctcacgccctccctgacccatcaggtcgggcctcccgggtcgaggntgacggctcgacttattactgggtcgcactcgaacgggcacaacagtggatgaacaatcgtggaggtcggttgggtcgttcgggcgggttagggaaccaaacgtgaacccgtcgaggttcaacgcccgaacggg

SEQ ID NO: 310486 - DNA, 559 bp, Homo sapiens
  misc_feature: GZ8MTXP01A1XP4.21.22.B11.1.454.CMB.2.raw
  modified_base (261)..(261): a, c, t, g, unknown or other
  misc_feature (261)..(261): n is a, c, g, or t
  modified_base (350)..(350): a, c, t, g, unknown or other
  misc_feature (350)..(350): n is a, c, g, or t
  modified_base (433)..(433): a, c, t, g, unknown or other
  misc_feature (433)..(433): n is a, c, g, or t
  modified_base (448)..(448): a, c, t, g, unknown or other
  misc_feature (448)..(448): n is a, c, g, or t
  modified_base (454)..(454): a, c, t, g, unknown or other
  misc_feature (454)..(454): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctgggacccccggcagagggtcaccatctcttgttctggagcaactccaacatcggaagtattatgtattctggtancagcaaactcccaggaatcggaccccccaaatcctcatccaagaggaataatcagccggccctcgacgggggtccctgaccgtacttcnctggcctccaaagtcctggccacctcacgccctcctgacccatcaggtcgggctccgggtcgaggatggagctgactattacngtgcatcgacgggcncaaacngtgggatacgaacaatccgtaggacggtcgggtttggggtcgttacggggcgggacgggttacccaaagtcggaacccgtcgtagggttccaacgccccgaaggg

SEQ ID NO: 310487 - DNA, 576 bp, Homo sapiens
  misc_feature: GZ8MTXP01AS7TG.21.22.B11.1.454.CMB.2.raw
  modified_base (265)..(265): a, c, t, g, unknown or other
  misc_feature (265)..(265): n is a, c, g, or t
  modified_base (312)..(312): a, c, t, g, unknown or other
  misc_feature (312)..(312): n is a, c, g, or t
  modified_base (445)..(445): a, c, t, g, unknown or other
  misc_feature (445)..(445): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagcccaccctcagcgtctcgggacccccgggcagagggtcaccatctcttgttctggagcaactccaacatcggaagtaattatgtattctggtancagcaactccaggaatcgaccccaaactcctcatccagagaaataancagcgcctgacggggtccctgaccgtacttctctggcctaccaaaagtcgtcggccaccctcacgccctcctagacccatcaggtcgggccgtccggtcgaggactgaggctagacttattacgtggggtacnctacgtcgacggggacacaaacagtagggaatcggaacaagttcgtggaggtcgggttggggtacggttcgggacgggttacgggaacctaaacgtcggtaacccgtacgtacggttccaacgccgaacgg

SEQ ID NO: 310488 - DNA, 582 bp, Homo sapiens
  misc_feature: GZ8MTXP01DQGX6.21.22.B11.1.454.CMB.2.raw
  modified_base (201)..(201): a, c, t, g, unknown or other
  misc_feature (201)..(201): n is a, c, g, or t
  modified_base (417)..(417): a, c, t, g, unknown or other
  misc_feature (417)..(417): n is a, c, g, or t
  modified_base (458)..(458): a, c, t, g, unknown or other
  misc_feature (458)..(458): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtcgtcgggacccccgggnagagggtcaccatctcttgttctggaggcaactccaaacatacggaagttaaattatgtattctggtatcagcaactcccaggaatcggacccccaaactcctcactccagaggaaataatcagcggccctcgacggggtccctgaccgtattctctggctccaaagtctggcacctcacgccctcctgaccatcaggtcggctccggtccgaggntgatgctgactattacgtgtgcagtcgacgggacgcaaacngtaggggatcgaactaaatcgttggtacgggttcgggtttaggggtcggtttacggggccgggaacgggtaacccgaaaacgttcggaacccggttccgttacgggtaaccgaacggaaccccg

SEQ ID NO: 310489 - DNA, 635 bp, Homo sapiens
  misc_feature: GZ8MTXP01C3SM3.21.22.B11.1.454.CMB.2.raw
  modified_base (239)..(239): a, c, t, g, unknown or other
  misc_feature (239)..(239): n is a, c, g, or t
  modified_base (346)..(346): a, c, t, g, unknown or other
  misc_feature (346)..(346): n is a, c, g, or t
  modified_base (376)..(376): a, c, t, g, unknown or other
  misc_feature (376)..(376): n is a, c, g, or t
  modified_base (408)..(408): a, c, t, g, unknown or other
  misc_feature (408)..(408): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtcgtcggggacccccggcaggagggtcaccatctcttgttctggagcaactccaanatacggaattaattatgtattcgtgtatcagcaactcccaaggaactccggaccccaaactcctacactccaagaggaataactcagccggcctacgacgggtcccngaccgtacttctcgtggctactaaagttcncggccacctcacgtcccctcctacgaaccctntacgacggtcggtccgtccggtacggaggtacgtaggacggtactacgtaacttaacgttacgtcgggtcgtacgtacgtaccggaaccgggaacgacgaacgtaggtacggtaatacgaactaagtcggtaggttacgggtgggttgggtacgggtcgggacggggaacgttaaccgtaacggtaccggtccgttacgtacggttaccgtaaccggaaccgtaacg

SEQ ID NO: 310490 - DNA, 759 bp, Homo sapiens
  misc_feature: GZ8MTXP01BWZZY.21.22.B11.1.454.CMB.2.raw
tcagtcgtcgctcgcacgaccggtgctcgatttagacgacagctcaggggagcttcagctgtggtagagaagacaggactcgggacaatctccagcatggccggcttccctctcctcctcaccctcctcactcactgcgcagggtcctgggcccagtctgtgctgactcacgccaccctcagcgtcgtcgggacccccgggcagacgggtcaccatctcttgttctggagcactcaacatacgaataattatgtatctggtatcagcaacctcccaaggaactccggacccccctaaactccctacactaccgaaggaacggaaattaaacgtcaacggcccgggcccttaccggacggggggttccccttacggacccgtactttccccgtccgtcgggtacccttaccgaaacggttcccgttacgggccctaaacccgttccgaaccggtcccccttccccgtacggaaaccctaacgtccgaacgggccggggtacccgtcccgggtaccggaagggtaacgttcgggacggtctacggaaccttagttacgtcggttcgggactaacggtcccgaacgggggaccaaccgaaagaggttacggggaatacggaaactaacggttcgtaagggtacggttcgggggtttacggggttcgggttaccggggacgggttaacgggaacccttaaaccggttcgggaacccggttccgttacggggtaccgaccggtaaccccgttaacgggtccccg

SEQ ID NO: 310491 - DNA, 683 bp, Homo sapiens
  misc_feature: GZ8MTXP01EGP87.21.22.B11.1.454.CMB.2.raw
  modified_base (200)..(200): a, c, t, g, unknown or other
  misc_feature (200)..(200): n is a, c, g, or t
  modified_base (264)..(264): a, c, t, g, unknown or other
  misc_feature (264)..(264): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagcccaccctcagcgtctgggaccccccggnagaggtcacatctcttgtcgtggagcaactccaacagtacggaattaattatgtattcgtgtancagacactccagactccgaccccaactcctcactacagaagaatatcagccgcctcgtacggtcctcgaccgtactctgtcgcctaccgtaagtcgtcggcctaccgtcaccgtcccctcccgtacgaaccctacgtccgtacgggtcggggtcccgttcccgggtaccggtaacgggtagtacgggacggtcgttacgtaacttaacgtttaccgtggggtcgacgtacgtaccgggaacgggaccacgtaaacgtaggtacgggtacgtacgtaaccgtaagttcggtagggttacggggttcgggggttttcgggggtaccgggtttaccggggacggggaacgggttaaacccgtaaacggttccgggaacccggttaccggtacgggttaccgtaacccgggaacccgtaacgg

SEQ ID NO: 310492 - DNA, 583 bp, Homo sapiens
  misc_feature: GZ8MTXP01ETVQP.21.22.B11.1.454.CMB.2.raw
  modified_base (201)..(201): a, c, t, g, unknown or other
  misc_feature (201)..(201): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagcccaccctcagcgtcgtcgggacccccggnagagggtcaccatctcttgtctggagcaactccaacatcggaaattaattatgtattctggtatcagcaactcccaggaactcggacccccaaactcctcactccaagagaaataatcagccggccctcgacgggggtccctgaccgtattcctcgtcggcctcccgaaaagtcctggccaccgtcacgtccctccctgacccatcaggtcggctccggtcgaggatggagctgaactagttacgtgggtcgacagtcgacgggacacgaaacgagtgggaataggaactaatcgttggagggtcgggtttgggtggttcggggacgggttacgggaacccaaagtcgtaacccgtaccgtaggccaacggaaccccgaagg

SEQ ID NO: 310493 - DNA, 547 bp, Homo sapiens
  misc_feature: GZ8MTXP01AWLW0.21.22.B11.1.454.CMB.2.raw
  modified_base (199)..(199): a, c, t, g, unknown or other
  misc_feature (199)..(199): n is a, c, g, or t
  modified_base (296)..(296): a, c, t, g, unknown or other
  misc_feature (296)..(296): n is a, c, g, or t
  modified_base (344)..(344): a, c, t, g, unknown or other
  misc_feature (344)..(344): n is a, c, g, or t
  modified_base (425)..(425): a, c, t, g, unknown or other
  misc_feature (425)..(425): n is a, c, g, or t
  modified_base (445)..(445): a, c, t, g, unknown or other
  misc_feature (445)..(445): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctgggaccccccggnagagggtcaccatctcttgtctggagcaactccaacatcggaagttaattatgtattctggtatcagcaactcccaggaatcggacccccaaatccncatccagagaatatcagcgccctgacggggtccctgaccgtattcctntggcctccaaagttctggccacctcacgccctcctgacccatcagtcgggctccggtcgagactgacggctgactattacngggtgactatccgagggacncaacgagtgggaactgaacaagtctaggaggtcggttgggtcgttcgggacggacggaaccaaactggaacccgtccgaggttccaacggttccccgaaggg

SEQ ID NO: 310494 - DNA, 576 bp, Homo sapiens
  misc_feature: GZ8MTXP01AHJA8.21.22.B11.1.454.CMB.2.raw
  modified_base (201)..(201): a, c, t, g, unknown or other
  misc_feature (201)..(201): n is a, c, g, or t
  modified_base (264)..(264): a, c, t, g, unknown or other
  misc_feature (264)..(264): n is a, c, g, or t
  modified_base (453)..(453): a, c, t, g, unknown or other
  misc_feature (453)..(453): n is a, c, g, or t
  modified_base (475)..(475): a, c, t, g, unknown or other
  misc_feature (475)..(475): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccacccctcagcgtcgtgggaccccccggnagagggtcaccatctcttgttctggagcaactccaacatcggaataattatgtattctggtancagcaactcccaaggaactcggacccccaaactcctacactccaagagaaataatcagccgccctagacgggtccctgaccgtacttccgtctggcctaccgaaagtccgtcggccaccctcacgtcccctcctcgacccatcgaggtcgggccctccgggtccgaggatggagctgaacttagttacngggtcgctatccggacgggacncaacgtagtgggatgaactagtcgtggacgggtcgggttgggtacggtcgggacggagggttaaaccaacgtgaacccgtcgtaggccaacgcccgtaagg

SEQ ID NO: 310495 - DNA, 608 bp, Homo sapiens
  misc_feature: GZ8MTXP01EXED5.21.22.B11.1.454.CMB.2.raw
  modified_base (199)..(199): a, c, t, g, unknown or other
  misc_feature (199)..(199): n is a, c, g, or t
  modified_base (517)..(517): a, c, t, g, unknown or other
  misc_feature (517)..(517): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctgggacccccgggnagagggtcaccatctcttgtctggagcaactccaacatcggaattaattatgtattctggtatcagcaactcccaggaatcggacccccaaactcctacatccgaagaggaataatcagccggccctgacggggtcccctgaccgtactttcctcgtggtcctacccaaagtccgtggccaaccctcacgtcccctcccctgaccctatcgaggtcgggcctccggtacgaggatggacggctagaaccttagttactggggtacgcgtacgtcgaacggggacactaacgagtggggaatggacctaagtcgtaggngggtcgggtttgggcggttcgggacgggttacgggaaccctaaacggtcggaacccggttcgtaacgggttccaacggttaaccccgaagg

SEQ ID NO: 310496 - DNA, 597 bp, Homo sapiens
  misc_feature: GZ8MTXP01EDQIN.21.22.B11.1.454.CMB.2.raw
  modified_base (202)..(202): a, c, t, g, unknown or other
  misc_feature (202)..(202): n is a, c, g, or t
  modified_base (396)..(396): a, c, t, g, unknown or other
  misc_feature (396)..(396): n is a, c, g, or t
tcagtcgtcgctcgcacgaccggtgctcgatttagacgacagctcaggggagcttcagctgtggtagagaagacaggactcaggacaatctccagcatggccggcttccctctcctcctcacccctcctcactcactgcgcagggtcctgggcccagtctgtgctgactcagccaccctcagcgtcgtcgggaccccccggnaggagggtcaccatctcttgttctggagcaactccaacatacggaagttaattatgtattctggtatcagcaactcccaggaactcggacccccaatcctcatccagagaataatcagccggcctcgacgggtccctgaccgtattcctactggcctcccgaaaagtctcgggccaaccctcacgtccctcccngaccatcgacggtgggcctccgggaccgaggattggaggcttagacttattacgtggtcgacgtactccgacggggtaccacaaacgtagtggggattcggaactaagtcgtgggacggtcgggggtttggggcggtttcggggacgggacgggaacctaaagtcggaaccgttcggaggttcgaaccggccgtaaccggg

SEQ ID NO: 310497 - DNA, 621 bp, Homo sapiens
  misc_feature: GZ8MTXP01A1UXN.21.22.B11.1.454.CMB.2.raw
  modified_base (201)..(201): a, c, t, g, unknown or other
  misc_feature (201)..(201): n is a, c, g, or t
  modified_base (257)..(257): a, c, t, g, unknown or other
  misc_feature (257)..(257): n is a, c, g, or t
  modified_base (262)..(262): a, c, t, g, unknown or other
  misc_feature (262)..(262): n is a, c, g, or t
  modified_base (295)..(295): a, c, t, g, unknown or other
  misc_feature (295)..(295): n is a, c, g, or t
  modified_base (434)..(434): a, c, t, g, unknown or other
  misc_feature (434)..(434): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagcccaccctcagcgtcgtcgggacccccggnagagggtcaccatctcttgtctggagcaactcaacatacggaataatatgtattcnggtancagcaactccaggaatccggaccccaatcctanatccagagaataatcagccgcctgacgggtcctgaccgtattctgtcgctccaaagtcctggccacctcacgtccctccctgaccatcgaggtcgggcctccgggtcgaggtatggaacggtctcgtaacttattacgnggggttacgaccctaagtaccgaacgggggaccacctaaacgtaagtgggggaaatgaaccgaacttcggttaggaggggtccggggttttaggggtcggtccggggaacgggttacggggaaccccttaaaacgggtcggtaacccggttacccggtagggttaccaacgggaaccccgtaacggg

SEQ ID NO: 310498 - DNA, 576 bp, Homo sapiens
  misc_feature: GZ8MTXP01A7PDY.21.22.B11.1.454.CMB.2.raw
  modified_base (200)..(200): a, c, t, g, unknown or other
  misc_feature (200)..(200): n is a, c, g, or t
  modified_base (259)..(259): a, c, t, g, unknown or other
  misc_feature (259)..(259): n is a, c, g, or t
  modified_base (459)..(459): a, c, t, g, unknown or other
  misc_feature (459)..(459): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctcgggacccccgggnagagggtcaccatctcttgttctggagcaactcaacatcggaatatatgtattctgtancagcaactcccaggaatcggacccccaaatcctcatccagagaatatcagccgcctcgacgggggtccctgaccgtatcctcgtggctccgaaattcctggccaccctcacgtccctccctgaccctatcgaggtcgggcctcccgggtacggagagtggacggctgacttattactgggtcgcaagtcgaaccggggancaaacgtagtgggatgaacaagtcgtggacgggtcgggttgggtcgggttcgggcggggttaaggaacccgtaaagtggtaacccgtcggtaagggttcctaacggccccgtaaggg

SEQ ID NO: 310499 - DNA, 588 bp, Homo sapiens
  misc_feature: GZ8MTXP01BJQAJ.21.22.B11.1.454.CMB.2.raw
  modified_base (329)..(329): a, c, t, g, unknown or other
  misc_feature (329)..(329): n is a, c, g, or t
  modified_base (336)..(336): a, c, t, g, unknown or other
  misc_feature (336)..(336): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctcgggacccccggcagagggtcaccatctcttgttctggaggcaactccaacatcggaattaattatgtattctggtatcagcaactccaggaatcggacccccaatcctcactccagagaatatcagcgcctgacgggtcccngaccgtnttctcgtggcctaccgaaagtcctggcctacccgtcacgtccctccctgacccatcgaggtcgggcctccgggtacgaggatggaggctagacttaattccgtgggtcgcgtaatccggaacggggaccacaaagagtggggaatcgaactaagtccgtaggacgggtcggggtttggtcggttccgggacgggttacggaaccctaaagttcggaacccgtcgtaaggcccgaacggttaaccccgtaagg

SEQ ID NO: 310500 - DNA, 589 bp, Homo sapiens
  misc_feature: GZ8MTXP01AYBWB.21.22.B11.1.454.CMB.2.raw
  modified_base (198)..(198): a, c, t, g, unknown or other
  misc_feature (198)..(198): n is a, c, g, or t
  modified_base (349)..(349): a, c, t, g, unknown or other
  misc_feature (349)..(349): n is a, c, g, or t
  modified_base (445)..(445): a, c, t, g, unknown or other
  misc_feature (445)..(445): n is a, c, g, or t
  modified_base (463)..(463): a, c, t, g, unknown or other
  misc_feature (463)..(463): n is a, c, g, or t
  modified_base (472)..(472): a, c, t, g, unknown or other
  misc_feature (472)..(472): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctgggacccccggnagagggtcaccatctcttgttctggagcaactccaacatcggaagtaattatgtattctggtatcagcaactcccaggaatcggacccccaaatccctacatccagaggaataatcagccggccctcgacggggtccctgaccgtatttcncgtggcctaccgaaagtctggcccaccctcacgtccctccgtgacccatcaggtcgggccttccgggcgaaggatggaggcctagacttattacgnggtgcaatcgaacggggnacctaaagngtggatacgaactagtcgtaggagggttcgggttgggtacggtcggggacgggttaacggttaaccctaaacggtcggtaacccggttaccggacggttaccaaccggcccgaaggg

SEQ ID NO: 310501 - DNA, 807 bp, Homo sapiens
  misc_feature: GZ8MTXP01BK3OP.21.22.B11.1.454.CMB.2.raw
  modified_base (200)..(200): a, c, t, g, unknown or other
  misc_feature (200)..(200): n is a, c, g, or t
  modified_base (278)..(278): a, c, t, g, unknown or other
  misc_feature (278)..(278): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctgggaccccccgggnaggacggtcacatcttcttgtcgtggacgacaactaccaacagtacgggtaaattaattattagttattcgtaggtanacagacctaactacccgaaggaactccggaccccctaaactccctacaactaccgaaggaaggtaaactaactaccgaacgggcccggtcccgtacggtaccgggggtaccctacggtaccgtaccgtttcctcgtcggtaccctaccgtaaacgttccgtcggaccctaccctaccgaccgtccccttaccccgtacgtaccctagttccgacggggttccggggtcccgttaccccggggttaccggaaacggggtacgtacgggacggggtaccttaacggttaacctttaacgtttaccggtggggttacgtaccgtaaccgtacccgggaaaccggggaccaccgaaagtacgggtacgggtaactacggaaactaacgttccggttagggttacgggttcgggggtttacgggggttaccggttacccgggggaacggggttaaccgggttaaaacccgtaacggttcccgggtaacccgttcccgggtaagggttacccgtaaccgggttccccggtaaggg

SEQ ID NO: 310502 - DNA, 565 bp, Homo sapiens
  misc_feature: GZ8MTXP01AXBPT.21.22.B11.1.454.CMB.2.raw
  modified_base (257)..(257): a, c, t, g, unknown or other
  misc_feature (257)..(257): n is a, c, g, or t
  modified_base (430)..(430): a, c, t, g, unknown or other
  misc_feature (430)..(430): n is a, c, g, or t
  modified_base (448)..(448): a, c, t, g, unknown or other
  misc_feature (448)..(448): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctgggaccccccggcagagggtcaccatctcttgttctggagcaactcaacatcggaatatatgtatctgtancagcaactcccaggaatcggacccccaaactcctcactccagaggaataatcagccggccctcgacgggggtcccctgaccgtattctcgtggcctccaaaagtctggccacctcacgccctcctgacccatcaggtcgggcctccggtcgaggatgaggctgacttattacnggtgcagtcgacgggacncaacgagtggggatcggaacaagtcgtggaggtcggggttgggtggttcggggacgggttaggggaacccaaacggtcggaacccggttccgtagggttccaacggccccgtaaggg

SEQ ID NO: 310503 - DNA, 756 bp, Homo sapiens
  misc_feature: GZ8MTXP01ECUD1.21.22.B11.1.454.CMB.2.raw
  modified_base (199)..(199): a, c, t, g, unknown or other
  misc_feature (199)..(199): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctcgggacccccggnagagggtcaccatctcttgttctggagcaactccaacatcggaagtaattatgtattctggtatcagcaactcccaggaatcggacccccaatcctcatccagaaggaataactcacgccggccctcgacggggtcccctggacccgtattcctcgtcggtcctaccaaaagttcctcgggaccctaacccttcaccggtcccccttacccgtacgaaccctacgttccgacgggttccgggggcccttccccggggtacccggaacggggtaacgttgggaaccggggtccttacgggtaaacctttaacgtttaacccgtgggggttacgacccgtaaacgttaccccggaaaccggggggtaaccacccgtaaaacgtaagggttgggggtaaacttacggaaacccttaaagttccggttagggacgggggtttccgggggttttgggggtacgggtttacccgggggaccggggttaacggggaaacccctaaaacggttcggaaccccggttcggtaaacgggttccgaacccggttaacccgtaaccggg

SEQ ID NO: 310504 - DNA, 664 bp, Homo sapiens
  misc_feature: GZ8MTXP01C3O0E.21.22.B11.1.454.CMB.2.raw
  modified_base (199)..(199): a, c, t, g, unknown or other
  misc_feature (199)..(199): n is a, c, g, or t
  modified_base (216)..(216): a, c, t, g, unknown or other
  misc_feature (216)..(216): n is a, c, g, or t
  modified_base (236)..(236): a, c, t, g, unknown or other
  misc_feature (236)..(236): n is a, c, g, or t
  modified_base (263)..(263): a, c, t, g, unknown or other
  misc_feature (263)..(263): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctcgggacccccggnaggagggtcaccatctnttgtctggagcaactccaanatacggaataattatgtattctagtancagcaactcccagactcgaccccaatcctcatccagagaataatcagccggccctacgacgggtccctagaccgtacttctcgtggcctaccgaaagttccgtcggaccctaaccctccgaaccgtccccttaccccgtagaacccctagtccgtacgggtcggggcccttcccgggtaccggaagggtactgggacggtctagtaaccgtttaattaccgtgggtcgacctaagtacccggaacggggaacccacaaaccgtaggtgggtaactacggaaacaagttcgtagggacgggttcggggtttggggtcggttccgggacggggttacggaaaccccgtaaacgtccggtaacccgttaccggtacggttaccaacggttaaccccgtaacggg

SEQ ID NO: 310505 - DNA, 615 bp, Homo sapiens
  misc_feature: GZ8MTXP01AJJ9N.21.22.B11.1.454.CMB.2.raw
  modified_base (199)..(199): a, c, t, g, unknown or other
  misc_feature (199)..(199): n is a, c, g, or t
  modified_base (260)..(260): a, c, t, g, unknown or other
  misc_feature (260)..(260): n is a, c, g, or t
  modified_base (419)..(419): a, c, t, g, unknown or other
  misc_feature (419)..(419): n is a, c, g, or t
  modified_base (474)..(474): a, c, t, g, unknown or other
  misc_feature (474)..(474): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctcgggacccccggnagagggtcaccatctcttgttctggagcaactccaacatcggaatattatgtattctgtancagcaactcccaggaactcggacccccaaactccctcatccagaggaataatcagccggccctgacggggtccctgaccgtattctcgtggctccaaagtctcggccacccgtcacgtccctcctgacccatccgaggtcgggcctccgggtcgaaggntggacggtctgaacttacttacgtgggtcgcataccggaacggggacacaaacgngtggggatacggaacaagtctagggagggtcgggtttgggggtcggttccggggacgggttaacgggggttacccctaaaacggttcgggaaccccggttacccgttaagggggccctaaccggggccccgtaaaccgggg

SEQ ID NO: 310506 - DNA, 579 bp, Homo sapiens
  misc_feature: GZ8MTXP01AHVML.21.22.B11.1.454.CMB.2.raw
  modified_base (352)..(352): a, c, t, g, unknown or other
  misc_feature (352)..(352): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctgggacccccggcagagggtcaccatctcttgttctggagcaactccaacatcggaagtaattatgtattctggtatcagcaactcccaaggaactcggacccccaaatccctacatccagaggaaataatcagccggccctgacgggggtccctgaccgtacttcnctcggcctaccaaagttctggcctaccctcacgccctccgtgacccatcgaggtcgggcctccggtcgaggtatggaggcttagacttagttactggggtcgacatccgaacgggcactaacgagtgggatggaaccagtcgtgggagtcggggttgggtcggttcgggacggagggaccctaaacgtcggaacccttccggtaggttccaacggccccgtaacggg

SEQ ID NO: 310507 - DNA, 817 bp, Homo sapiens
  misc_feature: GZ8MTXP01DG35L.21.22.B11.1.454.CMB.2.raw
  modified_base (201)..(201): a, c, t, g, unknown or other
  misc_feature (201)..(201): n is a, c, g, or t
tcagtcgtcgctcgcacgaccggtgctcgatttagacgacagctcaggggagcttcagctgtggtagagaagacaggactcaggacaatctccagcatggccgacttccctctcctcctcacccctctcactcactgcgcagggtcctgggcccagtctgtgctgactcagccaccctcagcgtcgtcgggaccccccggnaggaggtccacatctcttgtctggagcaactccaacatacggaattattatgtattcgtaggtatcagcaaacctcccgaaggaactccggacccccaaatccctacgactccgagaaggtaaatactacgcggacccggtcccctaggaccgggggttcccctcgaacccggtatttcctacgtcgggtcctaccccgaaaagttccgtgggaccctaaaccccgttcaccggtcccctttcccccgagtaaacccctagttaccgcggggttacgggggcccctttaccccgggggtcccgggaaacgggtaacgtttgggaacgggggtaccttacggtaaaccgttttattaaacccggtttggggcgggtaaacctaccgttaaccgggaaacccgggggaaccgtaacccaaacgtaaagggttcgggggtaattacggaaacctaaacggtcggttagggttaaacggggtccgggggggtttttacgttacggggggtaacccgggggaccgggggttaaaccgggttaaaacccgtaaaccggtcccgggtaaccccggttaaccgggttaccggttaaccgtaaccccggaaaccccgggtaacgg

SEQ ID NO: 310508 - DNA, 598 bp, Homo sapiens
  misc_feature: GZ8MTXP01BW8F9.21.22.B11.1.454.CMB.2.raw
  modified_base (202)..(202): a, c, t, g, unknown or other
  misc_feature (202)..(202): n is a, c, g, or t
  modified_base (268)..(268): a, c, t, g, unknown or other
  misc_feature (268)..(268): n is a, c, g, or t
  modified_base (350)..(350): a, c, t, g, unknown or other
  misc_feature (350)..(350): n is a, c, g, or t
  modified_base (404)..(404): a, c, t, g, unknown or other
  misc_feature (404)..(404): n is a, c, g, or t
  modified_base (460)..(460): a, c, t, g, unknown or other
  misc_feature (460)..(460): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagcccaccctcagccgtcgtcgggacccccggnagaggtcaccatctcttgttctggagcaactccaacatacggaagttaattatgttattctggtancagcaactcccaggaactccggacccccaaactcctacactaccagaaggaaataatcgagccggccctcgacggggtcccngaccgtacttctcgtggcctcaaacgtctcgccacctcacgccctccagacccngtacaggtcgggtcctccgggtcgaggtatggaggcttagtaacttagtttaccgnggtcgactacgtacgacgggaccacaaacgagtgggatacgaactatcgtggaggtcgggttaggggttcgtacggggacggttacgggaacctaacggtcgtaacccgtacgtacggttacaaccggccgtaaccgg

SEQ ID NO: 310509 - DNA, 580 bp, Homo sapiens
  misc_feature: GZ8MTXP01DX9Z0.21.22.B11.1.454.CMB.2.raw
  modified_base (200)..(200): a, c, t, g, unknown or other
  misc_feature (200)..(200): n is a, c, g, or t
  modified_base (265)..(265): a, c, t, g, unknown or other
  misc_feature (265)..(265): n is a, c, g, or t
  modified_base (408)..(408): a, c, t, g, unknown or other
  misc_feature (408)..(408): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtcgtcgggacccccggnagagggtcaccatctcttgttctggagcaactccaacatacggaattaattatgtattctggtancagcaactccaggactcggaccccaatcctcatccagaagaatatcagcgcctgacgggtcctgaccgtacttctcgtgcctaccaaagtctggccacctcacgtccctcctgaccatcgaggtcgggcctccgggtcgaggntggaggctagaacttattcgtgggtcactagtccgacgggacacaacgagtgggatagaactaagtcgtggacgggttcggggtttagggtcggttaccggggacgggttaacgggaaccctaaacgttcggaacccgttacgtacggaccgtaaccggaacccgtaacggg

SEQ ID NO: 310510 - DNA, 582 bp, Homo sapiens
  misc_feature: GZ8MTXP01CCA2T.21.22.B11.1.454.CMB.2.raw
  modified_base (352)..(352): a, c, t, g, unknown or other
  misc_feature (352)..(352): n is a, c, g, or t
tcagtcgtcgctcgcacgaccggtgctcgatttagacgacagctcaggggagcttcagctgtggtagagaagacaggactcaggacaatctccagcatggcccggcttccctctcctcctcaccctcctcactcactgcgcagggtcctgggcccagtctgtgctgactcagccaccctcagcgtctgggaccccccggcagagggtcaccatctcttgttctggaggcaactccaaacatcggaagtaaattatgtattctggtatcagcaactcccaggaatcggcccccaaatcctcatccagagaataatcagcggccctcgagggggtcccctgaccgtacttcctntggcctccaaaagtctggccacctcacgccctccctgacccatccagtgggcctccgggtcgaggatggaggcctagaacttattacgtgggtcgcaagtccgaacgggggacaccaaagagttggggaataggaccaaagtccgtaggacggtcgggttggggtacgttccgggacgggaggaacccaaagtcgtaaccgtcccgagggttccaacggccccgaacggg

SEQ ID NO: 310511 - DNA, 570 bp, Homo sapiens
  misc_feature: GZ8MTXP01CSPG1.21.22.B11.1.454.CMB.2.raw
  modified_base (200)..(200): a, c, t, g, unknown or other
  misc_feature (200)..(200): n is a, c, g, or t
  modified_base (264)..(264): a, c, t, g, unknown or other
  misc_feature (264)..(264): n is a, c, g, or t
  modified_base (294)..(294): a, c, t, g, unknown or other
  misc_feature (294)..(294): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctgggaccccccgggnagagggtcaccatctcttgttctggaggcaactccaacatcggaagtaattatgtattctgtancagcaactccagactcggccccaaactccncatccagagaataatcagccggccctcgacgggggtccctgaccgtacttcctctggcctccaaaagttctcggccaccctcagcccctcctgacccatcgaggtcgggcctccgggtaccgaggctggacggtctagacttattacgtggtgactatccgacggggacacaacgagtgggtatgaacaagtcgtgaggtcgggttagggtcgttcgggacgggacggaccctaaacgtcggtaacccgttcgtaggcctaaccgcccgtaacggg

SEQ ID NO: 310512 - DNA, 552 bp, Homo sapiens
  misc_feature: GZ8MTXP01CI9MT.21.22.B11.1.454.CMB.2.raw
  modified_base (199)..(199): a, c, t, g, unknown or other
  misc_feature (199)..(199): n is a, c, g, or t
  modified_base (222)..(222): a, c, t, g, unknown or other
  misc_feature (222)..(222): n is a, c, g, or t
  modified_base (263)..(263): a, c, t, g, unknown or other
  misc_feature (263)..(263): n is a, c, g, or t
  modified_base (435)..(435): a, c, t, g, unknown or other
  misc_feature (435)..(435): n is a, c, g, or t
  modified_base (463)..(463): a, c, t, g, unknown or other
  misc_feature (463)..(463): n is a, c, g, or t
  modified_base (476)..(476): a, c, t, g, unknown or other
  misc_feature (476)..(476): n is a, c, g, or t
  modified_base (483)..(483): a, c, t, g, unknown or other
  misc_feature (483)..(483): n is a, c, g, or t
tcagtcgtcgctcgcacgaccggtgctcgatttagacgacagctcaggggaggcttcagctgtggtagagaagacaggactcaggacaatctccagcatggccggcttccctctcctcctcaccctcctcactcactgcgcagggtcctgggcccagtctgtgctgactcagccacctcagcgtctgggaccccccggnagagggtcaccatctcttgttcnggagcaactcaacatcggaattaattatgtattctaggtancagcaactcccaaggaatccggacccccaaatcctcatccagagaatatcagccgcctcgaggggtccctgaccgtacttctcgtggcctccaaagtctggccacctcacgccctcctgacccatcgaggtcggctaccggtcgaaggatggacggctagaacttattacgnggggtgctatcggaaaccggcgactaanaggtggatcgaanaagtcgngagggtcgggttgggtacggtcggacgggttaaggaccctaagtgaacccgtcgtagcaacgccgaacg

SEQ ID NO: 310513 - DNA, 547 bp, Homo sapiens
  misc_feature: GZ8MTXP01DD056.21.22.B11.1.454.CMB.2.raw
  modified_base (215)..(215): a, c, t, g, unknown or other
  misc_feature (215)..(215): n is a, c, g, or t
  modified_base (358)..(358): a, c, t, g, unknown or other
  misc_feature (358)..(358): n is a, c, g, or t
  modified_base (480)..(480): a, c, t, g, unknown or other
  misc_feature (480)..(480): n is a, c, g, or t
  modified_base (499)..(499): a, c, t, g, unknown or other
  misc_feature (499)..(499): n is a, c, g, or t
  modified_base (528)..(528): a, c, t, g, unknown or other
  misc_feature (528)..(528): n is a, c, g, or t
  modified_base (539)..(543): a, c, t, g, unknown or other
  misc_feature (539)..(543): n is a, c, g, or t
  modified_base (545)..(545): a, c, t, g, unknown or other
  misc_feature (545)..(545): n is a, c, g, or t
  modified_base (547)..(547): a, c, t, g, unknown or other
  misc_feature (547)..(547): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcaaccaccctcagcgtctcgggacccccggcagagggtcaccatctnttgttctggagcaactccaacatcggaaataattatgtattctgtatcagcaactcccaaggaactcggacccccaaatcctacatccaagaagaaataatcagcccggccctcgacgggggtcccctagacccgtatttccncgtaggctaccaagttcctggcctacctcacgcccctcctgaccatcgagtcgggcctccggtcgaggatggagtctagacttattacgtgtacggactagtccgaaccgggacaccgaagngtagggatagaaccatcgnggacggcgggtacaggaaccgaagggccngttaagtgggnnnnngngn

SEQ ID NO: 310514 - DNA, 566 bp, Homo sapiens
  misc_feature: GZ8MTXP01CLECD.21.22.B11.1.454.CMB.2.raw
  modified_base (199)..(199): a, c, t, g, unknown or other
  misc_feature (199)..(199): n is a, c, g, or t
  modified_base (264)..(264): a, c, t, g, unknown or other
  misc_feature (264)..(264): n is a, c, g, or t
  modified_base (437)..(437): a, c, t, g, unknown or other
  misc_feature (437)..(437): n is a, c, g, or t
  modified_base (457)..(457): a, c, t, g, unknown or other
  misc_feature (457)..(457): n is a, c, g, or t
  modified_base (512)..(512): a, c, t, g, unknown or other
  misc_feature (512)..(512): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctgggaccccccggnagagggtcaccatctcttgttctggaggcaactccaacatcggaagtaattatgtattctggtancagcaactcccaggaatcggacccccaaactcctcatccagagaataatcagcggccctcgaggggtccctgaccgacttctcgtggctccaaaagttctggcacctcacgccctccctgacccatcgaggtcgggcctccgggtccgaggtactggaggctgaactattacngggtcgcatcgacggggacncgaacgagtgggatgaacaatcgtgaggtcgggttgggtacggttcgggacgggngggaaaccctaaacgtcggtaacccgtcgtagggttccaacggccccgtaaggg

SEQ ID NO: 310515 - DNA, 557 bp, Homo sapiens
  misc_feature: GZ8MTXP01EWEMX.21.22.B11.1.454.CMB.2.raw
  modified_base (201)..(201): a, c, t, g, unknown or other
  misc_feature (201)..(201): n is a, c, g, or t
  modified_base (315)..(315): a, c, t, g, unknown or other
  misc_feature (315)..(315): n is a, c, g, or t
  modified_base (335)..(335): a, c, t, g, unknown or other
  misc_feature (335)..(335): n is a, c, g, or t
  modified_base (349)..(349): a, c, t, g, unknown or other
  misc_feature (349)..(349): n is a, c, g, or t
  modified_base (372)..(372): a, c, t, g, unknown or other
  misc_feature (372)..(372): n is a, c, g, or t
  modified_base (379)..(379): a, c, t, g, unknown or other
  misc_feature (379)..(379): n is a, c, g, or t
  modified_base (436)..(436): a, c, t, g, unknown or other
  misc_feature (436)..(436): n is a, c, g, or t
  modified_base (461)..(461): a, c, t, g, unknown or other
  misc_feature (461)..(461): n is a, c, g, or t
  modified_base (469)..(469): a, c, t, g, unknown or other
  misc_feature (469)..(469): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagcccaccctcagcgtctcgggacccccgggnagagggtcaccatctcttgttctggagcaactccaacatcggaagttaattatgtattctggtatcagcaactcccaggaactcggacccccaaactcctcatccagagaatancagcgccctgacgggtcccngaccgtattctcgngctaccaaagtctgcacctcacnccctccngacccatcgaggtcgggctcccgggtacgaggatggacggctagtacttaattccgngggttgcctagtccgaacggggacncgaaacgngtagggactagaactaatcgtgaggtcgggttgggtgtcgggacggaggttacccaagtcgaaccgtccaggcaaccgttccgaacgg

SEQ ID NO: 310516 - DNA, 789 bp, Homo sapiens
  misc_feature: GZ8MTXP01BWBS7.21.22.B11.1.454.CMB.2.raw
  modified_base (201)..(201): a, c, t, g, unknown or other
  misc_feature (201)..(201): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtcgtcgggaccccccggnagaggttcaccatctcttgttctggagcaactccaacatcggaaagttaaattatgtattcgtggtatcagcaactcccaggaactccggacccccaaatcctacactccgaagaaggtaaataactccaacgggcccggtaccccgtacggtaacgggggtccccctaggaaccccgtaactttccgtcgtacgggtcccttaacccgtaaaacggttcccttgggaccctaaacccttcgaacccgtcccccttccccgtacgaacccctacgttaccgaacgggttcgggtccgttaccccggggttacccggaaggtaccgttaggacggggacttacggtaacttaacgtttaaccgtggggtacgtaccgtaacgttacccgggaacgggggtaaccaaccgtaaaccgtaaggttccgggggaaacttaggaaaccctaaagttcccggtagggttaaccggggtttcgggggttgggggttacgtttacccgggggacggggaaccgggttaaaccctaaacggtcccgggtaaccggttaccggacgggttaccaaccgggttaaccccggtaaccggg

SEQ ID NO: 310517 - DNA, 580 bp, Homo sapiens
  misc_feature: GZ8MTXP01AWC71.21.22.B11.1.454.CMB.2.raw
  modified_base (200)..(200): a, c, t, g, unknown or other
  misc_feature (200)..(200): n is a, c, g, or t
  modified_base (456)..(456): a, c, t, g, unknown or other
  misc_feature (456)..(456): n is a, c, g, or t
  modified_base (474)..(474): a, c, t, g, unknown or other
  misc_feature (474)..(474): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagcccaccctcagcgtctcgggacccccggnagagggtcaccatctcttgttctggagcaactcaacatcggaataattatgtattctggtatcagcaactcccaggaatcggacccccaaactcctcatccagaggaaataatcagccggccctcgacgggggtcccctaggacccgtactttcctcgtcggcctacccgaaaagttcctcggccaccctccacgccctccctgacccatcgaggtcgggctccgggtccgaggatggacggctagtactattacnggtcgcatccggacggcncaacagtgggatgaacaatcgtggaggtcgggtttgggtcggttcggggacgggagggaaccctaaacgtcgtaacccgtcgtacggttccaacgccccgtaacgg

SEQ ID NO: 310518 - DNA, 624 bp, Homo sapiens
  misc_feature: GZ8MTXP01DK2BD.21.22.B11.1.454.CMB.2.raw
  modified_base (201)..(201): a, c, t, g, unknown or other
  misc_feature (201)..(201): n is a, c, g, or t
  modified_base (236)..(236): a, c, t, g, unknown or other
  misc_feature (236)..(236): n is a, c, g, or t
  modified_base (264)..(264): a, c, t, g, unknown or other
  misc_feature (264)..(264): n is a, c, g, or t
  modified_base (347)..(347): a, c, t, g, unknown or other
  misc_feature (347)..(347): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagcccaccctcagcgtcgtcgggacccccggnagacggtcaccatctcttgtctggagcaactcaanatacggaattattatgtattctaggtancagcaactacccaggaactcggacccccaaatcctacactcgagaaggaatatcacggccgccctcgacgggtcctagacctnttcctcgtcggcctaccgaaagtccgtcggacccaaccctcgacgtcccctccgtacgaccctatcgagggttcgggcccttccgggaccgtaagggacttggacgggtcttagaacctttattacgtggtacgtacgaacgtccgaacggggaccacgtaaacgaagtgggtatacggactaagtcgtggagggtcggggttttggcggttacggggacgggacggaaccctaaggtccggaaccgttcgtaagggccgtaacgccccgtaacggg

SEQ ID NO: 310519 - DNA, 557 bp, Homo sapiens
  misc_feature: GZ8MTXP01DAXXX.21.22.B11.1.454.CMB.2.raw
  modified_base (198)..(198): a, c, t, g, unknown or other
  misc_feature (198)..(198): n is a, c, g, or t
  modified_base (327)..(327): a, c, t, g, unknown or other
  misc_feature (327)..(327): n is a, c, g, or t
  modified_base (337)..(337): a, c, t, g, unknown or other
  misc_feature (337)..(337): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctgggacccccggnagagggtcaccatctcttgttctggagcaactccaacatacggaagttaaattatgtattctggtatcagcaactcccaggaatcggacccccaaactccctcatccagaggaataatcagcggccctnacgggtcccngaccgtacttctctggcctccaaagtctggcacctcacgcctccctgaccatcaggtcgggctccgggtaccgaggatcggagggctaggactaattactgggtgctatcgacgggcacgaacagtggtatgaacaatcgtgaggtcgggttgggtggttcgggacggcgggaaaccctaaagtcgtaaccgtctacgggttactaacggcccgaacggg

SEQ ID NO: 310520 - DNA, 689 bp, Homo sapiens
  misc_feature: GZ8MTXP01ANXXQ.21.22.B11.1.454.CMB.2.raw
  modified_base (203)..(203): a, c, t, g, unknown or other
  misc_feature (203)..(203): n is a, c, g, or t
  modified_base (253)..(253): a, c, t, g, unknown or other
  misc_feature (253)..(253): n is a, c, g, or t
  modified_base (267)..(267): a, c, t, g, unknown or other
  misc_feature (267)..(267): n is a, c, g, or t
  modified_base (280)..(280): a, c, t, g, unknown or other
  misc_feature (280)..(280): n is a, c, g, or t
  modified_base (467)..(467): a, c, t, g, unknown or other
  misc_feature (467)..(467): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagcccaccctcagccgtcgtcgggaccccccggnaggacgggtcaccatcctcttgtctggaggcaactcaacatcggaatatntgtatctgtatcancaactccagaacnccggacccccaaatcctcactacccaagtacgaatacgtcgagccggaccctcgacgggggttccctaggaccgtactttcgtacgtcggtaccctaccgaaacgttccgtcggaccctacccgtcaccgtccctcccgtgaacccctagtccgagggtcgggacccgttccgggtaccggaaggtntacgggacggtaccttagtaaaccttacgtttacgtcgggggtacacccgtaagtacccgggtaaccgggcgtaaccgtaacgtagggtaggtaacctcgtaaccgtaagttccgggtaagttcggggttacccgggttaggggtcgtttaccgggggacggttacggggaaccttaaacggtcggaacccgttcggtggttaccaacggcccgttaacggg

SEQ ID NO: 310521 - DNA, 723 bp, Homo sapiens
  misc_feature: GZ8MTXP01BI38V.21.22.B11.1.454.CMB.2.raw
  modified_base (201)..(201): a, c, t, g, unknown or other
  misc_feature (201)..(201): n is a, c, g, or t
  modified_base (268)..(268): a, c, t, g, unknown or other
  misc_feature (268)..(268): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagcccaccctcagcgtcgtcgggacccccggnaggagggtcaccatctcttgttctggagcaactccaacatacggaagttaattatgtattctggtancagcaactccgaaggaactccggacccccaaactccctcaactccaaggaaggaaataactcacggccggccctcgacggggtccctgaccgtacttcctacgtcggtcctacccgaaaacgttccgtcgggaccctaaacccgttcgaacccggtccccttaccccgtacgaacccctattccgtaacgggttcggggcccttacccgggggtcccggtaaagggtcttagggacgggtcttacggtaacttaacgtttaccgtggggtcgtacgaaccgttcggaaaccgggggacctacgaaaccgtaggttcggggattacggaaacctaacgtcgttagggacgggttccggggtttaggggttcggttacgggggacggggttaacgggaaaccctaaacggtcggtaacccggttcgtacgggttaccaaccggttcccgaaccgggg

SEQ ID NO: 310522 - DNA, 898 bp, Homo sapiens
  misc_feature: GZ8MTXP01AC10C.21.22.B11.1.454.CMB.2.raw
  modified_base (199)..(199): a, c, t, g, unknown or other
  misc_feature (199)..(199): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctcgggacccccggnagagggtcaccatctcttgttctggagcaactccaacatcggaagtattatgtattctgtatcagcaactccaggatcgccccaactcctcatccagagaataatcagccgcctcgacggggtccctaggaccgtacttcctcgtcggtccctaccgtaaaacgttcccgttcgggccctaaaccccgttccgaacccggtccccctttaccccccgtacggtaaaccccctaacgttcccggtaaaggggttcccggggggtccccgtttcccccgggggttacccgggaaagggggtaacgtttcggggaaaccgggggttacccctttaggggttaaaaccctttaacgtttttaaaccccggttcggggggtttaacggaccccgttaaacggtttacccccgggaaaccggggggggtaaaccccacccggtaaaaccggttacggggttaacggggggtaaactttaacggaaaaccccgttaaagtttcccggggttaaagggtttaaccggggggtttcccggggggtttttaggggggttacccgggttttcccggggggaacccgggggttaaacgggggttaaaaccccccgttaaaaacgggggttcccggttaaaaccccccggggttcccggttaaaacgggggttcccccgtaaaccggggttaacccccccgtaaaccggggg

SEQ ID NO: 310523 - DNA, 565 bp, Homo sapiens
  misc_feature: GZ8MTXP01BAOZI.21.22.B11.1.454.CMB.2.raw
  modified_base (418)..(418): a, c, t, g, unknown or other
  misc_feature (418)..(418): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctgggaccccccggcagagggtcaccatctcttgttctggagcaactccaacatcggaagttaattatgtattctggtatcagcaactcccaggaatcggacccccaaatccctcactccagaggaaataatcagccgccctcgacgggtccctgaccgtacttctctggcctccaaagtctggccacctcacgccctccctgacccatcgaggtcgggcctccgggtcgaggntggaggctagacttattacgtggtagcagtccgacgggcgacaacgagtgggatgaacaatcgtaggaggtcgggttgggtcggttcgggcgggttacggaacccgaagttcggaacccgttcagggttccaacgccccgtaacggg

SEQ ID NO: 310524 - DNA, 572 bp, Homo sapiens
  misc_feature: GZ8MTXP01BYHJU.21.22.B11.1.454.CMB.2.raw
  modified_base (263)..(263): a, c, t, g, unknown or other
  misc_feature (263)..(263): n is a, c, g, or t
  modified_base (440)..(440): a, c, t, g, unknown or other
  misc_feature (440)..(440): n is a, c, g, or t
  modified_base (459)..(459): a, c, t, g, unknown or other
  misc_feature (459)..(459): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctcgggacccccggcagagggtcaccatctcttgttctggagcaactccaacatcggaagtaattatgtattctggtancagcaactcccaggaactcggacccccaaactcctacactccaagaggaataatcagccggccctcgacgggggtccctgaccgtacttctctggcctccaaagttctggccaccctcacgccctcctgaccatcaggtcgggcctccgggtcgaggatggaggctgactattacgngggtgctatcgacgggacncaacgagtcgggatgaacaagtcgtggaggtcgggtttgggtcggttcggggacggggacgggaaccctaaagtcggaaccccgttcgtagggttccaacggccccgaacggg

SEQ ID NO: 310525 - DNA, 551 bp, Homo sapiens
  misc_feature: GZ8MTXP01EUB8S.21.22.B11.1.454.CMB.2.raw
  modified_base (199)..(199): a, c, t, g, unknown or other
  misc_feature (199)..(199): n is a, c, g, or t
  modified_base (237)..(237): a, c, t, g, unknown or other
  misc_feature (237)..(237): n is a, c, g, or t
  modified_base (426)..(426): a, c, t, g, unknown or other
  misc_feature (426)..(426): n is a, c, g, or t
  modified_base (460)..(460): a, c, t, g, unknown or other
  misc_feature (460)..(460): n is a, c, g, or t
  modified_base (464)..(464): a, c, t, g, unknown or other
  misc_feature (464)..(464): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctgggaccccccggnagagggtcaccatctcttgttctggaggcaactccaanatcggaataattatgtattctggtatcagcaactcccaggaatcggacccccaaactcctcatccagaggaaataactcgagccggccctcgacgggggtcccctagaccgtattcctctggcctcccaaaagttctcggccacctcacgtccctccctgacccatcaggtcgggcctccggtcgaggntgagctgacttatactggtgcatcgacggggacncaanagtgggatagacaatcgtggaggtcgggttgggtgtcgggacggagggaccaaagtgaacccgtcgtacggttcaacgcccgaacgg

SEQ ID NO: 310526 - DNA, 737 bp, Homo sapiens
  misc_feature: GZ8MTXP01EM3Y2.21.22.B11.1.454.CMB.2.raw
  modified_base (203)..(203): a, c, t, g, unknown or other
  misc_feature (203)..(203): n is a, c, g, or t
  modified_base (283)..(283): a, c, t, g, unknown or other
  misc_feature (283)..(283): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagcccaccctcagccgtcgtgggaccccccgggnaggacggtcacctattcttcttgttcgtggacgacaacctaccaactagtacggtaaattaattatagtattcgtagtancacgacaactaccgagaactccgacccctaactcctacactacgaagaagaaatacgtacgacggccggtcccgtacggtaccgggtccctacgaccgtacttccgtcgtcgtcctaccgtaaacgttccgtcggccctacccgtccaccgtccccttccgtacgaccctacgtcgacgggttcgggtcccgttcccgggacggtaaggtacgtgggacgtcgtacgtaacttagttacgtgggtacgacgtacgtaccggaaccggggaacaaccgaacgtaagggtacgggtaactacgtaactaaggttaacggtacggggttacggggttcggggtttcggggtacggggtacgggggaccgggttaaaccggggttaaaccgtaacgggtaccggtaaccccggttaccgggtacggttaccgtaacccggttaaccccgggtaacggg

SEQ ID NO: 310527 - DNA, 585 bp, Homo sapiens
  misc_feature: GZ8MTXP01DC529.21.22.B11.1.454.CMB.2.raw
  modified_base (354)..(354): a, c, t, g, unknown or other
  misc_feature (354)..(354): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctgggacccccggcagagggtcaccatctcttgttctggaggcaactccaacatcggaagtaattatgtattctggtatcagcaactcccaggaactcggacccccaaaactcctcactccaagaaggaaataaatcagccggcctcgacgggtccctgaccgtattctntggctccgaaagtctggcaccgtcagcccctcctgacccatccaggtcgggcctccggtccgaaggtagtgacggctgaacttattacgtggtgctaatccgacgggacgcaaacgtagtgggataggaacaatcgtgagggtcgggttggggtggttcgggcgggaacggggaaccctaaaacgttggaaccccgttccggtagggttacgtaacgaaccccgtaacggg

SEQ ID NO: 310528 - DNA, 544 bp, Homo sapiens
  misc_feature: GZ8MTXP01ALL9W.21.22.B11.1.454.CMB.2.raw
  modified_base (199)..(199): a, c, t, g, unknown or other
  misc_feature (199)..(199): n is a, c, g, or t
  modified_base (419)..(419): a, c, t, g, unknown or other
  misc_feature (419)..(419): n is a, c, g, or t
  modified_base (435)..(435): a, c, t, g, unknown or other
  misc_feature (435)..(435): n is a, c, g, or t
  modified_base (452)..(452): a, c, t, g, unknown or other
  misc_feature (452)..(452): n is a, c, g, or t
  modified_base (470)..(470): a, c, t, g, unknown or other
  misc_feature (470)..(470): n is a, c, g, or t
  modified_base (473)..(473): a, c, t, g, unknown or other
  misc_feature (473)..(473): n is a, c, g, or t
  modified_base (489)..(489): a, c, t, g, unknown or other
  misc_feature (489)..(489): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctcgggacccccggnagagggtcaccatctcttgttctggaggcaactccaacatcggaataattatgtattctggtatcagcaactccaggaatcggacccccaactcctcactccagagaataatcagccggcctcgacgggggtccctgaccgtacttctcgtggcctccgaaacgtctggccacctcacgcccctcccgtgacccatcgaggtcgggcctccggtcgaggntgagctgactattacnggtgcatcgaacgggcncaacagtggatacgaacntcnggagtcgggttagggngttcgggcgggttacggacctaagtcgcccgtcgtaggttctaacgcccgaacgg

SEQ ID NO: 310529 - DNA, 575 bp, Homo sapiens
  misc_feature: GZ8MTXP01EHNH3.21.22.B11.1.454.CMB.2.raw
  modified_base (542)..(542): a, c, t, g, unknown or other
  misc_feature (542)..(542): n is a, c, g, or t
tcagtcgtcgctcgcacgaccggtgctcgatttagacgacagctcagggtggggtcaaaaacccggggagggggtctgatttgcatggatggactctccccctctcagagtacgaagagagggagagatcgtgggggaagctcagcttcagctgtggtagagaagacaggactcaggacaatctccagcatggccggcttccctctcctcctccaccctcctcactcactgcgcgacgggtcctgggcccagtctgtgctgactcacgcccaccctcacgcgtcgtcggggacccccgggcaggacgggtcaccatctcttgtctggagcaactccaacatacggaaataattatcgttattctggtatcaaagcaactcccaagggaactcggacccccaaactcctacactccagagaaataatcaacggccgcctacgacggggtcccctagaccgtattccgtctcggcctaccgaagtctacggctaccctcacgtccctccctgaaccctattcgacgttcgggccttccggccgnggactggacgtctgaacttacttaacgttgtcg

SEQ ID NO: 310530 - DNA, 738 bp, Homo sapiens
  misc_feature: GZ8MTXP01EFWCT.21.22.B11.1.454.CMB.2.raw
  modified_base (198)..(198): a, c, t, g, unknown or other
  misc_feature (198)..(198): n is a, c, g, or t
  modified_base (233)..(233): a, c, t, g, unknown or other
  misc_feature (233)..(233): n is a, c, g, or t
  modified_base (244)..(244): a, c, t, g, unknown or other
  misc_feature (244)..(244): n is a, c, g, or t
  modified_base (256)..(256): a, c, t, g, unknown or other
  misc_feature (256)..(256): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctgggacccccggnagagggtcaccatctcttgtctggagcaactcaantacgaattatntgtattctgtancagacaactcccgagactccggacccctaactcctacactaccgaagaacgtaaataactcgacggcccggtccccgtacggaccgggttccctacgaccgtacttcctcgcggtcctaccgtaaaacgtcgtcgggaccctaacccgtccgtaccgtcccccttcccgttacgaacccctacgtaccgtacgggttcccgggtccgttacccccgggtagggtaacgggtacgttacgggaaccggtcgttaacggtaacctttaaacgtttccgtgggggttacaccgtaacggttacccgggaaccgggggaaccctaacccaaaggtacgggttagggtaacttacggaaaccttaagtccggttaagggttacggggttccgggtttgggtacgggttaccggggaacgggttacgggaaaaccctaacgtaccggtaaccgttacggtacgttaccaaccggaacccgtaaccggg

SEQ ID NO: 310531 - DNA, 641 bp, Homo sapiens
  misc_feature: GZ8MTXP01APFRO.21.22.B11.1.454.CMB.2.raw
  modified_base (202)..(202): a, c, t, g, unknown or other
  misc_feature (202)..(202): n is a, c, g, or t
  modified_base (414)..(414): a, c, t, g, unknown or other
  misc_feature (414)..(414): n is a, c, g, or t
  modified_base (443)..(443): a, c, t, g, unknown or other
  misc_feature (443)..(443): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagcccaccctcagcgtcgtcgggacccccgggnagagggtcaccatctcttgttctggagcaactccaacatacggaattaattatgtattctggtatcagcaactcccaggaactccggacccccaaactcctacactccaagaaggaaactaatcgacggccggccctcgaccgggggtccctaggaccgtacttctcgtggcctcgaaacgtctcggccaccctcaccgtccctcctgaccntcgaggtcgggtcctccgggtcgagggtntcggacggcttacggtaacttatttacgtgggtcgtacgtactccggaacgggggccactaacgaaggttgggaactaggaacctaagtccgtaggttacgggttcggggttcgggtacgggttacgggacggggttacgggaacctaaaccggtggtaaccccggtcgtacgggttccaacggttcccgtaaccggg

SEQ ID NO: 310532 - DNA, 695 bp, Homo sapiens
  misc_feature: GZ8MTXP01DYJ1D.21.22.B11.1.454.CMB.2.raw
  modified_base (203)..(203): a, c, t, g, unknown or other
  misc_feature (203)..(203): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagcccaccctcagcgtcgtcgggaccccccgggnagagggtcaccatctcttgttctggagcaactccaacatacggaagtaattatgtattctggtatcagcaactcccagaactcggacccccaatcctcatccagagaatatcagcgcctgacggggtccctgacccgtacttcctcgtcggtaccctaccgtaaacgttccgtcgggaccctaccccgttacgacccgtcccccttacccgtacgtaaccctacgtcgtacgggtccgggtcccgttcccgggtaaccggaagggtacttacgggacggtcttacggaactttaacgttaccgtgggtacgacgtaacgtaccgggaaccgggacgaaccaaagtcggtagggtactacgtaaacaagtttcgagggttacggggttccggggtttagggttacgggttaccggggacggggaaacgggaaaccctaaacggtccggtaacccgttacggtacggttaccgaaccgttaacccggtaaccgg

SEQ ID NO: 310533 - DNA, 606 bp, Homo sapiens
  misc_feature: GZ8MTXP01C8OOT.21.22.B11.1.454.CMB.2.raw
  modified_base (301)..(301): a, c, t, g, unknown or other
  misc_feature (301)..(301): n is a, c, g, or t
tcagtcgtcgctcgcacgaccggtgctcgatttagacgacagctcaggggagcttcagctgtggtagagaagacaggactcaggacaatctccagcatggccggcttccctctcctcctcacccctcctcactcactgcgcagggtcctgggcccaggtctgtgctgactcagccaccctcagcgtctgggacccccgggcagagggtcaccatctcttgtctggagcaactccaacatacggaagtaaattatgtattctaggtatcagcaactcccaggaactcggcccccaaatcctnactccagaaggaatatcagccgcctgacggggtccctgacccgtattctacgtggcctaccaaacgtctggcctaaccttcacgcccctccgtgaccctatcgacggttcgggcttcccgggtaccgagggactggacgggctacgaacttattactggggttcgctaacgtccgaaacggggcaccaaacgtagtgggatcgaaacgtatcgtgagggtcggggtttgggtacggttccgggagggacgggaaacccaaacgttgggaaccccgttgacgggttacaaccggcccgtaaccggg

SEQ ID NO: 310534 - DNA, 634 bp, Homo sapiens
  misc_feature: GZ8MTXP01EPQN6.21.22.B11.1.454.CMB.2.raw
  modified_base (201)..(201): a, c, t, g, unknown or other
  misc_feature (201)..(201): n is a, c, g, or t
  modified_base (216)..(216): a, c, t, g, unknown or other
  misc_feature (216)..(216): n is a, c, g, or t
  modified_base (257)..(257): a, c, t, g, unknown or other
  misc_feature (257)..(257): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcacgcccaccctcagcgtcgtcgggaccccggnaggaggtcacatctnttgtctggagcactcaacatacgaatatatgtattctgtancagcaactccaggaactccggaccccaactcctacactaccgaagaagtaaatactcgacggccggccctacggaccggggtccctacgaccgtacttcctcgtcggccctaccgaaacgttcgtcggaccctacccgtcctaccgtccccttacccgtacgaccctagtacgtacgggtcgggtcccgtcccggtacggaacggtattcgggacggtctacgtaacttaagttccgtgggtacgactagaccggaacgggacacgaataggtggtactgaacctgtcggtaggcgggttcgggttggggtcggtcgggacgggacggttaaccctaaggcgtaaccggtcgtacggaccaaccggccgtaacccgg

SEQ ID NO: 310535 - DNA, 548 bp, Homo sapiens
  misc_feature: GZ8MTXP01BYTEF.21.22.B11.1.454.CMB.2.raw
  modified_base (198)..(198): a, c, t, g, unknown or other
  misc_feature (198)..(198): n is a, c, g, or t
  modified_base (420)..(420): a, c, t, g, unknown or other
  misc_feature (420)..(420): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctgggacccccggnagagggtcaccatctcttgtctggagcaactccaacatcggaagtaattatgtattctggtatcagcaactcccaggaatcggacccccaaactcctcatccagagaataatcagcggcctgacgggtccctgaccgtattctctggcctcaaagtctggcacctcacgcctcctgaccatcaggtcggctccggtcgaggatgagctgactattacgtggngctatcgacgggacgcaaacgagtggggatcggacaagtctggaggtcgggtttggggtcgtttcggggcgggttacgggaacccaaagtcggaacccgtcgtacgggttcaacggccccgtaacggg

SEQ ID NO: 310536 - DNA, 638 bp, Homo sapiens
  misc_feature: GZ8MTXP01ASMZK.21.22.B11.1.454.CMB.2.raw
  modified_base (200)..(200): a, c, t, g, unknown or other
  misc_feature (200)..(200): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtcgtcgggacccccggnaggagggtcaccatctcttgtctggagcaactccaacatcggaattaattatgtattctgtatcagcaactccaggaactcggacccccaaactcctcactccaagaaggaaactaactcacggccggccctacgtacgggggtccctgacccgtacttcctcgtggtccctaccaaacgttcctcggccaccctcacgcccctcctcgacctatcgaggtcgggctccggacgaggactgacggctagtaacttattacgtgtcggactacgtcgacgggacacaacgagttcggggaatacgaactaattcgtagggacgggttcggggtttcggggtacggtttcgggggaccgggttaacggggaaacccctaaaacgggttcggaacccggtttaccgtacggggaccctaacggaacccccggtaaaccggg

SEQ ID NO: 310537 - DNA, 560 bp, Homo sapiens
  misc_feature: GZ8MTXP01AVPI5.21.22.B11.1.454.CMB.2.raw
  modified_base (198)..(198): a, c, t, g, unknown or other
  misc_feature (198)..(198): n is a, c, g, or t
  modified_base (434)..(434): a, c, t, g, unknown or other
  misc_feature (434)..(434): n is a, c, g, or t
  modified_base (454)..(454): a, c, t, g, unknown or other
  misc_feature (454)..(454): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctgggacccccggnagagggtcaccatctcttgttctggagcaactccaacatcggaagtaattatgtattctggtatcagcaactcccaggaatcggacccccaaatcctcatccagagaatatcagcgcctcgacgggtccctgaccgtattctctggcctccgaaagttcctggccacccgtcacgtcccctccctgacccatcaggtcgggccttccggcgaggactgaggcttgacttattacgnggtcgcatccgacggggacncgaaacgtgtcgggaatcggaactaatcgtggacggtcgggtttagggtcgttcgggacgggagggaccctaaagtggaacccggtctaggccaacgcccgaaggg

SEQ ID NO: 310538 - DNA, 698 bp, Homo sapiens
  misc_feature: GZ8MTXP01BA9GW.21.22.B11.1.454.CMB.2.raw
  modified_base (201)..(201): a, c, t, g, unknown or other
  misc_feature (201)..(201): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagcccaccctcagcgtcgtcgggacccccggnaggagggtcaccatctcttgtctggagcaactcaacatcggaagtaattatgtattctggtatcagcaactcccaaggaactccggacccccaaactcctacactccagaagaaataatcacggccggccctacgtacgggggtccctgaccgtacttcctcgtcggcctaccgaaagttcctggccacccttcacgtcccctcccgtagaccctagtccaggtcgggccgtcccgggtacgagggtactcgggacggcctagtaaccgttaatttacgtagggtcgtaccgtaactcccgggaacgggaaccgacgaaacggtacggtaggggaacttacggaaaccgtaaagtccggtacgggaaggggttccggggtttgggggttacgggttccggggaaccgggggttacgggttaaacccgttaaaacggtccggtaaccccgggttacccggttaacgggccccgtaaaccggttccccggtaaaccggg

SEQ ID NO: 310539 - DNA, 637 bp, Homo sapiens
  misc_feature: GZ8MTXP01BGUG6.21.22.B11.1.454.CMB.2.raw
  modified_base (201)..(201): a, c, t, g, unknown or other
  misc_feature (201)..(201): n is a, c, g, or t
  modified_base (344)..(344): a, c, t, g, unknown or other
  misc_feature (344)..(344): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagcccaccctcagcgtcgtcgggacccccggnaggagggtcaccatctcttgttctggagcaactcaacatacggaatattatgtattctggtatcagcaactcccaggaatcggacccccaaatcctcactccaagagaatatcagccgccctgacgggtcctgaccgacttcncgtggcctaccgaaagtcgtggccacctcacgccctcctagacccatcgaggtcgggccttccgggtaccgaagggtctagggacggtcttacggaccttagttaccgtgggtacgactacgtcggaaccggggaccacgaaaccgtaaggttcggggaacttcggaaacctagtccggtgggaacgggtcggggtttgggtacgggttcggggaccggggttaagggaaacccctaaagggttcggaaccccggttacgtacggggttacctaacccgggcccgtaacgggg

SEQ ID NO: 310540 - DNA, 579 bp, Homo sapiens
  misc_feature: GZ8MTXP01BEZ7I.21.22.B11.1.454.CMB.2.raw
  modified_base (199)..(199): a, c, t, g, unknown or other
  misc_feature (199)..(199): n is a, c, g, or t
  modified_base (449)..(449): a, c, t, g, unknown or other
  misc_feature (449)..(449): n is a, c, g, or t
  modified_base (454)..(454): a, c, t, g, unknown or other
  misc_feature (454)..(454): n is a, c, g, or t
  modified_base (467)..(467): a, c, t, g, unknown or other
  misc_feature (467)..(467): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctgggaccccccggnagagggtcaccatctcttgttctggaggcaactccaacatcggaagtaattatgtattctggtatcagcaactcccaggaactcggacccccaaactccctcactccaagaggaaataatcagccggcccctcgacgggggtcccctgaccgtacttcctctggcctcccaaagttcctggccaccctcacgccctccctgacccatcgaggtcgggctccgggtccgaggatgaggctgacttattacngggtncatcgaacgggcncgaacgagtgggatgaacaagtctggaggtcgggttgggtcggttacgggcgggacgggaaccctaaagtcggaacccgttccgtagggttccaaccggttcccgtaacggg

SEQ ID NO: 310541 - DNA, 757 bp, Homo sapiens
  misc_feature: GZ8MTXP01AZZAV.21.22.B11.1.454.CMB.2.raw
  modified_base (203)..(203): a, c, t, g, unknown or other
  misc_feature (203)..(203): n is a, c, g, or t
  modified_base (245)..(245): a, c, t, g, unknown or other
  misc_feature (245)..(245): n is a, c, g, or t
  modified_base (276)..(276): a, c, t, g, unknown or other
  misc_feature (276)..(276): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagcccaccctcagccgtcgtcgggaccccccggnaggacgggtcacctattctcttgttctggacgcaactccaanagtacggaattaattatgtattcgtaggtancagacaacctccgaaggtaactccggacccccaaatccctacactaccaaggagtaaactaactcgacggcccggtccccgtcggaaccgggggttcccctacggaaccgttacctttccgtcgtcgggtaccctacccgtaaacgttcctcgggaccctaacccgtccaccggtccctcccgtagaccctagtcgacggtcgggtcccgttccgggcgaaaggcgttacgggaacggtcttaggtaacttacgtttacgtcggtacgacgttaacgaccggaaccgggacctaacgaaccgtaaggttacggggtaactacgtaaaccgtaaaggtccggtaagggttacgggggttccgggtttgggggtaccgggttaacggggaccgggggttaaccgttaaacccggaaacggttcccgggtaaacccgtttcccgggaacggttaccccgaaccgggaaccccggttaacccggg

SEQ ID NO: 310542 - DNA, 870 bp, Homo sapiens
  misc_feature: GZ8MTXP01EF8U0.21.22.B11.1.454.CMB.2.raw
  modified_base (206)..(206): a, c, t, g, unknown or other
  misc_feature (206)..(206): n is a, c, g, or t
tcagtcgtcgctcgcacgaccggtgctcgatttagacgacagctcaggggagcttcagctgtggtagagaagacaggactcaggacaatctccagcatggccggcttccctctcctcctccaccctcctcactcactgcgcagggtcctcgggcccagtctgtgctgactcacgcccaccctcagcgtccgtcgggaccccccggnaggacgggtccaccattcttcttgttcgtggacgacaactaccaacagtacggaaagttaattatagttattcgtggtatcagacaacctccccgaaggtaaacgtcccggaacccccccaaaacttcccctaccaacttaccccgaagaaggtaaaattaacgtaccgacggtcccggcccctacggtaacccgggggttcccctacggaccccgtactttccgttacgtcgggtaccctacccgtaaaacgttccgtcgggaccctacccgtccgaccgtccccctaccccgtacgtaaccctactcgtacgggtccgggtcccgttaccccgggtaccgggtaacggtagttacgggacggtaccgttacgtaacgtttaacgtttaccgttaggggtacgtaccgtaaccgttacccgggaaacccggggtaaccgaacccgtaaaccggtaaagggttacgggtaaacgttaaccgggaaaccttaaacgttcgggttacgggttaacggggtttcggggggttttaacggggttccggggttaacccgggggttaccgggggttaaacggggttaaaaccccgtaaaccgggttacgggtaaccccgtttacccgggaacgggttacccgaaacccggttaaccccggtaaccccggg

SEQ ID NO: 310543 - DNA, 560 bp, Homo sapiens
  misc_feature: GZ8MTXP01BVKD6.21.22.B11.1.454.CMB.2.raw
  modified_base (469)..(469): a, c, t, g, unknown or other
  misc_feature (469)..(469): n is a, c, g, or t
  modified_base (490)..(490): a, c, t, g, unknown or other
  misc_feature (490)..(490): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctgggacccccgggcagagggtcaccatctcttgttctggaggcaactccaaacatcggaagttaattatgtattctggtatcagcaactcccaggaaatcggaccccccaaaactccctcactccaagaacggaaataaatcaagccggccctacgacgggggtccctgaccgattcctctggcctccaaagtctggcaccctcacgtccctccctgacccatcaggtgggcctccggtacgaggatgaggctgaactattactggtgctaatcgaacgggacncaaacagtgggatgactaatntgaggtcgggttgggtggtcggacgggagggacccaaagtgaacccgtccgaggttacaacgcccgaagg

SEQ ID NO: 310544 - DNA, 777 bp, Homo sapiens
  misc_feature: GZ8MTXP01EI76H.21.22.B11.1.454.CMB.2.raw
  modified_base (201)..(201): a, c, t, g, unknown or other
  misc_feature (201)..(201): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtcgtcggggacccccggnaggagggtcaccatctcttgttctggagcaactccaacatacggaaagttaattatgttattctaggtatcacgacaacctacccgaaggaacgtaccggaccccctaaaactccctacaactaccaagaaggtaaataatccgaacgccggtccctacgtaacgggggttcccctaggtaacccgtactttccgtcgtcgggtaccctacccgtaaaaagttcccgttcgggacccctaaacccgttccgaacccgttcccccttacccccgttagaaacccctacgttaccgtaacgggttcggggcccgttaccccggggtacccggtaagggacgtttcgggaacgggtcgttaacggtaacctttaaagtttacccgttgggggttacgaccgtaacgttacccgggaaaccgggggtaacctaacccgaaagtaacggttaggggaaccttaggaaacctaaagttccgtaggttacgggttccggggtttgggtcgggttacggggacgggaccggaaacctaaggttcgaacccggttcgtacggttacaaccggttaacccgaacgg

SEQ ID NO: 310545 - DNA, 535 bp, Homo sapiens
  misc_feature: GZ8MTXP01A4K7H.21.22.B11.1.454.CMB.2.raw
  modified_base (200)..(200): a, c, t, g, unknown or other
  misc_feature (200)..(200): n is a, c, g, or t
  modified_base (320)..(320): a, c, t, g, unknown or other
  misc_feature (320)..(320): n is a, c, g, or t
  modified_base (331)..(331): a, c, t, g, unknown or other
  misc_feature (331)..(331): n is a, c, g, or t
  modified_base (453)..(453): a, c, t, g, unknown or other
  misc_feature (453)..(453): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctcgggacccccgggnagagggtcaccatctcttgttctggaggcaactccaacatcggaagtaattatgtattctggtatcagcaactcccaggatcggaccccaatcctcactccagagaataatcagcgcctnacggggtcccngaccgacttctctcggctaccaaagtcctggacctaccctcacgccctcctcgaccatcaggtcggcctccggtccgagatgaggctgacttatactggtgcatcgacgggcacgaactagnggtatagacgaatcgtgaggtcggttgggtgtcgggcggttaggaccaacgtgtaaccgtcgaggttacaacggcaaccggg

SEQ ID NO: 310546 - DNA, 602 bp, Homo sapiens
  misc_feature: GZ8MTXP01CFQ4Z.21.22.B11.1.454.CMB.2.raw
  modified_base (197)..(197): a, c, t, g, unknown or other
  misc_feature (197)..(197): n is a, c, g, or t
  modified_base (492)..(492): a, c, t, g, unknown or other
  misc_feature (492)..(492): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccacctcagcgtctgggacccccggnagagggtcaccatctcttgttctggaggcaaactccaaacatcggaaagtaattatgttattctggtatcagcaactcccaggaaactcggacccccaaactcctcactccaagaaggaaataatcagccgcctcgacggggtccctgaccgtacttctcgtggcctaccaaagttctggcctacctcacgtccctccctgaaccatcgaggttcgggacctcccgggtcgaaggtatggacggtcctagtaaccttagtttaccgtgggttcgactaacgtccgaacggggacncgaaagtagtgggatcgaactaagtcgtggacgggtcgggttgggtacggttcgggacgggacgggaaccaacgtcggccgttaccgtaagggccaacgccccgtaaggg

SEQ ID NO: 310547 - DNA, 537 bp, Homo sapiens
  misc_feature: GZ8MTXP01D40S4.21.22.B11.1.454.CMB.2.raw
  modified_base (179)..(179): a, c, t, g, unknown or other
  misc_feature (179)..(179): n is a, c, g, or t
  modified_base (199)..(199): a, c, t, g, unknown or other
  misc_feature (199)..(199): n is a, c, g, or t
  modified_base (330)..(330): a, c, t, g, unknown or other
  misc_feature (330)..(330): n is a, c, g, or t
  modified_base (402)..(402): a, c, t, g, unknown or other
  misc_feature (402)..(402): n is a, c, g, or t
  modified_base (422)..(422): a, c, t, g, unknown or other
  misc_feature (422)..(422): n is a, c, g, or t
  modified_base (434)..(434): a, c, t, g, unknown or other
  misc_feature (434)..(434): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctnagcgtctgggaccccccggnagagggtcaccatctcttgttctggagcaactccaacatcggaattaattatgtattctggtatcagcaactcccaggaatcggcccccaaactcctacatccagagaatatcagcgcctgacgggtcccngaccgtattctctggcctcaaagtctggcacctcacgtccctcctgaccatcaggtcggctccggtcgaggntgagctgactattactggtnctatcgacggcncaacgagtgggatgaccaatcgtgaggtcgggttggtggttcggacgggttacggaccctaaacggtgaacccgtcgtacggttactaacgcccgtaaacggg

SEQ ID NO: 310548 - DNA, 724 bp, Homo sapiens
  misc_feature: GZ8MTXP01C1EXF.21.22.B11.1.454.CMB.2.raw
  modified_base (198)..(198): a, c, t, g, unknown or other
  misc_feature (198)..(198): n is a, c, g, or t
  modified_base (255)..(256): a, c, t, g, unknown or other
  misc_feature (255)..(256): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctgggacccccggnagagggtcaccatctcttgtctggagcaactcaacatcggaatatatgtatctgtannagcaactccagatcggacccctaatcctcatccaagagaataatcagccggccctacgacggggtccctgaccgtacttcctctcggctacccgaaaagttccgtcggacctaaccctcaacgtcccctcccctgaaccctaatcgtacggtcggggtacctcccgggtaccggaaggtagttcgggaacgggcccttaaggtaactttaacgttaacggtttcggttacgggtaacccaacgttacccgggaaaccgggggtaaccgtaaccaaaacccgtaaggttcgggggaaattccgggaaaacgttaaaggttccgttaagggggaacgggtttccggggtttggggggttcggtttacccggggggttaacgggttaacgggggaaaaccccctaaaaaggtcccgggttaacccggttaccgtttacggggaccgtaaccggttaaccccggtaaccggg

SEQ ID NO: 310549 - DNA, 600 bp, Homo sapiens
  misc_feature: GZ8MTXP01ACBNA.21.22.B11.1.454.CMB.2.raw
  modified_base (436)..(436): a, c, t, g, unknown or other
  misc_feature (436)..(436): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctgggacccccggcagagggtcaccatctcttgttctggagcaactccaacatcggaagtattatgtattctggtatcagcaactcccaggaactcggacccccaaactcctacatccagaggaataatccagccggccctcgacggggtcccctgaccgtattctctggcctcaaagtctggcaccgtcacgccctcctgacccatccaggtcggctccgggtcaggatgacggctagtactatttaccgnggtcgactacgtaccggaccgggacgacgaaacgtagtcgggtaatacgaactaacgtcggtagggttacgggtcggggttggggtacgggttaccggggacgggttacggaacccgtaaacgtcggtaacccgttcgtaggttccgaaccggaacccgtaagg

SEQ ID NO: 310550 - DNA, 572 bp, Homo sapiens
  misc_feature: GZ8MTXP01B8KG8.21.22.B11.1.454.CMB.2.raw
  modified_base (200)..(200): a, c, t, g, unknown or other
  misc_feature (200)..(200): n is a, c, g, or t
  modified_base (263)..(263): a, c, t, g, unknown or other
  misc_feature (263)..(263): n is a, c, g, or t
  modified_base (311)..(311): a, c, t, g, unknown or other
  misc_feature (311)..(311): n is a, c, g, or t
  modified_base (330)..(330): a, c, t, g, unknown or other
  misc_feature (330)..(330): n is a, c, g, or t
  modified_base (340)..(340): a, c, t, g, unknown or other
  misc_feature (340)..(340): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctcgggaccccccggnagagggtcaccatctcttgttctggagcaactccaacatcggaataattatgtattctggtancagcaactcccaggaactcggacccccaaatcctcatccagagaatancagcgcctgacgggtcccngaccgattcngtggcctcgaaagttctggcacctcacgccctccctgacccatcaggtcgggctccggtacgaaggctggacggtctaggtaacttagtttaccgtggggtacgacctaatcccggaaacgggggccacaaacgtagtggggaatacggaacctaaagttccgaggacggtcgggttgggtcgttcgggacgggttaggacccaagcgtgacccgtcttaggtccaagcccg

SEQ ID NO: 310551 - DNA, 708 bp, Homo sapiens
  misc_feature: GZ8MTXP01EKIUR.21.22.B11.1.454.CMB.2.raw
  modified_base (201)..(201): a, c, t, g, unknown or other
  misc_feature (201)..(201): n is a, c, g, or t
  modified_base (238)..(238): a, c, t, g, unknown or other
  misc_feature (238)..(238): n is a, c, g, or t
  modified_base (267)..(267): a, c, t, g, unknown or other
  misc_feature (267)..(267): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagcccaccctcagcgtcgtcgggacccccggnagagggtcaccatctcttgttctggagcaactccaanatacggaagttaattatgtattctggtancagcaactccaggaactccggacccccaaactccctcactaccagaaggaaataatcacgccggcccctacggacgggggtcccctaggaccgtactttcctcgtcggacctacccgaaagttctcggacctacccgttcacgtccccttacccgtacggaacccctagtaccgtaacgggttcggggacccgttaccccgggggttacccggaaggggtacttacggggacggggtaccttacgggtaaactttaacgtttaaccggttgggggttacctaccggttaacgtcccggaaaccgggggaccctaccgaaaccgtaggttacgggggaatacggaaacctaagttccgtaggacgggtcgggggtttgggtcgggttcgggacgggttacgggaccaacgtcgaaccgttcgaggttcaaccgcccgaacgg

SEQ ID NO: 310552 - DNA, 672 bp, Homo sapiens
  misc_feature: GZ8MTXP01DMXDB.21.22.B11.1.454.CMB.2.raw
  modified_base (200)..(200): a, c, t, g, unknown or other
  misc_feature (200)..(200): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtccgtgggacccccggnagagggtcaccatctcttgttctggagcaactccaacatcggaattaattatgtattctggtatcagcaactcccaggactcggacccccaaactcctcatccagagaataatcagcgcctgacgggtccctgaccgtacttctcgtcggcctaccgaaagtctcggcctaccctcacgcccctccctgacccatcgaggtcgggtcctcccgggttaccgaaggacttggacgggtcctaggaaccttattaccgtgggtcgaccgtaagtccggaacggggaccgacgaaaccgtaggttagggggaaacttacggaacctaaaggttcccgtagggaaggggttccgggggttttgggggtcgggtttaccggggacggggaccggggttaaaccccgtaaaacggtccggtaaaccccggttcccggtaaagggttcccgaaccgggttaacccccgtaaacccgggg

SEQ ID NO: 310553 - DNA, 825 bp, Homo sapiens
  misc_feature: GZ8MTXP01AELKE.21.22.B11.1.454.CMB.2.raw
  modified_base (200)..(200): a, c, t, g, unknown or other
  misc_feature (200)..(200): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtcgtcgggacccccggnagagggtcaccatctcttgttctggagcaactccaacatacggaaagttaattatgttattctggtatcagcaactcccaaggaactccggacccccaaactccctacactccgaaggaaggtaaataaacgtcgaacggcccggtacccctcggtaaccggggggttcccctacggtaaccccggtactttccgtccgttacggggacccttaccccgtaaaaaacggttcccgttcggggacccctaaaccccgttccgaacccggtccccccttacccccgttacgggaaaccccctaacgttcccggtaaacggggttccgggggtaccccgtttaccccgggggttaccccggaaaggggtacgttacgggaaccggggttccttaccgggtaaacgtttaactttaacccggtggggtttacgaccgttaacgtacccggaaaccggggggtaacccacgtaaaaccgtagggtacgggggtaattaacggaaacctaaagttccgtaaggggttacgggttccggggtttagggggtccgttacgggggacggggttaaacgacccgtaaacggttcgcccgttaccggtacggacctaacggaaccccgtaaccggg

SEQ ID NO: 310554 - DNA, 731 bp, Homo sapiens
  misc_feature: GZ8MTXP01D42MI.21.22.B11.1.454.CMB.2.raw
  modified_base (201)..(201): a, c, t, g, unknown or other
  misc_feature (201)..(201): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagcccaccctcagcgtctcgggaccccccggnaggacggtccaccattctcttgttctggacgcaactaccaacagtacggaattaattatgtattcgtaggtatcagacctaacctacccgaaggtaactccggaccccctaaactccctacactaccgaaggaaaggtaaataacgtccgaaccgggcccggtcccctacggtaccgggggttcccctacggtacccgtactttccgtcgtcggtccctacccgtaaagttccgtcggaccctacccgtaccgaccgtccccttcccgtacgaaccctagtccgtagggttcgggccgttcccgggtacggaaggtacgtcggacggtctacgtaacttaagtttacgtggggtacgacgtaacgtaccggaacggggacctacaaacgtaggtgggtaatacgaactaacgttcggttaggttacgggttcggggtttagggttcgggttccggggacgggttacgggttaaaccctaacggtcggtaacccggttacgtacgggttaccaaccggttaacccgtaagg

SEQ ID NO: 310555 - DNA, 593 bp, Homo sapiens
  misc_feature: GZ8MTXP01BRY07.21.22.B11.1.454.CMB.2.raw
  modified_base (199)..(199): a, c, t, g, unknown or other
  misc_feature (199)..(199): n is a, c, g, or t
  modified_base (408)..(408): a, c, t, g, unknown or other
  misc_feature (408)..(408): n is a, c, g, or t
  modified_base (451)..(451): a, c, t, g, unknown or other
  misc_feature (451)..(451): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctgggaccccccggnagagggtcaccatctcttgttctggaggcaactccaacatcggaataatatgtattctggtatcagcaactcccaggaatcggacccccaaactcctcatccagagaatatcagccgcctcgacggggtccctgaccgtacttctcgtgctccgaaagtctggcctacctcacgccctcctgacccatcaggtcggctccggtccgagntgaggctagacttattactgggtcgctaagtcgaacggggacncgaaacgagtggggaattgaaactaaagtcccgtggacggtcgggtttgggggtaggtttccgggggacgggacggggttaaaccctaaacgtgggtaaccccgttccggtaagggttcccaacggttcccccgtaaagggg

SEQ ID NO: 310556 - DNA, 650 bp, Homo sapiens
  misc_feature: GZ8MTXP01A5G8R.21.22.B11.1.454.CMB.2.raw
  modified_base (414)..(414): a, c, t, g, unknown or other
  misc_feature (414)..(414): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgttgactcagccaccctcagcgtcgtcgggacccccgggcagagggtcaccatctcttgttctggagcaactccaacatcggaagtaattatgtattctggtatcagcaactccgaaggaactcggacccccaaatcctacactaccaggaggaaatactcgacggccggccctcggacgggggtcccctagacccgtatttcccgtcgtcgggactcccgaaggtctcgggccaccctcgacgtcccctccngacctatcgaggtcgggcctccggcgaggactggaggtctagaccttagttacgtcgtaggactacgtcggaacggggacacaacgtaggtacggggaacttacgaaaccgtaagttcggaacgggtagggttccggggggtttagggttcgggttacccgggggacggttaacggggaacccttaaacgtcggaccccgttcgttaagggcccaacggcccgttaacgggtcccg

SEQ ID NO: 310557 - DNA, 549 bp, Homo sapiens
  misc_feature: GZ8MTXP01BZLA9.21.22.B11.1.454.CMB.2.raw
  modified_base (235)..(235): a, c, t, g, unknown or other
  misc_feature (235)..(235): n is a, c, g, or t
  modified_base (342)..(342): a, c, t, g, unknown or other
  misc_feature (342)..(342): n is a, c, g, or t
  modified_base (357)..(357): a, c, t, g, unknown or other
  misc_feature (357)..(357): n is a, c, g, or t
  modified_base (413)..(413): a, c, t, g, unknown or other
  misc_feature (413)..(413): n is a, c, g, or t
  modified_base (456)..(456): a, c, t, g, unknown or other
  misc_feature (456)..(456): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccatcctcagcgtcgtcgggaccccggcagagggtcaccatctcttgtctggagcaactccaanatcgaatattatgtatctgatcagcaactcccgaggaactcggacccccaaatcctacatccagagaataatcagccggccctcgacggggtccctgaccccattcntcggctaccaagtcnggcaccctcacgtccctccctagaccctatccgagtcgggcctccgggaccgaggntggaggctagacttagtactgtgcactcgaacgggcacaaacngtcgggatcgaaacaagtcgttgggtacggttcggggtttaggtcggttcggacgggacggtaacaacgtgacccgtgacgtcgaacgtcccg

SEQ ID NO: 310558 - DNA, 549 bp, Homo sapiens
  misc_feature: GZ8MTXP01AL5ZY.21.22.B11.1.454.CMB.2.raw
  modified_base (431)..(431): a, c, t, g, unknown or other
  misc_feature (431)..(431): n is a, c, g, or t
  modified_base (437)..(437): a, c, t, g, unknown or other
  misc_feature (437)..(437): n is a, c, g, or t
  modified_base (451)..(451): a, c, t, g, unknown or other
  misc_feature (451)..(451): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctcgggaccccccggcagagggtcaccatctcttgttctggaggcaactccaacatcggaagttaattatgtattctggtatcagcaactcccaggaatcggacccccaaactcctcatccaagaggaataatcagccggccctcgacggggtccctgaccgtattctctggctcaaagtctggcacctcacgcctcctgaccatcaggtgggcctccgggtccgaggatggaggctgactattacngggtcnctatcgacgggacncaacgagtgggatgaacagtcgtggagtcgggttgggtgtcggggcgggagggacccaaacgtggaaccgtccgtagggttccaacggcccgaacggg

SEQ ID NO: 310559 - DNA, 777 bp, Homo sapiens
  misc_feature: GZ8MTXP01E10C2.21.22.B11.1.454.CMB.2.raw
  modified_base (200)..(200): a, c, t, g, unknown or other
  misc_feature (200)..(200): n is a, c, g, or t
  modified_base (262)..(262): a, c, t, g, unknown or other
  misc_feature (262)..(262): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagcccaccctcagcgtctcgggacccccggnagagggtcaccatctcttgttctggagcaactccaacatcggaataattatgtattctgtancagcaactcccaggaactcggacccccaaatccctcactccaagaaggaaataatcaggccggccctacgacgggggttcccctagacccgtactttccgtactcggccctacccgtaaaaggttccttcgggcccaaacccgttcccaacgtccccccttacccccgttaggaaaccccctagtaccccgaaggggtttccgggggcccctttcccccgggggtacccggaaaggggtaacgttgggaaacggggtccttacgggtaaaccttaagtttaaccgtggggttacggacctaaacggttccggaaacccgggggtaaccgacccaaaacgtcggtagggggtaaacttcgggaaaaccctaaaggtttccgtaagggttacgggggttccgggggttttgggggttcgggttccggggaccgggggttaaacggggaacccctaaaacggttccggaaccccggtttccggaacggggttcccaacccgggccccgtaaaccgggg

SEQ ID NO: 310560 - DNA, 685 bp, Homo sapiens
  misc_feature: GZ8MTXP01CD43J.21.22.B11.1.454.CMB.2.raw
  modified_base (199)..(199): a, c, t, g, unknown or other
  misc_feature (199)..(199): n is a, c, g, or t
  modified_base (364)..(364): a, c, t, g, unknown or other
  misc_feature (364)..(364): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctggggacccccggnaggagggtcaccattctcttgttctggaggcaaactccaaacatacggaattaattatgttattctggtatcagcaactcccaggaactcggaccccaaatcctacactccaagaaggaaataatcaacgccggccctacgacgggggtccctgaccgtacttcncgtcggcctaccaaagttctcggaccaccctcgacgcccttcccgtacacccatcgacggtcggggcctcccgggtaccgagggtactaggacgggcttacgaacttagtttacctggggtcgtaccgacgtacggaaccggggacaccggaaatacgggttaggggaacttacgaacgtaaacgttcggtaggttacggggttcgggtttgggggttcgggttacccgggggacgggaaaccggggaacccgtttaaaaccggccggttaacccggttaccccggttagggacccgtaaccggaaccccggtaaaccggg

SEQ ID NO: 310561 - DNA, 852 bp, Homo sapiens
  misc_feature: GZ8MTXP01EQI3E.21.22.B11.1.454.CMB.2.raw
  modified_base (266)..(266): a, c, t, g, unknown or other
  misc_feature (266)..(266): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctcgggacccccggcagagggtcaccatctcttgttctggaggcaactccaacatacggaagttaattatgtattctggtancagcaactccaggactccggacccccaaactcctcactaccagaaggaataactcacggccggccctacgacgggggtccctacggaccgtactttccgtcgtcggtacctacccgaaaaacgttcccgtcgggaccctaccccgttccgaacccgtcccccttacccccgttacggaacccctacttacccggaacgggtttccgggggaccccgtttcccccgggggtacccggtaaacgggggtacgtttagggggaaaccgggtccgttaccggtaaacctttaaacggtttacccgtttggggttaccgggaccgttaaacccgttaccccgggaaaccggggggttaacccaaacccggtaaaaccgtacgggtttaacggggggaatttaaccgggaaacgtaaaacggtttcccgttaagggggttaccggggtttacccgggggttttgggggttcggggttttacccgggggaaccgggggttaaaccggggttaaaccccgtaaaaaccgggttcggtaaccccgggttacccggtagggttacccgtaacccggttaacccccggtaaaccggg

SEQ ID NO: 310562 - DNA, 605 bp, Homo sapiens
  misc_feature: GZ8MTXP01DRW4U.21.22.B11.1.454.CMB.2.raw
  modified_base (201)..(201): a, c, t, g, unknown or other
  misc_feature (201)..(201): n is a, c, g, or t
  modified_base (352)..(352): a, c, t, g, unknown or other
  misc_feature (352)..(352): n is a, c, g, or t
  modified_base (426)..(426): a, c, t, g, unknown or other
  misc_feature (426)..(426): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagcccaccctcagcgtcgtcgggacccccggnagagggtcaccatctcttgttctggagcaactccaacatacggaagttaattatgtattctggtatcagacaactcccaggaactcggacccccaaactcctacatccaagaagaataatcagccgcctgacgggtccctgacctacttcnctggcctaccaaagtctcgccacctcacgcccctcctacgaccatcgaggtcgggcctcccgggtacgaaggtntgggacggtctacgaacttaagttcgtgggtcgactacgtcgaacgggacacaagagtggaactagaacaatcgtggacggggtcgggtttggggtacggttcggggaccgggttaacggaacccgtaaacgtcgggtaacccggtcgttacggacgtaacccggaacccggaaccggg

SEQ ID NO: 310563 - DNA, 642 bp, Homo sapiens
  misc_feature: GZ8MTXP01CCBLW.21.22.B11.1.454.CMB.2.raw
  modified_base (235)..(235): a, c, t, g, unknown or other
  misc_feature (235)..(235): n is a, c, g, or t
  modified_base (441)..(441): a, c, t, g, unknown or other
  misc_feature (441)..(441): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtcgtgggaccccagggcagagggtcaccatctcttgtctggagcaactcaanatcggaataattatgtattctggtatcagcaactccaggaactcgaccccaaactcctacatcagagaatatcacgcgcctcgacgggtcctgacccgtattctcgtcggcctacaagtctcggctaccctcacgtccctcctcgaccctatcgaggtcggacctccgggtacgaggtactggacggtctagacttacgtttacgngttacgctaacgtccggaaacccggggacacgaaaaccgtaggtcggggtaaactacggaaactaaacgttccggttagggtaacggggttcgggggttttacgggggtcggtttacgggggaccgggttaaacgggtaaacccgtaaaccgttcggggaacccccggttcgttaacgggttcccgaacgtaacccccggg

SEQ ID NO: 310564 - DNA, 620 bp, Homo sapiens
  misc_feature: GZ8MTXP01DQF0Y.21.22.B11.1.454.CMB.2.raw
  modified_base (200)..(200): a, c, t, g, unknown or other
  misc_feature (200)..(200): n is a, c, g, or t
  modified_base (391)..(391): a, c, t, g, unknown or other
  misc_feature (391)..(391): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagcccaccctcagcgtctcgggacccccggnagagggtcaccatctcttgttctggagcaactccaacatcggaattaattatgtattctggtatcagcaactccaggaatcggacccccaaactcctacactaccagaaggaataatcaacgccgccctcgacgggtccctgaccgtacttcctctcggtcctaccgtaaagtcctggcctaccctcgacncccctccctgacccatcgaggtcggctccggtacgaggtatgaggctagtaccttagtttactggggtcactagtccggaacggggaccacaaacgtaggtggggaacttacgggaaactaaagttcctagggacgggttcggggtttgggtacggttccgggggacggggttaacgggaaccctaaagtcggtaacccgtcgtaggttcccgaacgccccgtaacggg

SEQ ID NO: 310565 - DNA, 539 bp, Homo sapiens
  misc_feature: GZ8MTXP01EBL7H.21.22.B11.1.454.CMB.2.raw
  modified_base (198)..(198): a, c, t, g, unknown or other
  misc_feature (198)..(198): n is a, c, g, or t
  modified_base (326)..(326): a, c, t, g, unknown or other
  misc_feature (326)..(326): n is a, c, g, or t
  modified_base (371)..(371): a, c, t, g, unknown or other
  misc_feature (371)..(371): n is a, c, g, or t
  modified_base (514)..(514): a, c, t, g, unknown or other
  misc_feature (514)..(514): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctgggacccccggnagagggtcaccatctcttgttctggagcaactccaacatcggaattaattatgtattctggtatcagcaactcccaggaatcgacccccaatcctcatccagagaatatcagcgcctgacgggtcccngaccgtacttctctggcctcaaagtctgcacctcacgcccctccngacccatcaggtcgggactccggtcgaggatggagctagactattacgtggtgcatcgaacgggcacaacgagtggatgactaagtctaggaggtcgggttgggtgttcgggacggttacgggaacctaaacgtgaacccgtntacgggttcaacggttcccgaacgg

SEQ ID NO: 310566 - DNA, 544 bp, Homo sapiens
  misc_feature: GZ8MTXP01CU50R.21.22.B11.1.454.CMB.2.raw
  modified_base (415)..(415): a, c, t, g, unknown or other
  misc_feature (415)..(415): n is a, c, g, or t
  modified_base (458)..(458): a, c, t, g, unknown or other
  misc_feature (458)..(458): n is a, c, g, or t
  modified_base (508)..(508): a, c, t, g, unknown or other
  misc_feature (508)..(508): n is a, c, g, or t
tcagtcgtcgctcgcacgaccggtgctcgatttagacgacagctcaggggagcttcagctgtggtagagaagacaggactcaggacaatctccagcatggccggcttccctctcctcctcacccctcctcactcactgcgcagggtcctgggcccagtctgtgctgactcagccaccctcagcgtctgggaccccccggcagagggtcaccatctcttgttctggaggcaactccaacatcggaagtaattatgtattctggtatcagcaactcccaggaatcggcccccaaactcctcatccagaggaataatcagccggccctcgacggggtccctgaccgattcctctggcctccaaagtctggccacctcacgccctccctgacccatcaggtgggctccgggtccgaggntgaggctagacttattacgtggtacgctatccgaacggggacncaaacgagtggggatgacaagtctggaggtcgggttgggtgtcgggcggnggaccaagcgtgacccgtcttaggtcaaggtccccg

SEQ ID NO: 310567 - DNA, 680 bp, Homo sapiens
  misc_feature: GZ8MTXP01A51P6.21.22.B11.1.454.CMB.2.raw
  modified_base (235)..(235): a, c, t, g, unknown or other
  misc_feature (235)..(235): n is a, c, g, or t
  modified_base (262)..(262): a, c, t, g, unknown or other
  misc_feature (262)..(262): n is a, c, g, or t
  modified_base (331)..(331): a, c, t, g, unknown or other
  misc_feature (331)..(331): n is a, c, g, or t
  modified_base (374)..(374): a, c, t, g, unknown or other
  misc_feature (374)..(374): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctgggacccccggcagagggtcaccatctcttgttctggagcaactccaanatcggaagtaattatgtattctggtancagcaactccaggaatcggcccccaaatccctcatccagacggaataatcagccgcctgacggggtccngacccgtattctcgtggctcccgaaagttctcggaccaccctnacgcccctccctgaacccattcaggttcggccgttcccgggtaccgaaggacgttaggacgggtactacggtaaccttagtttaaccgtgggggttcgacgtaacggtacccgtaaaccggggggaccaacccggaaactagggttaggggaatacggaactaaacgttcgtgggaacgggtcggggtttgggggtacggtttccgggggaccgggttaaacgggggaacccctaaaaaccggttcggggtaaaccccgttcccgggttaaacggggccctaacggttaaccccccggtaaacggg

SEQ ID NO: 310568 - DNA, 638 bp, Homo sapiens
  misc_feature: GZ8MTXP01DRS79.21.22.B11.1.454.CMB.2.raw
  modified_base (199)..(199): a, c, t, g, unknown or other
  misc_feature (199)..(199): n is a, c, g, or t
  modified_base (236)..(236): a, c, t, g, unknown or other
  misc_feature (236)..(236): n is a, c, g, or t
  modified_base (493)..(493): a, c, t, g, unknown or other
  misc_feature (493)..(493): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagcccaccctcagcgtctgggacccccggnagagggtcaccatctcttgttctggagcaactccaanatcggaagtaattatgtattctggtatcagcaactcccaggaatcggacccccaactcctcatccagagaatatcagcggccctgacgggtccctgaccgtacttcctacgtcggcctcccgaaaacgttcctcggccaccctcacgcccctcctcgaccatcgaggtcgggcctccgggtaccgaggtactggacgggtctgtaacttagtttacctggggttacgcttaaacgccggaacggggaccgccgaaanaggttcggggatacggaacaagttaacgtggaacgggttcggggtttgggggttcggtttacggggacgggggttacgggaaaacccgtaacgtacgggtaacccgttccggtagggttaccgaaccggttaaccccgtaacggg

SEQ ID NO: 310569 - DNA, 741 bp, Homo sapiens
  misc_feature: GZ8MTXP01A42TV.21.22.B11.1.454.CMB.2.raw
  modified_base (202)..(202): a, c, t, g, unknown or other
  misc_feature (202)..(202): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagcccaccctcagcgtcgtcgggaccccccggnaggagggtcaccatctcttgttctggagcaactccaacatacggaagttaattatgtattctggtatcagacaactcccaaggaactccggacccccaaactcctacactccaagaaggaaataatcacgccggccctacgacgggggtcccctggaccgtacttcctacgtcggtaccctaccgtaaaacgtccgttcgggaccctaaccccgttcacccggtccccttaccccgtacggaacccctaacgttccgtaacggggtccgggggtcccgttacccggggttacccggaaggggtagtacgggtaccggggacttacgtaacttaagtttaccgtggggttcgacctaacgtaccggaacggggacacgaaacgagtacggggaatacggaaactaacgttcgtagggttagggttcgggggtttgggggtacggttccgggggaaccggggttaacgggaacccgtaaaacgggttccggtaacccggtaacccggtacgggttacccgtaaccggccccggtaaccggg

SEQ ID NO: 310570 - DNA, 618 bp, Homo sapiens
  misc_feature: GZ8MTXP01EZBIE.21.22.B11.1.454.CMB.2.raw
  modified_base (199)..(199): a, c, t, g, unknown or other
  misc_feature (199)..(199): n is a, c, g, or t
  modified_base (235)..(235): a, c, t, g, unknown or other
  misc_feature (235)..(235): n is a, c, g, or t
  modified_base (259)..(259): a, c, t, g, unknown or other
  misc_feature (259)..(259): n is a, c, g, or t
  modified_base (434)..(434): a, c, t, g, unknown or other
  misc_feature (434)..(434): n is a, c, g, or t
  modified_base (587)..(587): a, c, t, g, unknown or other
  misc_feature (587)..(587): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagcccaccctcagcgtctgggacccccggnagagggtcaccatctcttgttctggagcaactcaanatcggaatattatgtattctgtancagcaactcccaaggactcggacccccaaactcctcactccaagaggaaataactcacggcccggccctacgacgggggtccctaggaccgtacttcctcgtcggcctacccgaaagttcgtcggccacctcacgtcccctacccagacccatcgaggtcgggcctccggcgagntggacgctgattatacgtgtatgtagttgactacgagtccgttactttagtcggttaccgttacgggaacgttcggggaaaccttaacgggtcccttaccggttaccgtaacgggttcccacggaccccgtaaacggccccctaaaccccgtntccggttacctaaccgtttcccgttccccgg

SEQ ID NO: 310571 - DNA, 658 bp, Homo sapiens
  misc_feature: GZ8MTXP01EIF98.21.22.B11.1.454.CMB.2.raw
  modified_base (200)..(200): a, c, t, g, unknown or other
  misc_feature (200)..(200): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtcgtcgggacccccggnagagggtcaccatctcttgtctggagcaactccaacatacggaattaattatgtattctggtatcagcaacctcccaaggaactccggaccccctaaactccctacactcccgaagaaggaaataacgtcacgcggtcccctcgacgggggtcccctgaccgtacttcctacgtggcctccgaaaagtctcggccacctcacgccctccctcgaccctatcaggtcgggccttccgggtccgaggactgacggctaggaccttattacgtgggtcgtacgtaacgtccgaacggggaccgactaaaccgagttaggggaattacggaaacctaagttcgtaggttaggggtccgggtttgggggtacggttcggggacgggaacggggttaaaccctaaaacggtccggtaaccccggttaccgtacggggttaactcccgggaacccgtaaccgggg

SEQ ID NO: 310572 - DNA, 602 bp, Homo sapiens
  misc_feature: GZ8MTXP01ADB59.21.22.B11.1.454.CMB.2.raw
  modified_base (199)..(199): a, c, t, g, unknown or other
  misc_feature (199)..(199): n is a, c, g, or t
  modified_base (262)..(262): a, c, t, g, unknown or other
  misc_feature (262)..(262): n is a, c, g, or t
  modified_base (449)..(449): a, c, t, g, unknown or other
  misc_feature (449)..(449): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctcgggacccccggnagagggtcaccatctcttgttctggagcaactccaacatacggaagtattatgtattctgtancagcaactcccaaggaactcggacccccaaactcctacatccagaaggaaataatcagccggccctcgacggggtccctgaccgtacttctcgtggcctccgaaagtcctggccacctcacgtccctcctgacccatcgaggtcggcctccggtcgaggatggacggtcttagaacgttattaccgngggttcgacctagtcccggaacgggaccacgaacgtagtggggtactagaactaagtcgtgggttacggtcgggttggggtcggtacgggacgggacggaaccgtaacgtcgggaacccgttaccgtagggacctaaccggcccgtaaccggg

SEQ ID NO: 310573 - DNA, 746 bp, Homo sapiens
  misc_feature: GZ8MTXP01B8AK8.21.22.B11.1.454.CMB.2.raw
  modified_base (201)..(201): a, c, t, g, unknown or other
  misc_feature (201)..(201): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagcccaccctcagcgtcgtcgggacccccggnagagggtcaccatctcttgttctggagcaactccaacatacggaagttaattatgtattctggtatcagcaactcccgaaggaactccggaccccctaaactccctacactaccgaagaaggtaaataactcgaacgccggccctacggacgggggtcccctaggacccgtacttcctcgtcggccctaccgtaaaacgttccctcgggaccctaccccgttccgacccgtcccccgttacccctacggaaacccctagttacccggaacggggttcccggggcccgttaccccgggggttacccgggaaagggtacgttacgggaacgggtccttacggtaaacctttaacgtttaccgttggggtacgtaccgtaacggtacccggaaacggggaccaacgaaacgtaggtaggggattacggaacttaagtcgtaggttacggggttcgggtttggggtacggttccggggacgggttacgggaaacccgtaaacggtccggtaaccggtcgttacggaccgtaaccggaacccgtaacggg

SEQ ID NO: 310574 - DNA, 656 bp, Homo sapiens
  misc_feature: GZ8MTXP01CWQ31.21.22.B11.1.454.CMB.2.raw
  modified_base (231)..(231): a, c, t, g, unknown or other
  misc_feature (231)..(231): n is a, c, g, or t
  modified_base (242)..(242): a, c, t, g, unknown or other
  misc_feature (242)..(242): n is a, c, g, or t
  modified_base (253)..(253): a, c, t, g, unknown or other
  misc_feature (253)..(253): n is a, c, g, or t
  modified_base (285)..(285): a, c, t, g, unknown or other
  misc_feature (285)..(285): n is a, c, g, or t
  modified_base (340)..(340): a, c, t, g, unknown or other
  misc_feature (340)..(340): n is a, c, g, or t
tcagtcgtcgctcgcacgaccggtgctcgatttagacgacagctcaggggagcttcagctgtggtagagaagacaggactcaggacaatctccagcatggccggcttccttctcctcctcaccctcctcactcactgcgcagggtcctgggcccagtctgtgctgactcagccacctcagcgtctcgggacccccggagaggtcaccatctcttgtctggagcaactcaantcggaatatangtatctggtancagcaactcccagactcgaccccaaactcctnactccgaagacgaataactcgagccggccctgacggggtccctgaccgtacttcnctgctaccaaagttctcggctacctcacgccctacccgtgacctatcgaacggttcgggccgtccggtacccggaggtacgtgggaacgggtcctaggtaaccttagtttaacgtggggtacggacctagtacccggaacggggaccgaccaaacggtaggtaccggggaattacggaactaaacgtcggttcggaggggttcccgggttggggttcggttaccgggggacggaacggggaacccctaaaacgggtccggtaacccggttaaccccgaagggggttccctaacccgggaaccccgtaaaccggggg

SEQ ID NO: 310575 - DNA, 603 bp, Homo sapiens
  misc_feature: GZ8MTXP01BIEJ7.21.22.B11.1.454.CMB.2.raw
  modified_base (200)..(200): a, c, t, g, unknown or other
  misc_feature (200)..(200): n is a, c, g, or t
  modified_base (260)..(260): a, c, t, g, unknown or other
  misc_feature (260)..(260): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagcccaccctcagcgtctgggaccccccggnagagggtcaccatctcttgttctggagcaactcaacatcggaatatatgtattctggtancagcaactcccaggaactcggacccccaaactccctacactccagaggaaataatcacgccggccctcgacggggtccctagaccgtattcctcgtggcctaccgaaacgtctggcctaccctcacgtccctccctgaccatcgaggtcgggctccggtcgaggtactggaggcctagaccttaagttaccgtggtcgactacgtacgaacggggaccacaaacgagttaggggattacgaaacgtaattcggtagaggtcggggttgggtacggttcgggacggggacggaacccgtaaacgttcggaacccgtcgtacggttaccaacgccccgtaacggg

SEQ ID NO: 310576 - DNA, 668 bp, Homo sapiens
  misc_feature: GZ8MTXP01ASXAL.21.22.B11.1.454.CMB.2.raw
  modified_base (199)..(199): a, c, t, g, unknown or other
  misc_feature (199)..(199): n is a, c, g, or t
  modified_base (263)..(263): a, c, t, g, unknown or other
  misc_feature (263)..(263): n is a, c, g, or t
  modified_base (438)..(438): a, c, t, g, unknown or other
  misc_feature (438)..(438): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctgggaccccccggnagagggtcaccatctcttgtctggagcaactccaacatcggaagttaattatgtattctggtancagcaactcccaggaactcggacccccaaactccctacatcccaagaaggaaatatcagccggcctcgacggggtccctgaccgtacttcctcgtcggcctaccgaaagtcgtcggcctacccgtcaccgtccctcccgtagaccctatcgaggtcgggcctccgggtacgaggntggacgcttgaacttattacgtggggtcgactagtccgaaccgggacacaaacgtaggtggggaacttacgaactaaagttccgtggggttacggggtccggggttttgggggacgggtttcccgggggacgggggttaacccggggttaaacccttaaaaccggtcggggttaacccccggttacggtaacggggttaccaaacccggggttccccgtaaacccggggg

SEQ ID NO: 310577 - DNA, 550 bp, Homo sapiens
  misc_feature: GZ8MTXP01A75PB.21.22.B11.1.454.CMB.2.raw
  modified_base (199)..(199): a, c, t, g, unknown or other
  misc_feature (199)..(199): n is a, c, g, or t
  modified_base (258)..(258): a, c, t, g, unknown or other
  misc_feature (258)..(258): n is a, c, g, or t
  modified_base (466)..(466): a, c, t, g, unknown or other
  misc_feature (466)..(466): n is a, c, g, or t
  modified_base (471)..(471): a, c, t, g, unknown or other
  misc_feature (471)..(471): n is a, c, g, or t
  modified_base (488)..(488): a, c, t, g, unknown or other
  misc_feature (488)..(488): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctgggaccccccggnagagggtcaccatctcttgttctggagcaactcaacatcggaatattatgtatctgtancagcactcccaggaatcggcccccaaatcctcatccagaggaataactcaggccggccctcgacgggggttcccctggaccgtacttcctctggcctacccaaagttcctggcctaccctcacgtccctcctgacccatcaggtcggggactcccgggtcgaggctggacgctagactattacctggggtcgctaatccgaacgggcncaaanacgtggatgacaatcgngagcgggttggtgttcgggcggagggacctaaacgtgccgtcgaggttcaacgcccgaacgg

SEQ ID NO: 310578 - DNA, 728 bp, Homo sapiens
  misc_feature: GZ8MTXP01B8PFP.21.22.B11.1.454.CMB.2.raw
  modified_base (199)..(199): a, c, t, g, unknown or other
  misc_feature (199)..(199): n is a, c, g, or t
  modified_base (268)..(268): a, c, t, g, unknown or other
  misc_feature (268)..(268): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctcgggacccccggnagagggtcaccatctcttgttctggaggcaactccaaacatcggaaagttaaattatgtattctggtancagcaactcccaaggaactcggacccccaaaactccctacaactccaagaacggtaaataaactccgaagcccggcccttacgacgggggtcccctggaacccgtactttcctcgtcggacctacccgaaagttccctggaccctaacccgttccaaccgtccccttcccgtacgaccctatcccgaggttccggggccttcccgggaccgaagggtactggaacggtctacgtaacttaatttaccgttggggagtacctaaacgtcccggaaaccgggggccaacgaaacctaggttaccgggggaacttagggaaacctaaagttccggttagggaacgggtttccggggtttggggttacgggttaccggggacgggggttaacgggaaacccctaacggtaccgggtaacccggttaaccctagggggttacccaaaccgttccccggtaaaggg

SEQ ID NO: 310579 - DNA, 533 bp, Homo sapiens
  misc_feature: GZ8MTXP01ADR5E.21.22.B11.1.454.CMB.2.raw
  modified_base (263)..(263): a, c, t, g, unknown or other
  misc_feature (263)..(263): n is a, c, g, or t
  modified_base (369)..(369): a, c, t, g, unknown or other
  misc_feature (369)..(369): n is a, c, g, or t
  modified_base (428)..(428): a, c, t, g, unknown or other
  misc_feature (428)..(428): n is a, c, g, or t
  modified_base (465)..(465): a, c, t, g, unknown or other
  misc_feature (465)..(465): n is a, c, g, or t
  modified_base (487)..(487): a, c, t, g, unknown or other
  misc_feature (487)..(487): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctcgggacccccggcagagggtcaccatctcttgttctggagcaactccaacatcggaagtaattatgtattctggtancagcaactcccaggaatcggcccccaaactcctcatccagagaataatcagcggccctgaggggtccctgaccgattctctggctccaaagttcctggccaccctnacgccctccctgacccatcaggtgggctccgggtcgaggatgacggctgacttattacnggtgcatcgacggggccaaatgtgggatgacaattcngaggtcgggttgggtgtcgggnggacggaacccaaagtcgaaccgtcgtaggttcaacgcccgtaagg

SEQ ID NO: 310580 - DNA, 679 bp, Homo sapiens
  misc_feature: GZ8MTXP01D9UQR.21.22.B11.1.454.CMB.2.raw
  modified_base (202)..(202): a, c, t, g, unknown or other
  misc_feature (202)..(202): n is a, c, g, or t
  modified_base (238)..(238): a, c, t, g, unknown or other
  misc_feature (238)..(238): n is a, c, g, or t
  modified_base (367)..(367): a, c, t, g, unknown or other
  misc_feature (367)..(367): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagcccaccctcagcgtcgtcgggaccccccggnagagggtcaccatctcttgtctggagcaactccaanatcggaattaattatgtattctggtatcagcaactccaaggaactccggacccccaaactcctacactaccgaagaaggaaataactcaacggccggccctcgacggggtccctagacccgtacttccncgtgcctaccgaaagttcgtggcctaaccctcacgtccccttcccgtagaccctacgtcgaggtcgggtccgtaccgggtcccggagggtactaggacgggtacttacggtaaccttagtttaaccgtggggtcgaccgtaagtcccggaaacgggggacccgaacaaaccgtaaggttcgggtagtacgaaccgtaaagtccgtagggttacgggtcggggtttaggggtcggttacggggacgggttaacgggaaccctaaacggtccgtaaccggtccgtaggttaccgaaccggttcccgtaaccggg

SEQ ID NO: 310581 - DNA, 567 bp, Homo sapiens
  misc_feature: GZ8MTXP01BUDPT.21.22.B11.1.454.CMB.2.raw
  modified_base (198)..(198): a, c, t, g, unknown or other
  misc_feature (198)..(198): n is a, c, g, or t
  modified_base (254)..(254): a, c, t, g, unknown or other
  misc_feature (254)..(254): n is a, c, g, or t
  modified_base (317)..(317): a, c, t, g, unknown or other
  misc_feature (317)..(317): n is a, c, g, or t
  modified_base (399)..(399): a, c, t, g, unknown or other
  misc_feature (399)..(399): n is a, c, g, or t
  modified_base (419)..(419): a, c, t, g, unknown or other
  misc_feature (419)..(419): n is a, c, g, or t
  modified_base (439)..(439): a, c, t, g, unknown or other
  misc_feature (439)..(439): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctgggacccccggnagagggtcaccatctcttgtctggagcactcaacatcggaatatatgtatctgtancagcaactccagatcggccccaactcctcatccagagaataatcacgcgcctcgacgggtccngaccgattcctctggcctaccaaagtctcggcaccctcacgtcctccctagacccatcgaggtcgggcctccgggtcgaggntggagctagactattaccgnggtcgcatccgacgggaccncaacgagtgggatacggaacaagttctaggacgggtcgggtttggggtcggttcggggacgggttacgggaaccctaaacggtcggtaaccccgttacgacgggttaccaacggccccgtaaccgggg

SEQ ID NO: 310582 - DNA, 573 bp, Homo sapiens
  misc_feature: GZ8MTXP01ELU8W.21.22.B11.1.454.CMB.2.raw
  modified_base (200)..(200): a, c, t, g, unknown or other
  misc_feature (200)..(200): n is a, c, g, or t
  modified_base (258)..(258): a, c, t, g, unknown or other
  misc_feature (258)..(258): n is a, c, g, or t
  modified_base (412)..(412): a, c, t, g, unknown or other
  misc_feature (412)..(412): n is a, c, g, or t
  modified_base (442)..(442): a, c, t, g, unknown or other
  misc_feature (442)..(442): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagcccaccctcagcgtctgggaccccccggnagagggtcaccatctcttgtctggagcaactccaacatcggaatatatgtatctgtancagcaactcccaggaatcggacccccaaactcctcatccagagaataatcagcggcctcacgggggtccctgaccgtattctctggcctccgaaagtctggcacctcacgtcctccctgacccatcaggtcggctaccggtcgaggactgagcngactagttactggtgcataccgacgggacncgaacagtgggatggacaattcgtgacggtcgggtttaggggtgtttccggggcgggttacgggaaaccccgtaaacgtcgggtaaccccgttccggtaacgggttccaaccggttccccgtaaaccgggg

SEQ ID NO: 310583 - DNA, 640 bp, Homo sapiens
  misc_feature: GZ8MTXP01EFIFK.21.22.B11.1.454.CMB.2.raw
  modified_base (200)..(200): a, c, t, g, unknown or other
  misc_feature (200)..(200): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagcccaccctcagcgtctcgggacccccggnagagggtcaccatctcttgtctggagcaactccaacatacggaataattatgtattctggtatcagcaactccaggatcgacccccaactcctcactccagagaataatcagccgccctgacggggtcctgaccgtacttctctggcctaccgaaacgtctcggccaccctcacgtccctcccgtagacccgtatccgagggttccggccgttcccgggtacgaacgggtattcggacggtcttacgaacctttagttacccgttggtcggacacgttacccggaggggacccacgaagtaggtggggaattcgaaccaagttcggtaggagggttccgggtttagggtcgggttacggggacgggttaacggggttacccctaaaagggttccgaaccgggtttaccgacggttccgtaacccggaacccgtaaccggg

SEQ ID NO: 310584 - DNA, 563 bp, Homo sapiens
  misc_feature: GZ8MTXP01CA4XT.21.22.B11.1.454.CMB.2.raw
  modified_base (198)..(198): a, c, t, g, unknown or other
  misc_feature (198)..(198): n is a, c, g, or t
  modified_base (235)..(235): a, c, t, g, unknown or other
  misc_feature (235)..(235): n is a, c, g, or t
  modified_base (259)..(259): a, c, t, g, unknown or other
  misc_feature (259)..(259): n is a, c, g, or t
tcagtcgtcgctcgcacgaccggtgctcgatttagacgacagctcaggggagcttcagctgtggtagagaagacaggactcaggacaatctccagcatggccggcttccctctccttctcaccctcctcactcactgcgcagggtcctgggcccagtctgtgctgactcagccaccctcagcgtctgggacccccggnagagggtcaccatctcttgttctggagcaactcaacntcggaatattatgtattctggtancagcaactcccaggaatcggcccccaaactcctacatccagaaggaataatcaagcggccctcgacggggtccctgaccgtacttctctggcctccaaagtctggcacctcacgccctccctgacccatcgaggtcgggcctccggtccgaggactggacggctgaacttattacgtgggtgctatccgacgggacgcaaacgagtgggatggactaaagtcgtgaggtcgggtttgggtggttccgggacgggagggaacctaaaagtcgaaccggtcgacgggttccgaacgccccgaaggg

SEQ ID NO: 310585 - DNA, 717 bp, Homo sapiens
  misc_feature: GZ8MTXP01A4RRP.21.22.B11.1.454.CMB.2.raw
  modified_base (200)..(200): a, c, t, g, unknown or other
  misc_feature (200)..(200): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtcgtcgggacccccggnagagggtcaccatctcttgtctggagcaactcaacatcggaataattatgtattctggtatcagcaactcccaggaatcggacccccaaactcctcactaccagaaggaataactcgaaggccggtacccctacggtacggggtcccctaggacccgtacttccgtcgtcggccctaccgaaacgttcccgtcgggcccaacccttccaaccggtcccccttacccgtacgaacccctacgttccggtaacgggtccggggtacccgttccccgggtacggaacggtagttggaacgggtcttacgtaacttacttaacggtggtacgcgtaacgttaccggaaccgggaaccgaccgaaacgtacggttagggaagttacaaactaacgttcgtagggttacggggtccgggtttggggttacgggttccggggacggggttaacggaaacccgtaaaggtcccggaacccggtttaccggacgggttaccgaaccggttaaccccggtaaccggg

SEQ ID NO: 310586 - DNA, 720 bp, Homo sapiens
  misc_feature: GZ8MTXP01B7NNE.21.22.B11.1.454.CMB.2.raw
  modified_base (200)..(200): a, c, t, g, unknown or other
  misc_feature (200)..(200): n is a, c, g, or t
  modified_base (262)..(262): a, c, t, g, unknown or other
  misc_feature (262)..(262): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctcggggacccccggnaggagggtcaccatctcttgttctggagcaactccaacatcggaataatatgtatctggtancagcaactccagactcggaccccaaatcctcactccagaagaataatcagcgcctgaccgggtccctgaccgtacttccgtacgtcggtaccctacccgaaaacgttcctcgggacctaccccgttacgaaccggtccccctaccccgttacggaaccccctaatttcccgaacgggtttccgggggacccgttccccggggttaacccgggaagggtaacgtgggtaacgggtccctaaggtaaccctttaagtttaaccgttggggtacgtaccgtaacgtacccggaaacggggaccgtaccaaaccggtagttaggggaacctaggaaacttaaacgtcgttggaacggggttccggggtttgggggttacggttccgggggacgggttacgggaacccgtaaaagtcggtaacccgttacgtacgggttactaaccggaacccgtaaccgggg

SEQ ID NO: 310587 - DNA, 659 bp, Homo sapiens
  misc_feature: GZ8MTXP01ASFU0.21.22.B11.1.454.CMB.2.raw
  modified_base (414)..(414): a, c, t, g, unknown or other
  misc_feature (414)..(414): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagcccaccctcagcgtctcgggacccccggcaggagggtcaccatctcttgttctggagcaactccaacatcggaaattaattatgtattctggtatcagcaactcccaggaactcggcccccaaactccctcactccagacggaaataatcagccggccctcgacggggtcccctggaccgtacttcctctggccttcccgaaaaggttcctggccaccgttccacgtccctccctgaaccctntcgtacggtcggtccgtccgggtacgaggagtcggaacggtcgttacgtaacttaacgttacgtggtacgtaccaagtacccggaaccggggaccaaccgaaacgtggtacgggtactacggaaccgaattcggtaggttaggggttcggggtttcgggggtcgggtaccggggacggggttaaccgggaaccctaaacggtccggtaacccgtaccggtacgggaccgtaacggccccgtaagg

SEQ ID NO: 310588 - DNA, 565 bp, Homo sapiens
  misc_feature: GZ8MTXP01BCPKF.21.22.B11.1.454.CMB.2.raw
  modified_base (198)..(198): a, c, t, g, unknown or other
  misc_feature (198)..(198): n is a, c, g, or t
  modified_base (263)..(263): a, c, t, g, unknown or other
  misc_feature (263)..(263): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctgggacccccggnagagggtcaccatctcttgttctggagcaactccaacatcggaagttaattatgtattctggtancagcaactcccaggatcggacccccaaatcctcatccagacgaataatcagcggccctgacgggtccctagacctacttctctggtcctccgaaacgtctggctacccgtcacgccctcctgacccatcaggtgggctccggtcgaaggactgaggctgactattacgtggtcgcactcgacgggccagtaacagtcgggaatcggaactaaatcgtgaagggtccgggttggggtcgttccgggggacggacggggacctaaaacgtggaacccgtcgttaagggccaacgccccgtaagg

SEQ ID NO: 310589 - DNA, 692 bp, Homo sapiens
  misc_feature: GZ8MTXP01CDSQ0.21.22.B11.1.454.CMB.2.raw
  modified_base (264)..(264): a, c, t, g, unknown or other
  misc_feature (264)..(264): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccacctcagcgtcgtcgggacccccggcaggacgggtcaccatctcttgttctggagcaactcaacatcggaattaattatgtattctggtancagcaactcccgaaggaactccggacccccaaactccctacactccaaggaaggaaataactccgaacggcccggccctacggaacggggtccctcggaccgtacttccgtacgtcggtcctaccgtaaagttccgtcggaccctaacccgttccgaccgtcccctaccccgttagaaacccctacgttccgaacgggtcggggtcccgtacccggggtaccggagggtaacttcggaacggtctacgtaacttacgttacgtgggtcgaccgtagtacccggaacgggaccacgaacgtaggttgggaactacggaaactaacgttcggtacgggttagggttccgggttgggggttcgttacggggcgggaacgggaacctaacggtcggtaacccgttcgaggttaccgaacgcccgtaaccggg

SEQ ID NO: 310590 - DNA, 627 bp, Homo sapiens
  misc_feature: GZ8MTXP01BTZKW.21.22.B11.1.454.CMB.2.raw
  modified_base (199)..(199): a, c, t, g, unknown or other
  misc_feature (199)..(199): n is a, c, g, or t
  modified_base (333)..(333): a, c, t, g, unknown or other
  misc_feature (333)..(333): n is a, c, g, or t
  modified_base (442)..(442): a, c, t, g, unknown or other
  misc_feature (442)..(442): n is a, c, g, or t
  modified_base (469)..(469): a, c, t, g, unknown or other
  misc_feature (469)..(469): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctgggaccccccggnagagggtcaccatctcttgttctggagcaactccaacatcggaagtaattatgtattctggtatcagcaactcccaggaatcggacccccaaatcctcatccagaggaatatcagcggccctcgacgggtcccngaccgtattcctcgtggcctccaaagtctggccaccctcacgtccctccctagaccctagtcgaggtcgggcctccgggtacgaggatggaggctgaacttattaccgngggtctcgaactccggaacggggaccnccgaaagtaggttacggggattacggaacctaaagttccgtgggttaacgggttccggggtttggggttacggttcgggggacgggttacgggaaccctaaaaggttccgggaaccccgtttcggtacggttaccgaaccgggttccccgtaaacggg

SEQ ID NO: 310591 - DNA, 700 bp, Homo sapiens
  misc_feature: GZ8MTXP01ENE6F.21.22.B11.1.454.CMB.2.raw
  modified_base (201)..(201): a, c, t, g, unknown or other
  misc_feature (201)..(201): n is a, c, g, or t
  modified_base (267)..(267): a, c, t, g, unknown or other
  misc_feature (267)..(267): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagcccaccctcagcgtcgtcgggacccccggnaggagggtcaccatctcttgttctggagcaactccaacatacggaattaattatgtattctggtancagcaactcccaggaactccggaccccaaactcctcactccagaaggaataatcgacgccggcctcgacgggtccctgacctattcctcgtggtcctacccgaaaagttcctcggccacccttcgacgtcccctcctacgaccctactcgaggtcggggaccttccgggtaccggaaggacgttgggaacggtctacggtaacttacgtttaaccgtggggtcggtacctacgtacccgggaaccgggggtaccaaccgtaaacgaggttagggggacttacggaaaccgttaaacgtccgttagggaacggggtttccggggtttgggggtcgggttacccggggacggggttaacgggaaaccccgtaaacggtcccgggtaaccccgttccggtaacgggttaccaacccgggttccccgttaaccgggg

SEQ ID NO: 310592 - DNA, 673 bp, Homo sapiens
  misc_feature: GZ8MTXP01B0CXX.21.22.B11.1.454.CMB.2.raw
  modified_base (233)..(233): a, c, t, g, unknown or other
  misc_feature (233)..(233): n is a, c, g, or t
  modified_base (259)..(259): a, c, t, g, unknown or other
  misc_feature (259)..(259): n is a, c, g, or t
  modified_base (419)..(419): a, c, t, g, unknown or other
  misc_feature (419)..(419): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccacctcagcgtcgtcgggaccccggcagagggtcaccatctcttgtctggagcaactcaanatcggaattaattatgtattctgtancagcaactccaggaactcgaccccaactcctacactcaagaacggaaataaacgtcaaggccggtcccgtacggaaccgggttccccgagtaacccgtatttcctcgttacggcctacccgtaaaagtcctcggcctaacctcaacgtccctacccgtanacctatcgacgggtcggtccgtaccgggacgaaggtacgtacgacggtactacgtacttaacgtttcgtagggtcgacgtaaccgtaccgggaaccgggacgaaccgaaacgtaggtaggactaagtaaactaaggtcggtagggttggggttcggggttcggggttaggtaccgggggacgggaaacgggttaaaccgtaaacggtcggtaaccggttaccgtagggttacccgaacgttaacccgggtaacg

SEQ ID NO: 310593 - DNA, 643 bp, Homo sapiens
  misc_feature: GZ8MTXP01BQJZ9.21.22.B11.1.454.CMB.2.raw
  modified_base (201)..(201): a, c, t, g, unknown or other
  misc_feature (201)..(201): n is a, c, g, or t
  modified_base (453)..(453): a, c, t, g, unknown or other
  misc_feature (453)..(453): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagcccaccctcagcgtcgtcgggacccccggnagagggtcaccatctcttgttctggaggcaactccaacatacggaagttaattatgtattctggtatcagcaactcccaggaactccggacccccaaatccctcactccagaaggaaataactcacgccggccctacggacgggtcccacgaccgtacttctcgtcggcctaccgaaacgtccttcggaccaccctacacgtcccctccgcgtacccatcgacggtcgggcctccggtcggaggctggacgntacgaacttacgttacgtcggtacgacgtacgtaccggaacgggacgacaacgagttagggatcgaactaagtccgtagggttacgggtcggtttggggtcgggttcggggacggggaaacggttacccgtaaacggtccggtaacccggttaccggtacggttaccgaaccggttaacccggaaccggg

SEQ ID NO: 310594 - DNA, 694 bp, Homo sapiens
  misc_feature: GZ8MTXP01AQK89.21.22.B11.1.454.CMB.2.raw
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctcgggacccccggcagagggtcaccatctcttgttctggagcaactccaacatacggaagtattatgtattctggtatcagcaactccgaaggaaactcggacccccaaactcctcactccaagaggaaatatcacgccggccctcgacggggtccctaggaccgtacttcctacgtcggtccctacccgaaaacgttccgtcgggaccctaccccgttcgaaccgtcccccttccccgtcggaaacccctacttacccggaacgggtttcgggggacccgtttccccgggggtacccgggaaggggtaccgttagggaaccgggtccttaaggaacctttacgtttaccgtgggttcggcctagtaccgacggggacacgaacagtgggatagacctaagtcgtaggacggtcggggtttgggtcggttccggggacgggttacggaaacccgtaaacggtccggtaacccgttcggtagggttacccaaccggttaacccgaacggg

SEQ ID NO: 310595 - DNA, 674 bp, Homo sapiens
  misc_feature: GZ8MTXP01BP2JQ.21.22.B11.1.454.CMB.2.raw
  modified_base (199)..(199): a, c, t, g, unknown or other
  misc_feature (199)..(199): n is a, c, g, or t
  modified_base (236)..(236): a, c, t, g, unknown or other
  misc_feature (236)..(236): n is a, c, g, or t
  modified_base (261)..(261): a, c, t, g, unknown or other
  misc_feature (261)..(261): n is a, c, g, or t
  modified_base (460)..(460): a, c, t, g, unknown or other
  misc_feature (460)..(460): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctcgggacccccggnagagggtcaccatctcttgtctggagcaactccaacntcggaataattatgtattctggtancagcaactcccaaggaactcggaccccccaaactccctacactccaaggacggaaataactcacgccggccctacgacgggggtccctgacccgtattcctctggcctccaaagtctggccacctcacgccctcctgacccatcgaggtcgggacctccgggtcgaggtactcggacgcttggaaccttagtttaccgnggggttcgacgtaacgttccggaaccgggggtaccaccgaaacgtaaggtgggggtaacttacggaaacctaaagttccggtagggttacggggtcggggttttcgggggtcggtttacccgggggacgggttaaacgggggttaacccctaaaacggttccgggtaaccccggtttcggtaacggggttcctaaccgggcccccgtaaagggg

SEQ ID NO: 310596 - DNA, 601 bp, Homo sapiens
  misc_feature: GZ8MTXP01E0FRS.21.22.B11.1.454.CMB.2.raw
  modified_base (471)..(471): a, c, t, g, unknown or other
  misc_feature (471)..(471): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctgggacccccgggcagagggtcaccatctcttgttctggagcaactccaacatcggaagtaattatgtattctggtatcagcaactcccaggaaactcggaccccccaaaactccctacactccaagaaggaaataatcagccggcccctgacgggggtcccctgaccgtacttctctggctccaaaagtctggccacctcacgtccctccctgaccatcaggtcggctccggtcgaggatggaggctagaacttattacctgggtcgactatcgaaccggggacncaaacaggtgggatggaaccaatcgtggagggtcggggtttaggggtcggttaccggggacggggaacgggaaccctaaacgtggtaaccccgtcccgtaggggttacccaacgggttcccccgaagggg

SEQ ID NO: 310597 - DNA, 617 bp, Homo sapiens
  misc_feature: GZ8MTXP01DCV74.21.22.B11.1.454.CMB.2.raw
  modified_base (198)..(198): a, c, t, g, unknown or other
  misc_feature (198)..(198): n is a, c, g, or t
  modified_base (586)..(586): a, c, t, g, unknown or other
  misc_feature (586)..(586): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctgggacccccggnagagggtcaccatctcttgttctggagcaactccaacatcggaattaattatgtattctggtatcagcaacctcccaaggaaactcggaccccccaaactcccctacactcccgaagaaggaaataatccacggccggtcccctcggacgggggttcccctggaacccgtattcctcgtggcctacccaaagttcctggccacccgtcacgcccctcctagaccctatcgaggttcgggccttccgggtaccggaggtacgtggacgggtctaggtaaccttattaccgtggggtacgctaagtcgaccgggacgcaaacgtagtgggtatgaactaagtcgtggaggtcgggtttagggtggttcgggaacgggcggaacctaacgngaacccgttcgaggttcaacggcccgtaagg

SEQ ID NO: 310598 - DNA, 709 bp, Homo sapiens
  misc_feature: GZ8MTXP01ATLTQ.21.22.B11.1.454.CMB.2.raw
  modified_base (200)..(200): a, c, t, g, unknown or other
  misc_feature (200)..(200): n is a, c, g, or t
  modified_base (253)..(253): a, c, t, g, unknown or other
  misc_feature (253)..(253): n is a, c, g, or t
  modified_base (266)..(266): a, c, t, g, unknown or other
  misc_feature (266)..(266): n is a, c, g, or t
  modified_base (496)..(496): a, c, t, g, unknown or other
  misc_feature (496)..(496): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtcgtcgggacccccggnaggagggtcaccatctcttgttctggagcaactccaacatcggaaattaattntgtattctggtancagcaactccgagatccgaccccaatcctcatccagaagaataatcgagccggcctgacggtcctgaccgtacttcctctcggtacctaccgtaaacgttcgtcggacctacccgtcgaccgtccccttacccgtacggaaccccagttccgaagggttccggggcccgtttcccggggtaccgaaggggtacttagggacgggtacctacgtaaccttaagtttaccgnggggtttacgacccgttagtaccccgggaaacgggggtccaaacccgtaacgaacgggttggggaacttacaaaccgtaaacgttccgggttaagggaccggggttttcggggtttgggggtacggggttaaccgggacgggggttaaacgggaaccccctaaaaggttcccggaaccggttccggtaacgggcctaacggcccgtaaccggg

SEQ ID NO: 310599 - DNA, 579 bp, Homo sapiens
  misc_feature: GZ8MTXP01BVLTF.21.22.B11.1.454.CMB.2.raw
  modified_base (199)..(199): a, c, t, g, unknown or other
  misc_feature (199)..(199): n is a, c, g, or t
  modified_base (396)..(396): a, c, t, g, unknown or other
  misc_feature (396)..(396): n is a, c, g, or t
  modified_base (422)..(422): a, c, t, g, unknown or other
  misc_feature (422)..(422): n is a, c, g, or t
  modified_base (447)..(447): a, c, t, g, unknown or other
  misc_feature (447)..(447): n is a, c, g, or t
  modified_base (464)..(464): a, c, t, g, unknown or other
  misc_feature (464)..(464): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctgggaccccccggnagagggtcaccatctcttgttctggagcaactccaacatcggaataattatgtattctggtatcagcaactcccaggaactcggaccccccaaatcctcactccagaggaataatcagccggccctcgacgggggtcccctggaccgtattcctcgtggcctccaaagtctggccaccctcagccctccctgacccntcgaggtcgggccttccgggcgaggntgaggctgactagttactggggtcncagtccgacggggaccncaacgtagtggggtataggaacaagtcgtggagggtcgggttaggggtcggttcgggacgggagggaccctaaagtcggaacccgttccgtaggttccaacggttccccgaaggg

SEQ ID NO: 310600 - DNA, 648 bp, Homo sapiens
  misc_feature: GZ8MTXP01EF4B7.21.22.B11.1.454.CMB.2.raw
  modified_base (200)..(200): a, c, t, g, unknown or other
  misc_feature (200)..(200): n is a, c, g, or t
  modified_base (474)..(474): a, c, t, g, unknown or other
  misc_feature (474)..(474): n is a, c, g, or t
  modified_base (573)..(573): a, c, t, g, unknown or other
  misc_feature (573)..(573): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtcgtcgggacccccggnagagggtcaccatctcttgtctggagcaactccaacatacggaattaattatagttattcgtaggtatcagactaacctccgaagactcggacccccaaactcctacataccagaagaatactcacgccgcctagaccgggtcctgaccgtactctcgtcggctaccgaaagtctggcctaacctcgacgtccctcccgtacgaccctagtcgtacgggtcgggccttccgggtacgaagggtacgtggacggtctgtaaccttaagtttccgngggtacgtacgacggttaccgacggggtaaccaccgtaaacgaaggttcgggaaatacggtaaacctaaagtcggtaggacggggtcgggttttggggngggttaccgggacgggttacgaacccgtaaagtcgggaacctcggtacgggttacaacccggttaaccgaaccgg

SEQ ID NO: 310601 - DNA, 725 bp, Homo sapiens
  misc_feature: GZ8MTXP01AGF1Z.21.22.B11.1.454.CMB.2.raw
  modified_base (199)..(199): a, c, t, g, unknown or other
  misc_feature (199)..(199): n is a, c, g, or t
  modified_base (264)..(264): a, c, t, g, unknown or other
  misc_feature (264)..(264): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctcgggacccccggnagagggtcaccatctcttgttctggaggcaactccaacatcggaagtaattatgtattctggtancagcaactcccaggaactcggacccccaaactcctcactccagaaggaataactcgagccggccctcgacgggggtcccctggacccgtatttcctcgtacggccctaccgaaaagttccgtgggaccctaacccgttcaccggtccccttaccccgtacggaacccctagttccgaacgggttcgggggcccttccccgggggtaccggaaggggtattcgggaacggggtccttacgggtaaacctttacgtttaaccgtgggggttacggaccctaagttacccgggaaaccgggggtaccaccaaacgtaggttcgggggaattacggaaacctaagttccggttgggaacgggttccggggtttgggggtacgttccgggggacggggttacgggaaccctaaacggtcggaaccccggttcgtaacggggttccaaccggttaaccccgaacggg

SEQ ID NO: 310602 - DNA, 732 bp, Homo sapiens
  misc_feature: GZ8MTXP01CWECT.21.22.B11.1.454.CMB.2.raw
  modified_base (178)..(178): a, c, t, g, unknown or other
  misc_feature (178)..(178): n is a, c, g, or t
  modified_base (200)..(200): a, c, t, g, unknown or other
  misc_feature (200)..(200): n is a, c, g, or t
  modified_base (216)..(216): a, c, t, g, unknown or other
  misc_feature (216)..(216): n is a, c, g, or t
  modified_base (275)..(275): a, c, t, g, unknown or other
  misc_feature (275)..(275): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccacctnagcgtcgtcgggacccccgganagacgtcactatcttnttgtcgtaggacgacaactacaatagtacggtaaattaattagtagttattcgtagtanacacgacctaacctaccgaaggtaacgtacccggaaccccctaaacctccctactaactaccgaaaggaaacggtaaactaacgtaccgaacgggcccggtacccgtacggaccgggttacccgtacgtaaccgtacttccgtcgtacgtacctaccgaaacgttcgcggtacctaccctacaccgtccctaccctacgaacctactacgtacgggtccgggtccgtaccgggtaccggaaggacgtaggacggtacgtacgtaacgttacgttacgtgggtcgacgtacgtacggaccgggaacgaacgtaagacggtaggaacgtacgaactaacgtcgtagggttacggggttcgggttaggggttacggtacggggaccgggaacgggaaacctaaacgggtaccggtaacccggttaccggtacgggacccgtaaccggaacccggtaacgg

SEQ ID NO: 310603 - DNA, 770 bp, Homo sapiens
  misc_feature: GZ8MTXP01C7LFS.21.22.B11.1.454.CMB.2.raw
  modified_base (241)..(241): a, c, t, g, unknown or other
  misc_feature (241)..(241): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagcccaccctcagcgtcgtcggggacccccggcaggagggtcaccatctcttgttctggaggcaactccaanagtacggaagttaattatgttattcgtggtatcagccaactcccaaggaactccggaccccaaactccctcaactccaagaagaaatatcgacgccgccctggaccgggtccctgaccgtacttcctacgtggtccctaccgaaacgttccgtcgggaccctaccctacgacccgtcccctccccgttagaaccccgtactaccgtacgggttccggggtcccgtaccccggggttacccgggaaacgggtagttaccgggtaacgggtaccgttaacgtaactttaacgtttaacccgttggggttacgtaccgtaacgttaccgggaaacccgggaacgtaaccgaaacgtaagggtgggtaaacgtaccgaaacgttaaaccggttcggtaaggggttcgggtttaccgggggttggggtttaccggggttaccgggggaaacgggttaccgggttaaaacccttaacgggtaccgtaacccggttaacggtaccgggttacgtaacccggaacccggtaacccgg

SEQ ID NO: 310604 - DNA, 793 bp, Homo sapiens
  misc_feature: GZ8MTXP01B0PFT.21.22.B11.1.454.CMB.2.raw
  modified_base (200)..(200): a, c, t, g, unknown or other
  misc_feature (200)..(200): n is a, c, g, or t
  modified_base (440)..(440): a, c, t, g, unknown or other
  misc_feature (440)..(440): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtcgtcgggacccccggnagagggtcaccatctcttgtctggagcaactcaacatacggaattaattagtgttattctggtatcagacaacctcccaggaactccggaccccaaactcctacactaccgaagtaaggaaataactccgaggacccggtccccgttacggaccgggggtccctacggaaccgtacttccgtcgtcggccctacgaaaagttcctaaggccctaaccgttccacggtccccttccccganaacccctattccgaacgggtcgggtaccccgttcccgggttacccgggaacgggttaagtcgggaaccggggtacttaacgggttaaaccgtttattttaaacccgggtacgggggtacgtaacccgtaaaccgtacccgggtaacccggggaaccgaaccgtaaacggttagggttaacgggtaacttaaccgaaacgtaaacgttcggtaacgggttaacgggtacggttagggggttttcggggtaaccgggttaccgggggttaacggggaaacccggtaaaacccgtaaccgtaaccgggtaaccccggttaccggttaaccggtaacccggaacccggtaaccccgg

SEQ ID NO: 310605 - DNA, 696 bp, Homo sapiens
  misc_feature: GZ8MTXP01EJMNK.21.22.B11.1.454.CMB.2.raw
  modified_base (202)..(202): a, c, t, g, unknown or other
  misc_feature (202)..(202): n is a, c, g, or t
  modified_base (241)..(241): a, c, t, g, unknown or other
  misc_feature (241)..(241): n is a, c, g, or t
tcagtcgtcgctcgcacgaccggtgctcgatttagacgacagctcaggggagcttcagctgtggtagagaagacaggactcaggacaatctccagcatggccggcttccctctcctcctcacccctcctcactcactgcgcagggtcctgggcccagtctgtgctgactcagcccaccctcagcgtcgtcgggacccccggnaggacgggtcaccatctcttgttctggagcaactccaanatacggaattaatatgttatctggtatcagacaactcccgaggaatccggaccccctaaactccctcactaccagaagaaatatcgacgccgcctgacgggtcctgaccgtacttcgtctggcctacgaaacgtctcgggccctacctccacgtcccctccctgaaccctgtcgaggtcgggactcccgggtcgaacggatggaacggtctacgaacttattacgttggggtacgacgtacgtcccggaaacggggaccaacgtaaacgtacgggttaggggaaacttaacggaaacctaaacgttaacggtgggggttaaacggggttccgggggttttaaggggtcggggtttacccgggggaacgggttaaccggggttaaaacccctaaacgggtccggtaaacccggttcccgggttaaggttacccgtaaccgggaaccccgtaacggg

SEQ ID NO: 310606 - DNA, 776 bp, Homo sapiens
  misc_feature: GZ8MTXP01AIFH1.21.22.B11.1.454.CMB.2.raw
  modified_base (199)..(199): a, c, t, g, unknown or other
  misc_feature (199)..(199): n is a, c, g, or t
  modified_base (263)..(263): a, c, t, g, unknown or other
  misc_feature (263)..(263): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctcgggacccccggnagagggtcaccatctcttgttctggagcaactccaacatcggaagtaattatgtattctggtancagcaactcccgaggaactcggacccccaaactcctcactccagaggaaataatcagccggcccctgaacgggggtccctacggacccgtactttccgtcgtacgggtcccttacccgaaaacggttcccttcggggaccctaaccccctttaccgaacccgggtccccccttacccccgttacgggaaaccccctaacgttcccggtaaccggggttaccgggggtccccgtttaccccgggggaccccgggtaaaggggacgtttacggggaaacggggtccttacgggtaaacctttaacgtttaaccggttcgggggttacggacccgtaagttaccccgggaaacgggggtaccggacccttaaaacggacggttagggggaacttacggaaacctaagtccgtaagggttacgggtcggggtttagggttcgggttcgggacgggttacggggaaccctaaacgttcggaacccgtacgtaccggacgtaaccggccccgtaacggg

SEQ ID NO: 310607 - DNA, 600 bp, Homo sapiens
  misc_feature: GZ8MTXP01A55B0.21.22.B11.1.454.CMB.2.raw
  modified_base (198)..(198): a, c, t, g, unknown or other
  misc_feature (198)..(198): n is a, c, g, or t
  modified_base (475)..(475): a, c, t, g, unknown or other
  misc_feature (475)..(475): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctgggacccccggnagagggtcaccatctcttgttctggaggcaactccaacatcggaagtaattatgtattctggtatcagcaactcccaggaatcggaccccccaaactccctacactccaagaggaaataatcagccggccctcgacgggggtcccctgacccgtacttcctcgtcggccctcccgaaaagttcctcggcccaccctcacgtccctccctgacccatcaggtcgggctccggtccgaggctgacggctagacttattacgtggtgcatccgacgggcncaacgagtgggactaggaaccaatccgtgggaggtcgggtttgggggtcgttccggggacggggttacgggaacccctaaagtccggtaacccgttcccgtagggccaacggccccgaaacgggg

SEQ ID NO: 310608 - DNA, 744 bp, Homo sapiens
  misc_feature: GZ8MTXP01C9HZ8.21.22.B11.1.454.CMB.2.raw
  modified_base (200)..(200): a, c, t, g, unknown or other
  misc_feature (200)..(200): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcacgccacctcagccgtcgtcgggaccccggnaggaggtcacatctcttgttctggagcaactccaacagtacggaattaattatagttattcgtaggtactcacgacaacctacccgaaggtaactccggaaccccctaaactccctacactaccgaaggaaggtaaactaacgtaccgacgggtaccccggccccgttacggtaccgggggttcccctacggtaacccgttaccgtttccgttcgtacgggtacccttacccgtaaaaggttcccgtcggaccctaccgtaccgaccgtcccctaccgtacgaaccctacttacggacgggtccgggaccgttccgggtacgaggtagtcggaacggcttaagtacttacgttacgtgggtacacgtaacgtaccgggaacgggaccgaacaaacggtaggttcgggaattacgaaacgtacgttaacggtgggttacgggttcgggggttcgggttacgggttaaccgggacgggttaaacggaacccgtaacgtcccggtaaccgtacgggtacgttaccgtaaccggaacccgtaaccggg

SEQ ID NO: 310609 - DNA, 633 bp, Homo sapiens
  misc_feature: GZ8MTXP01ARM5U.21.22.B11.1.454.CMB.2.raw
  modified_base (202)..(202): a, c, t, g, unknown or other
  misc_feature (202)..(202): n is a, c, g, or t
tcagtcgtcgctcgcacgaccggtgctcgatttagacgacagctcaggggagcttcagctgtggtagagaagacaggactcaggacaatctccagcatggccggcttccctctcctcctcacccctcctcactcactgcgcagggtcctgggcccagtctgtgctgactcagccaccctcagcgtcgtcgggaccccccggnagagggtcaccatctcttgttctggaggcaactccaacatcggaagtaattatgtattctggtatcagcaactccaggaatcggacccccaaatcctcatccagagaatatcagccggcctcgagggtcccctgaccgtattcctcgtggcctaccgaaagtcctcggccaacccgtcacgtcccttcccgagacccatcgacggttcgggcctcccgggtcggacggtagtcggacggccgttagtaaccttagttaccgtggggtgaccgtagtaccgaaccggggacacctaaacgagttcggggattcgaaaccgtaatcgtagggaaggtccggggtttgggacgggtttcggggaccgggttaaggaacccgtaacgtccggtaaccgttacgtacggttacgaaccggttaacccgtaaccggg

SEQ ID NO: 310610 - DNA, 568 bp, Homo sapiens
  misc_feature: GZ8MTXP01CQKYT.21.22.B11.1.454.CMB.2.raw
  modified_base (199)..(199): a, c, t, g, unknown or other
  misc_feature (199)..(199): n is a, c, g, or t
  modified_base (451)..(451): a, c, t, g, unknown or other
  misc_feature (451)..(451): n is a, c, g, or t
  modified_base (457)..(457): a, c, t, g, unknown or other
  misc_feature (457)..(457): n is a, c, g, or t
  modified_base (497)..(497): a, c, t, g, unknown or other
  misc_feature (497)..(497): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctcgggacccccggnagagggtcaccatctcttgttctggagcaactccaacatacggaagtaattatgtattctggtatcagcaacctcccaggaactccggaccccctaaactcctacactccgagaaggaataatcacgcggccctgacgggtccctgacctacttctcgtggcctccgaaaagttcctggcctaaccctcacgcccctcctcgaccatcgaggtcgggctccgggtccgaaggtatggagctagactattcgnggttcnctacgtcgaccgggtacacaacaggtggatgaactagtcngggacgtcggggttgggtcgtcgggcggttacgggacctaaaggcgaaccgtcgtggactcgcccgtaagg

SEQ ID NO: 310611 - DNA, 714 bp, Homo sapiens
  misc_feature: GZ8MTXP01AL2X6.21.22.B11.1.454.CMB.2.raw
  modified_base (265)..(265): a, c, t, g, unknown or other
  misc_feature (265)..(265): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagcccaccctcagcgtcgtcgggacccccggcagagggtcaccatctcttgttctggagcaactccaacatcggaagtaattatgtattctggtancagacaactcccgaaggtaactccggaccccccaaactccctacactaccgagaacggaaataactcgaacgggcccggtccccttacggaccgggggtcccctacggaccgtacttcctcgtcggccctacctaaacgttccgtcgggcctaacccgttcgaccgtcccctacccctagaccctagtcgacggggttccgggccgttaccccgggtcggaaggggtactaggggtaccgggtacttacggtaaacttacgttttaccggtggtacgacctaacgtacccgggaacgggaccaacgtaacggtaggtacggaatacgaactacgtcggtagggttcggggttccggggttgggtacgggtcccggggacgggttaaccggttaacctaaccgggtccgtaacccggttacgtacgggaccaaccggttaacccgaacgg

SEQ ID NO: 310612 - DNA, 620 bp, Homo sapiens
  misc_feature: GZ8MTXP01BWKGT.21.22.B11.1.454.CMB.2.raw
  modified_base (199)..(199): a, c, t, g, unknown or other
  misc_feature (199)..(199): n is a, c, g, or t
  modified_base (223)..(223): a, c, t, g, unknown or other
  misc_feature (223)..(223): n is a, c, g, or t
  modified_base (497)..(497): a, c, t, g, unknown or other
  misc_feature (497)..(497): n is a, c, g, or t
  modified_base (504)..(504): a, c, t, g, unknown or other
  misc_feature (504)..(504): n is a, c, g, or t
  modified_base (539)..(539): a, c, t, g, unknown or other
  misc_feature (539)..(539): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctgggacccccgggnagagggtcaccatcttctttttcnggagcaactccaacatcggaagtaattatgtattctggtatcagcaactcccaaggactcggacccccaaatcctcatccagagaataatcagccggccctcgacggggtccctaggaccgtatttccctcgtcggtcctcccgaaagttcccttcgggcctacccgtacgacgtcccctcccgtcgaccctatccaggtcgggctccgggtaccgaggtagtcggaggtcctagtactattacgtgtggacgtagtccgaacgggacgcaacngtagggntagactaagtcgtaaggtacggttcggggttaggnggtttccggggcgggttaacgggttccaaaaccgtgtaccccggtccgtaaggggtccaccggccccgttaagggtccccg

SEQ ID NO: 310613 - DNA, 773 bp, Homo sapiens
  misc_feature: GZ8MTXP01CVSYA.21.22.B11.1.454.CMB.2.raw
  modified_base (200)..(200): a, c, t, g, unknown or other
  misc_feature (200)..(200): n is a, c, g, or t
  modified_base (271)..(271): a, c, t, g, unknown or other
  misc_feature (271)..(271): n is a, c, g, or t
  modified_base (323)..(323): a, c, t, g, unknown or other
  misc_feature (323)..(323): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtcgtcgggacccccggnaggagggtcaccatcttcttgttctggaggcaaactccaacatacggaaagttaattatgtattcgtgtancagcaactccaggaactccggaccccaaactcctacactccaagagaataancagccggcctacgacgggtccctgaccgtacttcctcgtcggcctaccgtaaacgttccgtcggccctacccgtaccgaccgtcccctacccgtacgaacccctagttaccgacggtcggggtcccgtcccgggtacccggtaagggtacgtcgggtaacgggtaccttacgtaaaccgtttacgtttaacggtcggggttaacggtaccgttaaccggttacccggggaaaccgggggtaacccggtaacccaaaacggttaagggttaccggggtaatttaccggaaaccgtaaagtttcggtaaacgggttggggtttaccggggtttggggttaccggggtttcgggaaccgggggttaaacgggttaaacccgtaaaacggttccgggtaaccccggttaccggtaacgggttacccgtaacccgggaacccggtaaacccgggg

SEQ ID NO: 310614 - DNA, 677 bp, Homo sapiens
  misc_feature: GZ8MTXP01EEZBQ.21.22.B11.1.454.CMB.2.raw
  modified_base (229)..(229): a, c, t, g, unknown or other
  misc_feature (229)..(229): n is a, c, g, or t
  modified_base (357)..(357): a, c, t, g, unknown or other
  misc_feature (357)..(357): n is a, c, g, or t
tcagtcgtcgctcgcacgaccggtgctcgatttagacgacagctcagggggagcttcagctgtggtagagaagacaggactcaggacaatctccagcatggccggcttccctctcctcctcaccctcctcactcactgcgcagggtcctgggcccagtctgtgctgactcagcccaccctcagcgtcgtcgggaccccccggaggagggtcaccattcttctttttcgnggaggccaactccaacatacggaaagttaattatgtattctggtatcagcaactcccaagatcgacccccaatccacatccaagagaatactcagcccgcctcgacgggtccctgaccgtacttcccncgtcggccttaccaacgttcctgggccctacctccgaaccgtcccctaccccgtagaccctactaccgtacgggtcggggtccgtacccggggttaccgagggtaacgtcgggaacggtccctagtaacccttagtttaccgtggtacggaccttacgtaccggaaccggggaccaccgaaacgtaggtagggtactacggaactaacgtcgtgggacgggttcggggttagggttggtaccgggacgggttaacggaacccgttaaacgtcggacccggttaaccggagtacccgccggtaacccgttaacgggtcccc

SEQ ID NO: 310615 - DNA, 780 bp, Homo sapiens
  misc_feature: GZ8MTXP01EF0GP.21.22.B11.1.454.CMB.2.raw
  modified_base (201)..(201): a, c, t, g, unknown or other
  misc_feature (201)..(201): n is a, c, g, or t
  modified_base (238)..(238): a, c, t, g, unknown or other
  misc_feature (238)..(238): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctggcccagtctgtgctgactcacgcccaccctcagcgtcgtcgggacccccggnagagggtcaccatctcttgttctggagcaactccaanatacggaatattatgtattcgtagtatcagccaactcccgaaggaactccgaccccctaaatcctacactaccgaagtaaaggtaaactaactcgacggacccggtcccctacggtaccggggtcccctaggacccttacttccgtcgtacggtccctacccgaaaagttccgtcggaccctaaccccgttcacccggtccccttcccgtacgaaacccctgttacgaacgggtcgggtcccttaccggggtacccgaaagggtaacgttgggacgtaccgtagttaaactttaaacgtttaccgtggggttaggaccccttaaagtacccgggaaaccgggggaacaaacccgtttaaagaggtacggggttaaaatacgtaaacgtaacgtaacggtacgggttacggggttacggggtttacggggttacggggttaccggggttaaccggggttaaccgggttaaacccggtaaaccggtaaccggtaacccggtaccggtaccggttaccggtaacccggttaacccggtaacccgg

SEQ ID NO: 310616 - DNA, 780 bp, Homo sapiens
  misc_feature: GZ8MTXP01EQ6K2.21.22.B11.1.454.CMB.2.raw
  modified_base (138)..(138): a, c, t, g, unknown or other
  misc_feature (138)..(138): n is a, c, g, or t
  modified_base (203)..(203): a, c, t, g, unknown or other
  misc_feature (203)..(203): n is a, c, g, or t
  modified_base (295)..(295): a, c, t, g, unknown or other
  misc_feature (295)..(295): n is a, c, g, or t
tcagtcgtcgctcgcacgaccggtgctcgatttagacgacagctcagggtggggtcaaaaacccggggagggggtctgatttgcatggatggactctcccctctcagagtacgaagagagggagagatcgtggggaanctcagcttcagctgtggtagagaagacaggactcaggacaatctccagcatcggccgcttccctntccctcctcaccctcctcactcactgcgcagggtcctgggcccagtctgtgctgactcacgcccacctcagccgtcgtcggggacccccggnacggacggtccacctattctcgtttgttccgtggacggactaacctaccgaaactagttacggaaattaatttagtcgttattcgtacggtaccagaccgagtcccgtacccgaaacgggtaaaccccgtaacccccctaaaacttcccctactaacttacctaaagttaaacggaaacttaacgtaccgaacggttccccgggaccccgttaccgggtaaccgggggttccccctacgggtaaccccggttaactttccccgttaccgggtttccggggtaccctttaccccgtaaacgttttcccggtacgggccccttaaaccccttccgtaacccggtccccctttaccccggttcgggccctaaacgttcccggttaacgggttccggggttcccgtaccccggggttacccggaagggttcgtttcggggaacggtccgttaagggttaactttacgtttaccggtggttcggtaaccg

SEQ ID NO: 310617 - DNA, 749 bp, Homo sapiens
  misc_feature: GZ8MTXP01AKBUG.21.22.B11.1.454.CMB.2.raw
  modified_base (202)..(202): a, c, t, g, unknown or other
  misc_feature (202)..(202): n is a, c, g, or t
  modified_base (272)..(272): a, c, t, g, unknown or other
  misc_feature (272)..(272): n is a, c, g, or t
  modified_base (327)..(327): a, c, t, g, unknown or other
  misc_feature (327)..(327): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcacgcccaccctcagcgtcgtcgggacccccggnaggacgggtcacctatctcttgttctggacgcaactaccaacatacggaaattattatgtattcgtgtancagcaactccaggaactccggacccccaactcctacactaccaagaacgaataancgacggcccggcccgtacggacgggggtcccctacggtaaccgtacttccgtcgtcggtacccttaccgtaaaacggttcccgtcgggtacccaaccccttcgtaaccccggtcccccttacccccgttacggaaaccccttacgttacccggtaacggggttcccggggtacccgtttccccgggggtaaccggtaaggggtaacgttcgggaaccgggttaccgttacggttaaacttaacgtttacgtcgggtcgaacgtacgtaccgggaaccggacgaccgaagacggtggtaatacgaactagtcgtagggacgggttcgggtttggggtcggttaccgggacggggttaaacgggttaaccctaaacgggtccggtaaccgtaccggtacgggttactaaccggcccggtaacgg

SEQ ID NO: 310618 - DNA, 758 bp, Homo sapiens
  misc_feature: GZ8MTXP01A24LU.21.22.B11.1.454.CMB.2.raw
  modified_base (237)..(237): a, c, t, g, unknown or other
  misc_feature (237)..(237): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtcgtcgggacccccggcagagggtcaccatctcttgttctggagcaactccaanatcggaagttaattatgtattctggtatcagcaactcccaggaactcggacccccaaactccctcactccagaggaataatcacgcggccctcgacggggtccctaggacctactttcctacgtcggtccctacccgtaaaacgttccgttcgggcctaaccccgttaccgaaccggtccccttaccccgtacgtaaacccctaccgtttccgaacgggttcggggtaccccgttacccccgggggtaccggtaaaccgggggtaatcgggtaaaccgggggtccttacggtaacccgtttaacgttttaccccgttaagggggtcgttccgtaacggttacccggaaccgggggtaccaccggtaaaccgtagggtacggggtagttaacgaccgtaaacgttcgtagggttaacgggttccgggggtttggggtcggggttacgggacggggttacggaaccctaaaggtccgtaaccggttacccgtagggttccaaccggttaacccggtaaccggg

SEQ ID NO: 310619 - DNA, 683 bp, Homo sapiens
  misc_feature: GZ8MTXP01DEB5U.21.22.B11.1.454.CMB.2.raw
  modified_base (202)..(202): a, c, t, g, unknown or other
  misc_feature (202)..(202): n is a, c, g, or t
  modified_base (348)..(348): a, c, t, g, unknown or other
  misc_feature (348)..(348): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtcgtcggggacccccgggnaggagggtcaccatctcttgttctggaggcaactccaacatacggaataattatgtattctggtatcagcaactcccaaggaactccggacccccaaactcctcactccaagaggaaataactcgagccggcctcgacgggtcccngaccgtacttctcgtcggcctaccaaacgttctcggcctacctccgacgtcccctcccgtacgaccctagtcgacgggtcgggccgtccgggtaccggaggtacgtcggaacgtcgtacgtaacttacgttacgtgggtcgacgtaacgtaccggaaccggggacaccgaaacgtaacggtcgggtaattacggaaactaacgttcgtaggacgggggttcgggtttagggggttcggttaccggggacggggttaacgggttaaaccccgtaaaggttaccgggaacccggtttaccgtacggggttacctaaccgggaaccccgtaaccgggg

SEQ ID NO: 310620 - DNA, 626 bp, Homo sapiens
  misc_feature: GZ8MTXP01ESC8S.21.22.B11.1.454.CMB.2.raw
  modified_base (201)..(201): a, c, t, g, unknown or other
  misc_feature (201)..(201): n is a, c, g, or t
  modified_base (468)..(468): a, c, t, g, unknown or other
  misc_feature (468)..(468): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagcccaccctcagcgtcgtcgggacccccggnagagggtcaccatctcttgttctggagcaactccaacatacggaataattatgtattctgtatcagcaactcccaggaactcggacccccaaactcctcataccagagaaataatcagccgcccgtcgacggggtccctagaccgtacttccgtctggcctaccgtaaagttcctcggcctaccctcgacgtcccctaccctgaccctatcgacgggtcgggcctacccgggtccgaaggactggacgcgtagtaacttattaacgnggtcgactaacgtcgaaccgggaccgaccaaagtaggtgggaactacgaactaaacgttcgtgggttaacgggtcggggttttcgggacgggtttcgggaacggggttacgaaacccgtaaagtcgaacccgttcggagttccgaacgttcccgaacg

SEQ ID NO: 310621 - DNA, 652 bp, Homo sapiens
  misc_feature: GZ8MTXP01DWUT9.21.22.B11.1.454.CMB.2.raw
  modified_base (201)..(201): a, c, t, g, unknown or other
  misc_feature (201)..(201): n is a, c, g, or t
  modified_base (265)..(265): a, c, t, g, unknown or other
  misc_feature (265)..(265): n is a, c, g, or t
  modified_base (293)..(293): a, c, t, g, unknown or other
  misc_feature (293)..(293): n is a, c, g, or t
  modified_base (324)..(324): a, c, t, g, unknown or other
  misc_feature (324)..(324): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtcgtcggggacccccggnagagggtcaccatctcttgttctggagcaactccaacatcggaagttaattatgtattctgtancagcaactccagactcgaccccaatccnactcagagaatatcagcgcctgacgggtccngaccgtattctcgtggcctaccgaaagtctggcctaacctcacgtccctccctgaccctatcgaggtcgggcctccgggtacgaaggtatgagggtcctgaactttacttaccgtgggtacgaccgtacgttaccggacggggtaaacccacgtaaacgtaggttaggggaaacttacgaaccgtaaagttccggtaaaggggttcgggttccggggggttttagggtacggggtttccggggaaaccggggttaacgggttaaacccctaaaacgggtcggtaaccccgtttcggaacggttccgaaacccggcccggtaaacccgg

SEQ ID NO: 310622 - DNA, 621 bp, Homo sapiens
  misc_feature: GZ8MTXP01CZDD5.21.22.B11.1.454.CMB.2.raw
  modified_base (344)..(344): a, c, t, g, unknown or other
  misc_feature (344)..(344): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagcccaccctcagcgtctcgggacccccgggcagagggtcaccatctcttgttctggagcaactccaacatcggaagtattatgtattctggtatcagcaactcccaggaactcggccccaatcctcactccagagaatatcagcggccctgacgggtcctgaccgtacttctcnggctccgaaacgtctggccacctcacgccctccctgacccatcgagtcgggcctccgggtaccgaggactgacgggctagacttattaccgtggtacgactacgtaccgaccggggaaccacgtaaacgtagtcggggattacgaaacgtaactcggtaagggacgggttacggggttggggttacggttccgggggacgggttaccggggaaccctaaacggtccggtaacccgggttcccgtaacggggttacaacccgggttccccgtaacggg

SEQ ID NO: 310623 - DNA, 635 bp, Homo sapiens
  misc_feature: GZ8MTXP01CQI4P.21.22.B11.1.454.CMB.2.raw
  modified_base (200)..(200): a, c, t, g, unknown or other
  misc_feature (200)..(200): n is a, c, g, or t
  modified_base (262)..(262): a, c, t, g, unknown or other
  misc_feature (262)..(262): n is a, c, g, or t
  modified_base (292)..(292): a, c, t, g, unknown or other
  misc_feature (292)..(292): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtcgtcgggacccccggnagagggtcaccatctcttgttctggagcaactcaacatcggaagtaattatgtatctggtancagcaactccagactcggaccccaactccncactccagagaataatcagccgcctgacgggtccctgaccgacttctcgtggcctaccaaagttctcggccacctcaccgccctccctcgaccctagtccaggtcgggcgtacccgggtaccgaggtactcgggaacggccttaggtaaccttaagtttacgtcggggttacgtaccgtaaacgttccggaacggggaacccaacgaaaccgtaggttacggggaattacgaacgtaaagtcgtaagggacggttcgggttggggtcggttacggggacggttacgggaaccctaaagtccggtaacccgttcgtacgggttaccgtaaccgcccgtaacggg

SEQ ID NO: 310624 - DNA, 678 bp, Homo sapiens
  misc_feature: GZ8MTXP01BI095.21.22.B11.1.454.CMB.2.raw
  modified_base (201)..(201): a, c, t, g, unknown or other
  misc_feature (201)..(201): n is a, c, g, or t
  modified_base (261)..(261): a, c, t, g, unknown or other
  misc_feature (261)..(261): n is a, c, g, or t
  modified_base (457)..(457): a, c, t, g, unknown or other
  misc_feature (457)..(457): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtcgtcgggaccccccggnagagggtcaccatctcttgttctggagcaactcaacatcggaatattatgtattctgtancagcaactccgagactccggacccccaatcctcactccgagagaatatcagccgccctcgacgggtccctgaccgtacttcctcgtggccctaccgaaacgtctcggccaccctcaccgtccccttcccagaccctatcgacggtcgggcctccgggtacgaggtagtggacggtctagtaaccttagtttaccgngggttacgactaacgtaccggaaaccgggaccgacgaaacgtaaggttggggaacttacgggaaactaacggttccggttagggttacggggttccggggtttggggttcgggttaccgggggaaccggggttaaccggggttaaaccccgtaaacgggttccggaaccccgggtttccggtaacgggttacccgtaaccggttaaccccggtaaccgggg

SEQ ID NO: 310625 - DNA, 746 bp, Homo sapiens
  misc_feature: GZ8MTXP01C73A3.21.22.B11.1.454.CMB.2.raw
  modified_base (198)..(198): a, c, t, g, unknown or other
  misc_feature (198)..(198): n is a, c, g, or t
  modified_base (707)..(707): a, c, t, g, unknown or other
  misc_feature (707)..(707): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccacctcagcgtcgtcgggaccccggnagacggtcaccatctcttgttctggagacaactaccaactagtacggaagttaattatgttattcgtaggtatcacgcaactcccgaggaactccgacccccaaactcctacactccgaagaaggtaaataactccgacggcccggaccccgtacggtaccgggggtcccctagaccccgttaacgttccttacgtcgggtacctacccgtaaaacgttccgtcggacctacccttacgacccgtcccctaccctacggaaccctagtttcccgaagggtcccggggaccttccccggggtacggaaacgggtacttagggaaccggggtctacgggtaacctttacgttttaacggcggggtttacgaaccgtacgttacccggggaacgggggtaacccacgtaaagtaacgggttacggggaattcggaaactaacgtttcggaaggttcgggttaccggggtttgggtacgggttccggggacgggttaacgaacccgttaaacnccggtaaccgtcggtaacgccgaacgttcccccgtaagg

SEQ ID NO: 310626 - DNA, 624 bp, Homo sapiens
  misc_feature: GZ8MTXP01AWCWX.21.22.B11.1.454.CMB.2.raw
  modified_base (200)..(200): a, c, t, g, unknown or other
  misc_feature (200)..(200): n is a, c, g, or t
  modified_base (257)..(257): a, c, t, g, unknown or other
  misc_feature (257)..(257): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagcccaccctcagcgtctcgggacccccggnagagggtcaccatctcttgtctggagcaactcaacatcgaataatatgtatctgtancagcaactccgagactccgaccccaatcctcatccagaagaataacgtcacggccgcctcggaccgggtccctaggaccgtacttccgtacgtcggtaccctaccgtaaacgtcgtcggccctaccgtccgacccgtccccttacccgtacgaaccctacgtcgtacggtccgggtccgtcccggtaccggaggtacgtggacgtcgtagacttagtacgtggtagactacgaccggacgggaccacgaacgtaggtacggatacgaactagtcggtggagggttcggttaggggttcggtcggggacggacggaacccgtaagtccggtaaccgtcggtacggttacaaccggttccggtaaccgg

SEQ ID NO: 310627 - DNA, 628 bp, Homo sapiens
  misc_feature: GZ8MTXP01BZXWV.21.22.B11.1.454.CMB.2.raw
  modified_base (203)..(203): a, c, t, g, unknown or other
  misc_feature (203)..(203): n is a, c, g, or t
  modified_base (540)..(540): a, c, t, g, unknown or other
  misc_feature (540)..(540): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagcccaccctcagcgtcgtcgggaccccccgggnaggagggtcaccatctcttgttctggagcaactccaacatcggaattaattatgtattctgtatcagcaactccaggaactcggacccccaaactcctcactccagagaataatcagccggccctcgacgggtccctagaccgtatttccacgtcggccctaccgtaaagtccgtcggccacccgtcacgccccctcccgtgaccctatcgacggttcgggccttcccggggtacgagggtactggacggtctagtacttaagttccgtggggtacgccaagtcccggaacggggcacaaacgtagtgggaacttaggacctaagtccgttaggggngggttcggggttgggtacgggtcgggacgggttacggaacccgtaagtccggtaaccggtccgtaggaccgaaccggttcccgtaacg

SEQ ID NO: 310628 - DNA, 597 bp, Homo sapiens
  misc_feature: GZ8MTXP01BLUEO.21.22.B11.1.454.CMB.2.raw
  modified_base (199)..(199): a, c, t, g, unknown or other
  misc_feature (199)..(199): n is a, c, g, or t
  modified_base (236)..(236): a, c, t, g, unknown or other
  misc_feature (236)..(236): n is a, c, g, or t
  modified_base (261)..(261): a, c, t, g, unknown or other
  misc_feature (261)..(261): n is a, c, g, or t
  modified_base (292)..(292): a, c, t, g, unknown or other
  misc_feature (292)..(292): n is a, c, g, or t
  modified_base (326)..(326): a, c, t, g, unknown or other
  misc_feature (326)..(326): n is a, c, g, or t
  modified_base (404)..(404): a, c, t, g, unknown or other
  misc_feature (404)..(404): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctgggacccccgggnagagggtcaccatctcttgttctggagcaactccaanatcggaataattatgtattctgtancagcaactcccaggatcggaccccaactccncatccagagaataatcagcgcctgacggggtccnggacctacttcctcgtgctccaaacgtctggcacctcacgccctcctgaccctatcaggtcggccttccggtcgaggntggacggctcgaacttattaccgtggtcgactacgtccggaacgggaccgacgtaaacgagtgggattacggaacctaagtccgtggacgggtcgggtttcggggtcggttccggggacggggacgggttaaaccctaaacggtcggtaacccgttaccgtagggttacccgaaccgttcccggtaaaccggg

SEQ ID NO: 310629 - DNA, 764 bp, Homo sapiens
  misc_feature: GZ8MTXP01EXF0I.21.22.B11.1.454.CMB.2.raw
  modified_base (201)..(201): a, c, t, g, unknown or other
  misc_feature (201)..(201): n is a, c, g, or t
  modified_base (272)..(272): a, c, t, g, unknown or other
  misc_feature (272)..(272): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcgagggtcctgggcccagtctgtgctgactcagcccaccctcagcgtcgtcgggaccccggnaggaggtcaccatctcttgttcgtggagcaactcaactatacggtaaagtaattagtgtattcgtaggtancgagacaacctcccgaaggaactccggacccccaaatccctacactaccgaagaagaaatatcgacgccgccgtcgacgggtcctgaacctcttacctgtacggtcctaccgaaagttctcgggtaccctaacctccgtacccgtaccctaccccgtagaccctaacgtccgtacggtccggggtaccgttacccgggttacggaacgggtagttaccggagggtacctaacggttaacgtttaaacgtttacgtacggggttacgtaccgtaaacgttacccggggaaaccgggaccgtaaccgtaaaacgtacgggttaaggtaaccgttaacgaaccgttaaagttcgggtaacgggttacgggggttaacggggtttcgggggttacgggttaacccgggggaacgggttaaccgggaaacccgtaaaccggttcggtaaccccggttcggtaacggttaccgaacccgggttaacccgtaacccggg

SEQ ID NO: 310630 - DNA, 738 bp, Homo sapiens
  misc_feature: GZ8MTXP01DJ15P.21.22.B11.1.454.CMB.2.raw
  modified_base (201)..(201): a, c, t, g, unknown or other
  misc_feature (201)..(201): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagcccaccctcagcgtcgtcgggacccccggnaggacgggtcaccatctcttgttctggagcaactccaacatacggaagttaattatgttattcgtggtatcagacaacctacccgaaggaactccggacccccaaactccctacactaccgagaaggaaataatcaggcccggtccctacggaccgggtcccctgacccgtacttccgtacgtcggccctacgaaacgttctcgggaccctacccttccgaccgtccccctacccgtacgacccctagttccgtagggttccgggtccccgtacccggggtacccggaagggtacgtagggaccggtacgttacgtaacctttaagtttaccgtgggggttacgacgtaaaccgtccgggaaaccgggaccgacgaaaccgtaggttacggggattacggaaccttaaacgtcggttacgggacggggttcgggggtttgggttcgggtaccgggggaacggggttaaccgggaacccgtaaacggtaccggtaacccgttaccggtacgggttaccaaccggttccccggtaacgg

SEQ ID NO: 310631 - DNA, 650 bp, Homo sapiens
  misc_feature: GZ8MTXP01CBAHK.21.22.B11.1.454.CMB.2.raw
  modified_base (201)..(201): a, c, t, g, unknown or other
  misc_feature (201)..(201): n is a, c, g, or t
  modified_base (240)..(240): a, c, t, g, unknown or other
  misc_feature (240)..(240): n is a, c, g, or t
  modified_base (362)..(362): a, c, t, g, unknown or other
  misc_feature (362)..(362): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccatcctcagcgtcgtcggggacccccggnaggagggtcacctatctcttgtcgtggagcaactccaanatacggaattattatgtattctgatcagcaactccaggactcgaccccaaatcctacatcagaagataatcagccggcctacgacgggtccctgaccccgtattctgtcggctaaccagtcncgccacctcgacgccccttccacgaccctagtcgacggtcgggcccgtacccgggacggaaggtacgtacgggacggtctacggtaaactttacgtttaaccggtggtttaccggaccgtacgttaacccgggaaccgggggacccctaaataaacccgaggttaggggaacttacgaaacgtaacttcgggttaggtacgggttcggggtttacggggtcgttacgggggacggttacggggaaacctaacggtcggtaaccgtcggttcggtaaccgcgaacccgg

SEQ ID NO: 310632 - DNA, 753 bp, Homo sapiens
  misc_feature: GZ8MTXP01AQVT5.21.22.B11.1.454.CMB.2.raw
  modified_base (200)..(200): a, c, t, g, unknown or other
  misc_feature (200)..(200): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcacgccaccctcagcgtcgtcgggaccccggnagacggtcacctatctcttgttctggacggcaactccaaacagtacggaaagttaattagtgttattcgtggtatacgacgcctaaacctcccgaaggtaaacgtcccggacccccctaaaaccgttccctacctaacgtaccccgaaaggtaaaggtaaacttaacgtaccgacgggtccccggtaccccttaccggtaccgggggttccctacggacccgtaactttcccgttcgtcggtaccctaccgtaaaacgttccgtcggacctaaccccttcgacccgtacccctcccgtacgaccctactacgtacggtcgggtccgtcccggtacccgggaggtacgtgggacgtacgtacgtaacttagtttaccgtgggtactacgtacgtaccggaaccggacgaccaaacgtagtagggtatacggaacctaagttccggtagggttacgggttcggggttggggttacggttacggggaccgggggttaacggaaccgtaacggtcggtaacgtcggtaccggttaggaaccgttaacgaaccccggg

SEQ ID NO: 310633 - DNA, 705 bp, Homo sapiens
  misc_feature: GZ8MTXP01AZ5NZ.21.22.B11.1.454.CMB.2.raw
  modified_base (203)..(203): a, c, t, g, unknown or other
  misc_feature (203)..(203): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagcccaccctcagcgtcgtcgggaccccccgggnaggacgggtcaccatctcttgttctgggacggacaactaccaacatacgggtaaagttaattatgttattcgtaggtatcagacaacctcccgaaggaactccggacccccaaactccctacaactaccgaagaacggaaataactccgacgcccggcccctacggtacggggtcccctggaccgtacttcctcgtcgcctaccaaagttcctcggccctacccgtccaccgtcccctccctagacccctagttcccgagggtccggggccctcccgggggtaccgaagggtacgtaggaccggtactacgaactttagttaccgtgggtacgtacgtacgtaccggaacgggaccgacgaacgtaggtcgggacttaggaacctaagtccggtagggttacgggttcggggtttgggtacgggttcggggaccgggttaacgggaacctaacgggtcggtaacccgtccggtaggttacccgtaaccggcccgtaaccggg

SEQ ID NO: 310634 - DNA, 759 bp, Homo sapiens
  misc_feature: GZ8MTXP01EYFIZ.21.22.B11.1.454.CMB.2.raw
  modified_base (201)..(201): a, c, t, g, unknown or other
  misc_feature (201)..(201): n is a, c, g, or t
  modified_base (433)..(433): a, c, t, g, unknown or other
  misc_feature (433)..(433): n is a, c, g, or t
  modified_base (444)..(444): a, c, t, g, unknown or other
  misc_feature (444)..(444): n is a, c, g, or t
  modified_base (479)..(479): a, c, t, g, unknown or other
  misc_feature (479)..(479): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagcccaccctcagcgtcgtcgggacccccggnaggagggtcaccatctcttgtctggagcaactccaacatacggaagttaattatgtattctggtatcagcaactcccgaggaactcggacccccaaatccctacactaccgaagaaggtaaataacgtcaacggccggtccctacgacgggggtcccctggaacccgtacttcctcgtcggtcctacccgaaaagttccgtcggaccctaccctcaccgtcccctcccgtanacccataccgnggtcggggccttcccgggtacgaaggagttacggnggtaccgttagaacctttaatttacgtcggggtacgtaccgttaacgtacccgggaaccggggaaccgaccctaaaacgggtacggtttacgggggaaattaaccgggaaaccctaaaggtttcccggtaaggggttaccgggggttccggggtttagggggttccggttacccggggggacgggttaaaccggggttaaaccccgttaaaccggtccgggtaaccccgttcccgggtaaacgggttcccggaaacccggttaacccggtaaacccgggg

SEQ ID NO: 310635 - DNA, 792 bp, Homo sapiens
  misc_feature: GZ8MTXP01A4KZZ.21.22.B11.1.454.CMB.2.raw
  modified_base (201)..(201): a, c, t, g, unknown or other
  misc_feature (201)..(201): n is a, c, g, or t
  modified_base (265)..(265): a, c, t, g, unknown or other
  misc_feature (265)..(265): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagcccaccctcagcgtcgtcgggacccccggnaggagggtcaccatctcttgtctggagcaactccaacatacggaataattatgtattcgtgtancagcaactccgaaggactccggacccccaaactcctacactaccgaagaaggtaaataacgtcgaacggcccggtccctacggtacgggggtcccctaggacccgtactttccgtcgtcggtaccctaccgtaaacggttccgtcgggaccctaacccgttccgaaccggtcccccttaccccgtacgaaacccctacgttacccggtacggggttcccggggtaccccgttaccccgggggttaccggaaaaggggtcgttacggggaacgggtccttaaggtaaacctttaacgtttacccggtggggtacgaccgtaaacggttacccgggaaaccgggggaacctaccgtaaaacgtaggggttacggggaacttaacggaaaccttaacggtcgggtaagggaccgggggttcgggggttcggggttacgggttacccgggggaaccggggttaacggttaaaccccgtaaacggttcggtaaccccgttagacgggttaccaaccggaacccggtaacggg

SEQ ID NO: 310636 - DNA, 601 bp, Homo sapiens
  misc_feature: GZ8MTXP01AQOXY.21.22.B11.1.454.CMB.2.raw
  modified_base (199)..(199): a, c, t, g, unknown or other
  misc_feature (199)..(199): n is a, c, g, or t
  modified_base (236)..(236): a, c, t, g, unknown or other
  misc_feature (236)..(236): n is a, c, g, or t
  modified_base (259)..(259): a, c, t, g, unknown or other
  misc_feature (259)..(259): n is a, c, g, or t
  modified_base (444)..(444): a, c, t, g, unknown or other
  misc_feature (444)..(444): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctcgggacccccggnagagggtcaccatctcttgtctggagcaactccaacntcggaatattatgtattctgtancagcaactccagactcgaccccaatcctcatcagagaatatcagcggccctgacggggtccctgaccgtactttcctctggcctacccgaaagttcctggcccacccgtcacgccctccctgaccccatcgaggttcgggccgttaccgggaccgaggactgggacggtcttggaccttaattcngggtcgccgtagtacccgacgggggacacccgaaagtggtaggggataccggaacctaaagtccgtggaagggttcgggttagggtcggttacggggcgggaacgggaccctaaacgtcggtaacccgtccgtagggcaacggttaaccccgaaggg

SEQ ID NO: 310637 - DNA, 647 bp, Homo sapiens
  misc_feature: GZ8MTXP01CAQ1T.21.22.B11.1.454.CMB.2.raw
  modified_base (203)..(203): a, c, t, g, unknown or other
  misc_feature (203)..(203): n is a, c, g, or t
  modified_base (245)..(245): a, c, t, g, unknown or other
  misc_feature (245)..(245): n is a, c, g, or t
  modified_base (260)..(260): a, c, t, g, unknown or other
  misc_feature (260)..(260): n is a, c, g, or t
  modified_base (273)..(273): a, c, t, g, unknown or other
  misc_feature (273)..(273): n is a, c, g, or t
  modified_base (315)..(315): a, c, t, g, unknown or other
  misc_feature (315)..(315): n is a, c, g, or t
tcagtcgtcgctcgcacgaccggtgctcgatttagacgacagctcaggggagcttcagctgtggtagagaagacaggactcaggacaatctccagcatggccggcttcctctcctcctcaccctcctcactcactgcgcagggtcctgggcccagtctgtgctgactcacgcccaccctcagccgtcgtcggggacccccggnaggacgggtcaccattctcttgttctggacggcaactccaanatacggaattaattntgtattctagtancagcactccaggactcgaccccaatcctcactcagagaatancagccgccgtcgacgggtcctagacgtacttctcgtggcctacgtaaacgtcgttccggcctaacccgtcacccggtcccttccccgtacgaacccagttacccggagggtcggggaccctttccggggacggtaagggtactcgggaacgggtctacgttaactagtttacggtcggtacgctaacgtccggaaacggggtcaacgtaacgtaggtcggtatacggtaatcgtaacggtggttacgggttcgggtttggggtaccgtcggggacgggacggttaacctaaggtccgccggtacgttacggccgtaaccgaaccgtaaccgg

SEQ ID NO: 310638 - DNA, 713 bp, Homo sapiens
  misc_feature: GZ8MTXP01B56QX.21.22.B11.1.454.CMB.2.raw
  modified_base (201)..(201): a, c, t, g, unknown or other
  misc_feature (201)..(201): n is a, c, g, or t
  modified_base (265)..(265): a, c, t, g, unknown or other
  misc_feature (265)..(265): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcacgccaccctcagcgtcgtcgggacccccggnaggagggtcaccatctcttgtctggagcaactcaacatacggaagtaattatgtattctggtancagacaactcccgaaggaactccggacccccaaatccctacactaccaagaaggaaataactcgacggccggtccctacgaccgggggtccctaggacccgtatttcctcgtcggcctaccgtaaaacgttccgtcggaccctaacccgttccaccgtcccccttaccccgacgtaaccctaagttccgtaacgggttccggggtcccgttacccggggttacccggaaagggttacgttacgggaaccgggtttaccctttaaacgtttacgtttaacgtcgggtttaaccggaccgtaacggttacccggaaccgggggaacctaaaccccgaaacgtaggttacggggattacggaactaagtccgtaaggtaggttcgggttggggttcgtcgggagggacggacaacgtcgccgtcgtaggaccacgtaacccgaagggtccc

SEQ ID NO: 310639 - DNA, 713 bp, Homo sapiens
  misc_feature: GZ8MTXP01DD0GS.21.22.B11.1.454.CMB.2.raw
  modified_base (179)..(179): a, c, t, g, unknown or other
  misc_feature (179)..(179): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctnagcgtcgtcgggacccccggagagggtcaccatctcttgttctggagcaactccaacatacggaagttaattatgtattctggtatcagcaactcccaaggactccggacccccaaactccctacactaccgaagaaggtaaactaatcgacggccggtcctacgacggggtccctgaccgtacttcctcgtggtcctaccgtaaacgttcgtcgggtccctaccgtccgaccgtccccctccctacgaccctactcgacggttccgggtccgttcccgggtacccggaaggtacgttcggacgggtaccttacggtaacccttaagtttaaccgtgggtcgtacctaacgtccggaaccgggacgaccgtaaacgtacggtacggggtaacttacgggaactaaacgttccgtgggttaacgggtccggggttgggggtttacggttccgggggaccgggaacgggttaaacccgaaacggttcggaaccccggttacgtaccgggttacgtaacccgcccgggtaacccggg

SEQ ID NO: 310640 - DNA, 731 bp, Homo sapiens
  misc_feature: GZ8MTXP01ALIOJ.21.22.B11.1.454.CMB.2.raw
  modified_base (201)..(201): a, c, t, g, unknown or other
  misc_feature (201)..(201): n is a, c, g, or t
  modified_base (240)..(240): a, c, t, g, unknown or other
  misc_feature (240)..(240): n is a, c, g, or t
  modified_base (267)..(267): a, c, t, g, unknown or other
  misc_feature (267)..(267): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcacgccaccctcagcgtcgtcgggacccccggnaggagggtcaccatctcttgttctggaggcaactccaanatacggaagtattatgtattctggtancagcaactcccgaggaactcggacccccaaactcctacactaccaagacggaaatactcgagcccggcccctcgacgggggtcccctagacccgtacttccgtcgtggccctaccgaaaggttccgtcgggacccaccccgttcacccggtccccttaccctacggaaccctagttcccgagggttccggggcccttaccccggggtaccgaagggtacttagggaacgggtccttacgggtaacctttaagttttaccggtcggggtacgaccgtaaccgtaccgggaaccgggaccaacgaaacgtagggtacgggtaactacgtaacgtaagtcggtagggttacggggttcggggttaggggtaccggttaccggggaacgggaaccgggttaaaccctaaacggttccggtaacccggttaccggtacggttaccgaacccggttaacccgtaaccggg

SEQ ID NO: 310641 - DNA, 695 bp, Homo sapiens
  misc_feature: GZ8MTXP01AQ152.21.22.B11.1.454.CMB.2.raw
  modified_base (199)..(199): a, c, t, g, unknown or other
  misc_feature (199)..(199): n is a, c, g, or t
  modified_base (487)..(487): a, c, t, g, unknown or other
  misc_feature (487)..(487): n is a, c, g, or t
  modified_base (587)..(587): a, c, t, g, unknown or other
  misc_feature (587)..(587): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctcgggacccccggnagagggtcaccatctcttgttctggaggcaactccaacatcggaattaatatgtattctgtatcagcaactccaggaactccggacccccaaactcctcactccagaaggaataactcagccggccctgacggggtcctcgaccgtacttcgtctcggacctccgtaaaacgttccgttcgggaccctaaacccgttccaacccggtcccccttaccccgtacgtaaacccctacgtaccgtaacgggtccggggtccccgttaccccggggttaccggaaaggggtnttacgggacgggtaccttacggtaaacctttaacgtttcccgtagggggttacacgtaacgtaccggaaccgggggacctacgaaacgtaggttacgggntaacgacctaagttcgtagggacgggttgggtttcggggtcgttcgggacgggaacgggttaacctaacgtcggcccgttacgtagggttaccaacgttcccgaacgg

SEQ ID NO: 310642 - DNA, 740 bp, Homo sapiens
  misc_feature: GZ8MTXP01EYZQ3.21.22.B11.1.454.CMB.2.raw
  modified_base (204)..(204): a, c, t, g, unknown or other
  misc_feature (204)..(204): n is a, c, g, or t
  modified_base (242)..(242): a, c, t, g, unknown or other
  misc_feature (242)..(242): n is a, c, g, or t
  modified_base (269)..(269): a, c, t, g, unknown or other
  misc_feature (269)..(269): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctcgggcccagtctgtgctgactcacgcccaccctcagccgtcgtcgggacccccggnaggagggtcaccatctcttgttctggagcaactccaanatacggaattaattatgtatctagtancagcaactcccaaggtaactccggaccccctaaactcctacactaccgaagaaggaaataactcgaacggcccggtcccctacggaccgggggttcccctacggtaaccgtacctttccgttcgtcgggtacctacccgtaaaacgttccgtaacgggccctaaacccttcgaaccggtcccccttaccccgacggtaccctaacttccggaacgggttcgggggccccttacccgggggtaccggaaagggtgttacgggaacgggtccttacgtaaaccgttatttacccgttgggtcggaactaacggtacggaacccggggacacccgttaaaagagttggggaacttaggaaactaacgtaacgtagggttacgggtacggggttggggttcgggttacgggttacgggacgggaaccgtaacgtacggtaaccggtacgtacgttacgtaacgaaccgtaaccgg

SEQ ID NO: 310643 - DNA, 628 bp, Homo sapiens
  misc_feature: GZ8MTXP01CJ0DM.21.22.B11.1.454.CMB.2.raw
  modified_base (179)..(179): a, c, t, g, unknown or other
  misc_feature (179)..(179): n is a, c, g, or t
  modified_base (199)..(199): a, c, t, g, unknown or other
  misc_feature (199)..(199): n is a, c, g, or t
  modified_base (212)..(212): a, c, t, g, unknown or other
  misc_feature (212)..(212): n is a, c, g, or t
  modified_base (247)..(247): a, c, t, g, unknown or other
  misc_feature (247)..(247): n is a, c, g, or t
  modified_base (258)..(258): a, c, t, g, unknown or other
  misc_feature (258)..(258): n is a, c, g, or t
  modified_base (265)..(265): a, c, t, g, unknown or other
  misc_feature (265)..(265): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctnagcgtcgtcgggaccccggnaggagggtcaccntctcttgtctggagcaactcaacatacggaatatntgtatctgtancagcacnccagaactccgaccccaatcacatccagagaataatcgagccgcctcggacgggtcctgaccgtcttccgtcgtcggtccctacctaaacgtttccgtcggcctaacccttcgaccgtcccctccgtcgcctagtcgacggtcgggccgtccgggtacggaggagttcgggacgtcttagtaatttcgttaacgtgggtcgacgtagcgtagttgtcgagtacgggacgtccgtaggtacggttcgggtccggtggttaccggggacgggacgggtacccgtagggttccgttaacggttccccggttaacgtacggttcgacccggtacccgttaacggggtcccttccccgggtcccccgg

SEQ ID NO: 310644 - DNA, 807 bp, Homo sapiens
  misc_feature: GZ8MTXP01BSHPT.21.22.B11.1.454.CMB.2.raw
  modified_base (200)..(200): a, c, t, g, unknown or other
  misc_feature (200)..(200): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtcgtcgggacccccggnagaggtcaccatctcttgtctggagcaactccaacatacggaaattaattatgtattcgtaggtatcagacaacctcccgaaggaactaccggacccccaaacttccctacgaactacccgaaggaaggaaataactcgaacgggtcccggtacccctacggtaaccgggggttcccctacggtaaccccgtactttcccgtacgtcggaccctttacccaaaaacgggttcccgttcgggaccctaaccccgttccgaacccggtccccttaccccggttacgaacccctaagtccgtacgggtccggggtccttacccgggtaccggaaggtacgtcgggacggaccttagtaaccgttaagtttcccggtaggggttacgtaaccgtaacgttacccgggaaaccgggggtaccctaacgaaaaccgttacgggtaggggaacttaaccgggaactaaaacggttccggtagggttaacggggttccgggggtttggggttaccgggttccgggggaacggggttaaccggggttaaaccctaaaccgggtccggtaacccggttccggtacgggttaccgaaccgggttaacccgtaaccggg

SEQ ID NO: 310645 - DNA, 545 bp, Homo sapiens
  misc_feature: GZ8MTXP01AOUFI.21.22.B11.1.454.CMB.2.raw
  modified_base (180)..(180): a, c, t, g, unknown or other
  misc_feature (180)..(180): n is a, c, g, or t
  modified_base (234)..(234): a, c, t, g, unknown or other
  misc_feature (234)..(234): n is a, c, g, or t
  modified_base (252)..(252): a, c, t, g, unknown or other
  misc_feature (252)..(252): n is a, c, g, or t
  modified_base (256)..(256): a, c, t, g, unknown or other
  misc_feature (256)..(256): n is a, c, g, or t
  modified_base (281)..(281): a, c, t, g, unknown or other
  misc_feature (281)..(281): n is a, c, g, or t
  modified_base (323)..(323): a, c, t, g, unknown or other
  misc_feature (323)..(323): n is a, c, g, or t
  modified_base (348)..(348): a, c, t, g, unknown or other
  misc_feature (348)..(348): n is a, c, g, or t
  modified_base (359)..(359): a, c, t, g, unknown or other
  misc_feature (359)..(359): n is a, c, g, or t
  modified_base (413)..(413): a, c, t, g, unknown or other
  misc_feature (413)..(413): n is a, c, g, or t
  modified_base (435)..(435): a, c, t, g, unknown or other
  misc_feature (435)..(435): n is a, c, g, or t
  modified_base (442)..(442): a, c, t, g, unknown or other
  misc_feature (442)..(442): n is a, c, g, or t
tcagtcgtcgctcgcacgaccggtgctcgatttagacgacagctcagggggagcttcagctgtggtagagaagacaggactcaggacaatctccagcatggccggcttccctctcctcctcaccctcctcactcactgcgcagggtcctgggcccagtctgtgctgactcagtcaccctnagcgtctgggacccccggcagagggtcaccatctcttgtctggagcaactcaanatcggaatatatgtatcngtancagcaactccagatcgccccaatcnatcagagaatatcagcgccctgacgggtcctgacgtacttcntcggctcaaagttctcggcaccctnacgccctcccngtacccatcaggtcgggcctccgggtcgaggtatcggaggtctgacttattacngggtagccatccgacgggaacncaaacgngtacgggatcggactaatcgtaggacgggtcgggttggggtacgtcgggacgggacgggacaaacgtcgaaccgtcgtaaggggctaacggaacccgaacggg

SEQ ID NO: 310646 - DNA, 717 bp, Homo sapiens
  misc_feature: GZ8MTXP01A8UHD.21.22.B11.1.454.CMB.2.raw
  modified_base (234)..(234): a, c, t, g, unknown or other
  misc_feature (234)..(234): n is a, c, g, or t
  modified_base (282)..(282): a, c, t, g, unknown or other
  misc_feature (282)..(282): n is a, c, g, or t
tcagtcgtcgctcgcacgaccggtgctcgatttagacgacagctcaggggagcttcagctgtggtagagaagacaggactcaggacaatctccagcatggccggcttccctctcctcctcacccctcctcactcactgcgcagggtcctgggcccagtctgtgctgactcagccaccctcagcgtctcgggacccccggagaggtcaccatctcttgtctggagcaactccaanatacggaattaattatgttattctggtatcagcaactcccaaggaacnccggacccccaaactcctcactccgaagaaggaaataactcgacgccggtcctcgacggggtccctacgaccgtacttctcgtcggcctacccgtaaagtccgtcggaccctaacccgtcgaccgtccccttaccccgtacgtaacccacgttcgaacggttccgggggtcccgtttcccgggggacccggtagggtacgttacgggaacgggtcttacgggtaactttacgtttaaccgtaggggttcgaccgtacgtaccggaaccggggtaccgtacgaaacggtacgtagggggtaacctaaggtaactaacggtcgttagggaacggtcgggggttttggggtacgggttaccggggcgggttaaacgggaccctaaacggtccgggtaacctacgggtacggttaccgtaacggaaccccgtaaccggg

SEQ ID NO: 310647 - DNA, 655 bp, Homo sapiens
  misc_feature: GZ8MTXP01DQSDI.21.22.B11.1.454.CMB.2.raw
  modified_base (200)..(200): a, c, t, g, unknown or other
  misc_feature (200)..(200): n is a, c, g, or t
  modified_base (297)..(297): a, c, t, g, unknown or other
  misc_feature (297)..(297): n is a, c, g, or t
  modified_base (370)..(370): a, c, t, g, unknown or other
  misc_feature (370)..(370): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccatcctcagcgtcgtcgggacccccggnagagggtcaccatctcttgttctggagcaactccaacatcggaaataattatgtattctggtatcagcaactcccaagaactcgaccccaaactccncatccaagaagaataatcaagccggccctcgacggggtccctagaccccgattctcgtggcctaaccaagtcngaccacctcacgccctcctgacctatcagggtcggaccgtcccggaccggaggatcgggaacgtcctagtaaccttagtttaaccggtgttagaccgttaacacccgggaaaccgggacgacctaaaacgtgtacgggggaacttacgaaaccgtaaagttccggttagggtaacgggttcggggtttagggggttcgggttacggggacggggttaaaccgggtaaaccgtaaaacgttcgggtaaccccgttaccggttaagggtcccgaacggtaaccccgg

SEQ ID NO: 310648 - DNA, 709 bp, Homo sapiens
  misc_feature: GZ8MTXP01BRS51.21.22.B11.1.454.CMB.2.raw
  modified_base (205)..(205): a, c, t, g, unknown or other
  misc_feature (205)..(205): n is a, c, g, or t
  modified_base (382)..(382): a, c, t, g, unknown or other
  misc_feature (382)..(382): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcacgcccaccctcagccgtcgtcgggaccccccgggnaggacgggtcaccatcttcttgttctgggacgacaactccaaatatacggtaaattaattatagtattcgtagtatacagactaacctcccgaaggtaactccggaaccccctaactcctacactaccgaagagaataactcgacgccgtcctcgacgggtccctgaccgtacttcncgtcggcctaccgtaacgtccgtggaccctacccgtcgaccgtccccctaccgtacgaccctagtccgtagggtcgggcccgtcccgggtacgacgggtacgtaggacggtcctagtacttacttacgtggtcgtacgaactaccgggaaccggacgaccgtaagacggtaggtagtagtaacgtagtccggttaggttacgggttccgggggttagggggttccggtacgggggttaaccggggttaacggttaacccgtaaaccggtcccgggtaacccggttacgggtacggttacccgaaccggttaacccggtaacccgggg

SEQ ID NO: 310649 - DNA, 641 bp, Homo sapiens
  misc_feature: GZ8MTXP01EDI8E.21.22.B11.1.454.CMB.2.raw
  modified_base (200)..(200): a, c, t, g, unknown or other
  misc_feature (200)..(200): n is a, c, g, or t
  modified_base (261)..(261): a, c, t, g, unknown or other
  misc_feature (261)..(261): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtcgtcgggacccccggnagagggtcaccatctcttgttctggagcaactcaacatcggaattaatatgtattctgtancagcaactccagaactcgaccccaatcctcactaccagaagaataatcacgccggccctacgacggggtccctacgaccgtacttcctctcggcctaccgaaacgttctcggccaccgtcacgtcccctccctgaccctatcgaggtcgggccgttccgggtaccggaaggtctacggacggctacgtacttaagttaccgtggtacggctaacgtcggaaaccgggaccgactaaacgtaggtagggtaactacgaacgtaaattcgtagggttaccgggtggggtttacggggtacgggttccggggacgggacgggttaacccgtaaacggtcggaacccggttcggtacggttaccgaaccggttcccgtaaccgg

SEQ ID NO: 310650 - DNA, 695 bp, Homo sapiens
  misc_feature: GZ8MTXP01B683I.21.22.B11.1.454.CMB.2.raw
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctggcccagtctgtgctgactcagcccaccctcagcgtcgtcgggaccccccggagagttcaccatctcttgttctggagcaactccaacatcggaataattatgtattctggtatcagcaactcccaaggaactccggacccccaaactcctacactaccagaaggaaataatcacggccgcctcgaccggggtccctggaccgtacttcctcgtggcctacccaaagttcgtggacctaccctcaccgtccctccccgtacgaccctacgtcgaggtcgggcgtccccgggtaccggaagggtactggaacgggtctacggtaacttacgttaccgtgggttacgacgtacgtaccggaaccggggacacgtaaacgtaggtaggggtaactacgaaactacgtaaccgttgggaacggggtttcgggggtttagggtacgggtttccgggggaacggggttaccgggttaaacccgtaaacggttccgggtaacccgttacccgggttacgggttaccgaacccgggttaaccccgtaaaccgggg

SEQ ID NO: 310651 - DNA, 745 bp, Homo sapiens
  misc_feature: GZ8MTXP01B2H8Y.21.22.B11.1.454.CMB.2.raw
  modified_base (206)..(206): a, c, t, g, unknown or other
  misc_feature (206)..(206): n is a, c, g, or t
  modified_base (441)..(441): a, c, t, g, unknown or other
  misc_feature (441)..(441): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcacgcccaccctcagtccgtccgtcgggaccccccggnaggacgggtcacctatcttcttgttcgtgggagaccaactaccaaactagtacgggtaaattaattagtgttattcgtggttatcacgacaaccgtaccaaggaactcccggaaccccctaaactcctacactaccgaagaacggaaataatcgacgccggcccgtcggaccgggttccctacgaccgtacttccgtcgtcggccctaccgtaaacgttcgcgacctaccctccncgtcccctcccgtcgaaccctgtacgacggtcggtcccgtccgggtccgaaaggtcgtaggtacgtacgttctaacgttacgttcgtgggtacgtagtaccgtaccgggaaaccgggtacgaaccttaaacggacggttggggttaaaaccgtacgtaaccgtaggttcgggtacggggttacggggttcgggggtttcggggtaaccggggtccggggttaacggggttaaccggttaaacccgtaacggttacccggtaaccggttacggtacggttaccgtaacccggttaacccggtccg

SEQ ID NO: 310652 - DNA, 754 bp, Homo sapiens
  misc_feature: GZ8MTXP01DRNRD.21.22.B11.1.454.CMB.2.raw
  modified_base (199)..(199): a, c, t, g, unknown or other
  misc_feature (199)..(199): n is a, c, g, or t
  modified_base (265)..(265): a, c, t, g, unknown or other
  misc_feature (265)..(265): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccacctcagcgtcgtcgggacccccggnagagggtcacatctcttgttctggagcaactcaacatacggaagttaattatgtattcgtaggtancagacaactacccaaggaactccggaacccccaaactccctacaactccgaaggaaaggtaaactaaactccgaagggtccccgggtcccctacggaaaccgggggttcccctacggtaaccccgttatttccgttcgtcgggtaccctacccgtaaaagtccgttcggaccctaaaccctcctaaccgtcccccttacccgacgacccttaatcgaacgggtcgggtcccgtacccgggtacggtaggattcgggaacgtctaagtaacctaagtttaccgttggggtcaccgtataccccgggaaacggggccaagaaaaccgtaggtaacgggattacaaaaccggaattttccgagggttaccgggttgggggttttcgggacggggtttccggggaaaccgggacggggttaaaccctaaaaccgggttcggaaccccgggttaccgttaacggggactaacccggttaaccccggtaaacggg

SEQ ID NO: 310653 - DNA, 559 bp, Homo sapiens
  misc_feature: GZ8MTXP01D32YJ.21.22.B11.1.454.CMB.2.raw
  modified_base (200)..(200): a, c, t, g, unknown or other
  misc_feature (200)..(200): n is a, c, g, or t
  modified_base (413)..(413): a, c, t, g, unknown or other
  misc_feature (413)..(413): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctgggaccccccgggnagagggtcaccatctcttgttctggagcaactccaacatcggaataattatgtattctggtatcagcaactccaggaactcggcccccaaactcctcatccagagaataatcagcggcctcgacgggtcctgaccgtacttctctggcctccgaaaacgtctcggcaaccctcacgccctccctcgaccatcaggtcggctccggtccgaggntggagctagacttattacgtggtcgctagtcgaacgggcgcaacgagtgggatgactaaagtctgaggtcgggttgggtggttcgggacgggttacggggaccaaagtcggaacccgttccgaggttaccaacggcccgtaacggg

SEQ ID NO: 310654 - DNA, 646 bp, Homo sapiens
  misc_feature: GZ8MTXP01AJ0RU.21.22.B11.1.454.CMB.2.raw
  modified_base (261)..(261): a, c, t, g, unknown or other
  misc_feature (261)..(261): n is a, c, g, or t
tcagtcgtcgctcgcacgaccggtgctcgatttagacgacagctcagggggagcttcagctgtggtagagaagacaggactcaggacaatctccagcatggccggcttccctctcctcctcaccctcctcactcactgcgcagggtcctgggcccagtctgtgctgactcagccaccctcagcgtctgggacccccggcagagggtcaccatctcttgtctggaggcaactccaacatcggaagttatatgtattctgtancagcaactccagaatcggaccccaatcctcatccagagaatatcagcgcctcgacgggtccctgaccgtacttcctcgtcggtcctaccgtaaaacgttccgttcgggcccaacccgttcacggtccccttccctacgacccctatcgacgggttcggggcccttcccggggtacccggagggtaccgtggaacgggtccttacggtaacttagtttaccgtggggtacgctaagtccggaaccgggacgaccaaacgtgtacggggtaatcggaactaatcgtggaggtccgggttaggggtcgttcggggacgggaaccgggttaccgtaaaacgtccgggtaacccgttccggtaacggttccgaaccggcccgtaaccggg

SEQ ID NO: 310655 - DNA, 725 bp, Homo sapiens
  misc_feature: GZ8MTXP01BEZFA.21.22.B11.1.454.CMB.2.raw
  modified_base (202)..(202): a, c, t, g, unknown or other
  misc_feature (202)..(202): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagcccaccctcagccgtcgtcgggacccccggnagagggtcaccatctcttgttctggagcaactccaacatacggaattaattatgtattctggtatcagcaacctccgaaggaactccggacccccaaactccctacactaccaaggaggaaataactcgacggccggtacccctcggaccgggtccctcggaccgtaccttccgtcgtcggccctaccgtaaacgttccgtcggcctacccgtcaccgtccccttacccgtacgaaccctagtaccgtacgggtccgggtccgtcccgggtaccggaaggtagttcgggacgggcttaggaactttagttaccgtgggtcgtacgacgtaccggaaccgggaccgaccgaaacgtagggtacgggaattacgaacgtaatccggtgggttacggggttccggggttggggtaccgggttaccgggggaaccggggttaaccggggttaaaacccctaagggttccccgggtaacccgttccgggttaaccgggttaccgtaaccccggccccggtaaaccggg

SEQ ID NO: 310656 - DNA, 743 bp, Homo sapiens
  misc_feature: GZ8MTXP01A95UN.21.22.B11.1.454.CMB.2.raw
  modified_base (207)..(207): a, c, t, g, unknown or other
  misc_feature (207)..(207): n is a, c, g, or t
  modified_base (244)..(244): a, c, t, g, unknown or other
  misc_feature (244)..(244): n is a, c, g, or t
tcagtcgtcgctcgcacgaccggtgctcgatttagacgacagctcaggggagcttcagctgtggtagagaagacaggactcaggacaatctccagcatggccggcttccctctccctccctcacccctccttttcactcactgcgcagggtcctgggcccagtctgtgctgactcagcccaccctcagcgtcgtcgggacccccggnagagggtcaccatctcttgttctggagcaactccaanatacggaagttaattatgtattcgtgtatcagcaacctccgaggaactccggacccccaactcctacactccgaagagaaataatcgacggcccggtacctcggtacgggggtcccctacgacccgtactttccgtcgtcgggaccctacccgaaacggttccgtcggaccctaacccctcgaccgtccccctcccgtacggtaaccccagttaccgtagggttccggggcccgttacccgggtaccgggaagggtacgttaggaacgggtcttacgtaactttacttacgtggggtcacgtacgtacggaaccgggaccacgaacgtacggtagggtaactacggtaaacctaaagttccggtaagggttacggggtttcgggggtttgggggtacgggtttaccgggggaaccgggttaacggggttaaccccaaaacggttccggtaaccccggtttcgaccgggttacccgaaccgggttaaccccgtaaccggg

SEQ ID NO: 310657 - DNA, 779 bp, Homo sapiens
  misc_feature: GZ8MTXP01B1W6J.21.22.B11.1.454.CMB.2.raw
  modified_base (202)..(202): a, c, t, g, unknown or other
  misc_feature (202)..(202): n is a, c, g, or t
  modified_base (239)..(239): a, c, t, g, unknown or other
  misc_feature (239)..(239): n is a, c, g, or t
  modified_base (368)..(368): a, c, t, g, unknown or other
  misc_feature (368)..(368): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcacgcccaccctcagcgtcgtcgggacccccggnagagggtcaccatctcttgttctggagcaactccaanatacggaaagttaattatgtattcgtggtatcagcaactcccgaggaactccggacccccaaactcctacactaccgaaggtaacggaaataactcgaacggcccggcccctacggacgggggttcccncggtaaccgtaccttccgtcgtcggtccctacccgtaaacggttcccttcgggaccctaaccctcgaacccgtcccccttcccctacggaacccctagttacccgtacggggttccggggtaccgttccccgggggtacggtaaaccggggtagtttcgggaaacgggtccttacgggtaacctttaaacgtttacccgtgggggttcgaccgtaacgttaccgggaaaccgggggaccaccgtaaacgtagggtggggtaacttacggaaactacgttcggtagggttacggggttccgggggttttggggttaccgggttaccgggggacggggaacgggttaacccctaaacgggtccgtaaccccgttcggtacgggttacccgtaacggaacccccggttaacggg

SEQ ID NO: 310658 - DNA, 777 bp, Homo sapiens
  misc_feature: GZ8MTXP01CBPH1.21.22.B11.1.454.CMB.2.raw
  modified_base (200)..(200): a, c, t, g, unknown or other
  misc_feature (200)..(200): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtcgtcgggacccccggnaggacgggtcaccatctcttgttctggagcaactccaacatacggaaagttaaattatgttattcgtaggtatcagacaacctcccgaggaactccggaccccctaaactccctacactaccaaggaaggtaaactaacgtccgaacggcccggtccccgtacgtaccgggggttcccctcggacccgttacttcctcgtcggtccctacccgaaaagttccgtcgggccctacccgtccaccgtccccttaccccgcgaaccctagtccgacggttccggggacccgttcccgggtaccggaaggtacgttagggacggtaccttacggtaactttaacgttacgttcgggtcggtaccctaagtaccccggaacggggaaccaccgtaaacgtacgggttaggaacgtaccgaaacgttacgtaacggtaggttacgggggtttcggggtttacgggggttacgggtacccgggggttaacggggaaaccgggttaaacccgttaaaccgggttccgggtaaaccccggtttccggtaaccgggttcccgtaacccggccccggttaacccgggg

SEQ ID NO: 310659 - DNA, 758 bp, Homo sapiens
  misc_feature: GZ8MTXP01CVK9A.21.22.B11.1.454.CMB.2.raw
  modified_base (201)..(201): a, c, t, g, unknown or other
  misc_feature (201)..(201): n is a, c, g, or t
tcagtcgtcgctcgcacgaccggtgctcgatttagacgacagctcaggggagcttcagctgtggtagagaagacaggactcaggacaatctccagcatggccgtcttccctctcctcctcaccctcctcactcactgcgcagggtcctgggcccagtctgtgctgactcagcccaccctcagcgtcgtcgggacccccggnaggacgggtcaccatctcttgttctggagcaactccaacagtacggaagtaattatgtattcgtggtatcagcaactcccgaggaactccggaccccaactcctacataccaaggagaaataactcgacggccggccctcggaccggggtccctagaccgtactttccgtcgtcggacctacccgaaaacgttccgtcgggacctacccgtctacgtccccgtacccttacgaaccctagttacctacggggtcgggtacccgttcccgggtacccggaagggtacgttgggaaccgggttcgttaacgtaacgtttaacgtttacgttcggggtacgtaccgtaacgtaacccgggaccggggaaaccgtaccgtaaacgtaacggtagggggtaactacggtaaactaaaggttcgtacggggaacggggttcggggttagggggttaccgggttaccggggaaccgggggttaaacggggaacccgttaaaccgttccgggtaacccgttaccggttacgggttaccgaaccgggttaaccccggtaacccggg

SEQ ID NO: 310660 - DNA, 692 bp, Homo sapiens
  misc_feature: GZ8MTXP01EQIUN.21.22.B11.1.454.CMB.2.raw
  modified_base (237)..(237): a, c, t, g, unknown or other
  misc_feature (237)..(237): n is a, c, g, or t
  modified_base (266)..(266): a, c, t, g, unknown or other
  misc_feature (266)..(266): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagcccaccctcagcgtcgtcgggacccccggaggaggtcaccatctcttgttctggagcaactccaanatacggaattaattatgtattcgtagtancagcaactccaaggaactccggacccccaaactccctacactaccgaagaagtaaataatcgaacggcccggaccctacggaccggggtccctcgaaccgtacttcctcgtcggacctacccgaaagttcctcggacctaccgtccgaccgtcccctcccgtagacccatccgagggtccggccgttcccgggaccggaggtagttacggacgggtactacgtaacttaacgttccgtagggtcgtaccgtaacgtacccggaacggggaccaaccggaaacgtacgggtagggaacttaacggaacctaaagttccgtagggacggttcgggggtttagggtcggttaaccggggacggttaacgggaaccctaacggtaccgtaaccggttaccgacggttaccaaccggttcccgtaacccgg

SEQ ID NO: 310661 - DNA, 545 bp, Homo sapiens
  misc_feature: GZ8MTXP01DVO1W.21.22.B11.1.454.CMB.2.raw
  modified_base (200)..(200): a, c, t, g, unknown or other
  misc_feature (200)..(200): n is a, c, g, or t
  modified_base (223)..(223): a, c, t, g, unknown or other
  misc_feature (223)..(223): n is a, c, g, or t
  modified_base (237)..(237): a, c, t, g, unknown or other
  misc_feature (237)..(237): n is a, c, g, or t
  modified_base (266)..(266): a, c, t, g, unknown or other
  misc_feature (266)..(266): n is a, c, g, or t
  modified_base (315)..(315): a, c, t, g, unknown or other
  misc_feature (315)..(315): n is a, c, g, or t
  modified_base (349)..(349): a, c, t, g, unknown or other
  misc_feature (349)..(349): n is a, c, g, or t
  modified_base (491)..(491): a, c, t, g, unknown or other
  misc_feature (491)..(491): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtcgtgggaccccccggnagagggtcaccatctcttgttcnggagcaactccaanatcggaagttaattatgtattcgtggtancagcaacctcccaggaactcgaccccaaactcctcatccagagaataancagcgccctgacggggtccctgaccgatttcctntggcctaccaaagtctcggccacctcacgccctcctgacccatcaggtcggctccgggtcaggtacgtgaggctgacttattactggtcgctagcgaccggagacaacagtggtatggaacaagtcgtgaggtcgggttggnggttcgggacggacggaacctaaagtcgaaccgtctagggccaagccccgaagg

SEQ ID NO: 310662 - DNA, 724 bp, Homo sapiens
  misc_feature: GZ8MTXP01AZUNI.21.22.B11.1.454.CMB.2.raw
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagcccaccctcagccgtcgtcgggaccccccggcaggacgggtccaccatcttcttgttctggagcaactccaacatacggaataattatgtattctgtatcagcaactcccaggaactccggacccccaaactcctacactaccaaggaagaaataatcgacggcccggtcccgtcgacgggtccctacgaccgtacttcctcgtcggtccctaccgaaacgttccgtcggacctacccgtaccgaccgtcccctaccccgtagaacccctacgtaccgtacggtccgggtccgttccggttacgggttaccccggagggttaccttagggaaccggtcgttaaccggtaactttaacgtttaccgggttgtacggtaaccgttaccgtaccggaaaccgggggaaccaaccgtaaaacgtaggttccggggaattacgggaacctaaaggtttccgagggtaccgggttgggggtttacgggtcgggttaccgggacgggaacggggaaaccctacggtcggtaccgtcgttacgggtaacaacggaaccccg

SEQ ID NO: 310663 - DNA, 646 bp, Homo sapiens
  misc_feature: GZ8MTXP01CQKLW.21.22.B11.1.454.CMB.2.raw
  modified_base (200)..(200): a, c, t, g, unknown or other
  misc_feature (200)..(200): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtcgtgggaccccccggnaggagggtcaccatctcttgttctggaggcaactccaacatacggaaagtaattatgtattctggtatcagcaactcccaggaactcggaccccaactcctcactccagagaatatcagcggcctgacgggtcctgaccgtacttctcgtcggcctaccaaagtctggcctacctcacgccctaccctcgaccctatcacgggttcgggccgttcccgggtacccgagggacttcggaacgggtctacgtaactttaagttaccgtggggttcgactacgttccggaaccggggaccgtaccgaaacgtacggttggggaattacgaaacgtaacgttccgttagggacgggtttcggggttggggttcgggttcgggacggggacgggaaccgtaaacgtcggaacccgttaccgttacgggaccaacggttcccgtaaaccggg

SEQ ID NO: 310664 - DNA, 746 bp, Homo sapiens
  misc_feature: GZ8MTXP01EWXJW.21.22.B11.1.454.CMB.2.raw
  modified_base (203)..(203): a, c, t, g, unknown or other
  misc_feature (203)..(203): n is a, c, g, or t
  modified_base (274)..(274): a, c, t, g, unknown or other
  misc_feature (274)..(274): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcacgcccaccctcagccgtcgtcgggacccccggnaggagggtccaccatctcttgttctggagcaactccaaacagtacggaaattaattatgtattcgtggtancagcaactcccaggaactccgaccccaaactcctacactccgaagaagtaaataactcgacggccggtaccctacggaccggggttcccacgtaccgtacttccgtcgtcggtacctacccgtaaaagtccttcgggcccctaacccttcccgaacgtcccccttaccccgacgaaccccagtttcccgacggggtccgggtcccgttacccgggaccgggtaaggtacgttagggacggtcttacgggtaacttaacgttaccgtggggtacgtaccgtaacgtcccggggaaacggacccgaacttaaacgggaggttaacggtataacgtaacgtgttcgggtagggttcggggttcggggtttacgggggtacggtaccgggggaacgggaaccggttaaacccgtaacgggtaccgtaacccggttaccggtacgggttaccctaaccgggttaacccgtaaccggg

SEQ ID NO: 310665 - DNA, 788 bp, Homo sapiens
  misc_feature: GZ8MTXP01AHSJX.21.22.B11.1.454.CMB.2.raw
  modified_base (202)..(202): a, c, t, g, unknown or other
  misc_feature (202)..(202): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcacgccaccctcagcgtcgtcggggacccccggnaggagggtcaccatctcttgttctggagcactccaacatacggaataattatgttattcgtaggtatcagacaacctccgaaggactccggacccccaactcctcactaccaagagaatatcgagccggccctgacgggtccctggacctacttcctcgtcggcctaccgtaaagtcgtcggacctaccctcgaccgtccccttacccgtcggaaacccctactcgtacgggttccgggggtacccgttccccggggttaccggaagggttaacggttcgggaacgggttaccgtacggtaacctttacgtttaaccggtcgggggttacgaccgttaacgtacccgggtaaaccgggggaaccgtaaccgaaacgggttaacggttagggggaacccttaaggtaaaccgtaaacgggtttccgtaagggggttaacgggggtttcccggggggtttaagggggttccgggggttttaccggggaccgggggttaaaccggggttaaacccgtaaaacgggttcccgggtaaccccgggttaacgtaccgggttaccgaacccgggttaaccccggtaacccggg

SEQ ID NO: 310666 - DNA, 786 bp, Homo sapiens
  misc_feature: GZ8MTXP01AU9YI.21.22.B11.1.454.CMB.2.raw
  modified_base (765)..(765): a, c, t, g, unknown or other
  misc_feature (765)..(765): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagcccaccctcagcgtcgtcgggacccccggagacgggtcaccatctcttgttctggagcaactaccaacatacggaattaattatgttattcgtggtactcagcaacctccgaaggaactccggaccccctaaactcctacactacccgaagaaggtaaactaacgtcgaacggcccggtaccccgtacggtaccggggtccctcggaacccgttacttccgtacgtcggcctaccgtaaacgttctcggacctaccgtacgaccgtcccctcccgtacgacctacgtaccgagggtccggaccgttcccgggtacccgggaagtacggttacgggaaccgggttacgtaccggttaaccgtttaaagtttaccccggtagggtttacccgggaaccgtaaccggttaccccggggaaaccgggggaacccaacccggtaaaacgtaggggttaccgggtaagttaccgtaaaccgtaacgttcggtacgggttacgggggtaccggggtttgggggttacggttacccgggggaaaggggacccgggttaaacccgtaaacggtccggaacccgggttaccgtacgggttaccnccgggaaccccggtaaccggg

SEQ ID NO: 310667 - DNA, 640 bp, Homo sapiens
  misc_feature: GZ8MTXP01AKDWI.21.22.B11.1.454.CMB.2.raw
  modified_base (200)..(200): a, c, t, g, unknown or other
  misc_feature (200)..(200): n is a, c, g, or t
  modified_base (308)..(308): a, c, t, g, unknown or other
  misc_feature (308)..(308): n is a, c, g, or t
  modified_base (352)..(352): a, c, t, g, unknown or other
  misc_feature (352)..(352): n is a, c, g, or t
  modified_base (445)..(445): a, c, t, g, unknown or other
  misc_feature (445)..(445): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtcgtcgggacccccggnacgagggtcaccatctcttgttctggaggcaactccaacatcggaagtaattatgtattctggtatcagcaactccagaactcgaccccaactctcatcagagaatancagcgcctgacggtcctgaccgtctctgtcgcctctaaacgtcncggccaccctcaccgtccctccctcgaccctatcgacggtcgggcctaccgggtccgagggattcggacggtacctgtaacttactttaccgnggggtacgactacgtaccgggaaccgggtacactaaacggtgggtaggtactaacgacgtaacgttcggtgggggttacgggttcgggggttacgggggttcggtaacccgggggaacgggttaaaccgggaaacctaacggttaccgggtaacccgttccgggttaggacccgaaccgggttaaccccgaacgg

SEQ ID NO: 310668 - DNA, 643 bp, Homo sapiens
  misc_feature: GZ8MTXP01BSYQU.21.22.B11.1.454.CMB.2.raw
  modified_base (199)..(199): a, c, t, g, unknown or other
  misc_feature (199)..(199): n is a, c, g, or t
  modified_base (459)..(459): a, c, t, g, unknown or other
  misc_feature (459)..(459): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccatcctcagcgtctcgggacccccggnagaggtcaccatctcttgttctggagcaactccaacatcggaaagtattatgtattctggtatcagcaactcccaggaactcggacccccaaactcctcatccagaggaatatcagcggccctcgacggggtccctgaccccgtattctctggcctaccgaagtctggccacctcacgccctcctcgaccctatcgaggtcggggaccttcccgggaccggagggtacgtcgggacggccttaggtacttacgtttacgnggttcggctaacgtaccgaaccgggggtacaccaaaacgtgttcggggaatacggactaaacggttcgttaggggtagggttccgggggtttagggggtcgggtttaccgggggccggggttaaacggggaaccctaaacggtcgggtaacccgtcgttacggggtcccaaccgggtaaccccg

SEQ ID NO: 310669 - DNA, 846 bp, Homo sapiens
  misc_feature: GZ8MTXP01D5KN8.21.22.B11.1.454.CMB.2.raw
  modified_base (199)..(199): a, c, t, g, unknown or other
  misc_feature (199)..(199): n is a, c, g, or t
  modified_base (236)..(236): a, c, t, g, unknown or other
  misc_feature (236)..(236): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtcgtgggacccccggnagagggtcaccatctcttgttctggagcaactccaanatacggaattaattatgtattctgtatcagcaactcccgaggaactccggacccccaaactcctacactccaagaaggtaataactcacgccgcccgtcgacggggtccctcgaccgtacttcctacgtcggtacctacccgtaaagttccgttcgggaccctaccccgttaccgacccggttcccccttacccccgtacggtaaccccctagttacccgtaacggggtttccgggggccccgttaccccgggggttaccccgggaaaggggtaaccgtttaggggaaccggggttacccttaacgggtaaaccctttaagttttaaacccggttgggggttaccggtaacgttaacccggttaacccgggaaacccggggggaaactaccccggaaaaccgtaaggggttagggggtaaacttacgggaaacctaaacggtttaaccgtaggggttaaccggggttccgggggtttttgggggtacgggtttaacccgggggacccgggggttaaaggggaaacccccgtaaaacggttaccgggtaacccccgggttaacccggttacggggaccccgtaaccgggttaacccccgggtaaaccgggg

SEQ ID NO: 310670 - DNA, 520 bp, Homo sapiens
  misc_feature: GZ8MTXP01ADAPV.21.22.B11.1.454.CMB.2.raw
  modified_base (203)..(203): a, c, t, g, unknown or other
  misc_feature (203)..(203): n is a, c, g, or t
  modified_base (307)..(307): a, c, t, g, unknown or other
  misc_feature (307)..(307): n is a, c, g, or t
  modified_base (354)..(354): a, c, t, g, unknown or other
  misc_feature (354)..(354): n is a, c, g, or t
  modified_base (377)..(377): a, c, t, g, unknown or other
  misc_feature (377)..(377): n is a, c, g, or t
  modified_base (379)..(379): a, c, t, g, unknown or other
  misc_feature (379)..(379): n is a, c, g, or t
  modified_base (388)..(388): a, c, t, g, unknown or other
  misc_feature (388)..(388): n is a, c, g, or t
  modified_base (390)..(390): a, c, t, g, unknown or other
  misc_feature (390)..(390): n is a, c, g, or t
  modified_base (463)..(463): a, c, t, g, unknown or other
  misc_feature (463)..(463): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagcccaccctcagcgtcgtcgggaccccccgggnaggagggtcaccatctcttgttctggagcaactccaacatacggaagttaattatgttattctggtatcagcaacctcccaaggactcggacccccaaactccncactccgagagaataatcagccgcctagacgggtcctgactgattcntagctaccagtctgcactcgacncncctcacacncngtcgcgtcgtaccgagagtgaggctagtatatactgtgtagtacgacgacgacagagtgtagagaacatgtgnggtggttggtcggtcggcggcgacgaacgtacgtcgtcgtacgacgaacgcgtaacg

SEQ ID NO: 310671 - DNA, 606 bp, Homo sapiens
  misc_feature: GZ8MTXP01ASI1R.21.22.B11.1.454.CMB.2.raw
  modified_base (199)..(199): a, c, t, g, unknown or other
  misc_feature (199)..(199): n is a, c, g, or t
  modified_base (232)..(232): a, c, t, g, unknown or other
  misc_feature (232)..(232): n is a, c, g, or t
  modified_base (254)..(254): a, c, t, g, unknown or other
  misc_feature (254)..(254): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctcgggacccccggnagagggtcaccatctcttgtctggagcactcanatcgaatatatgtattctgtancagcaactccaggaactcggacccccaaactcctacactcccagacggaataatcagccgaccctcgacggggtcccctgaccgtattcctctggcctcccgaaaagtccttggccaccctcacgtccctccctacgacccacgtcgacgggtcggccgtccgggtacgacgggtatcggacggcgttacgtaacttacgttacgtgggtcgacctactaccgggaccgggaacaccgaagtaggtcggatacggaacttagtcgtagggacggtcggggttggtaccgggttcggaacggggcgaacccgtaaagccggtaaccgtacgtcggacgtcgaacccgtaacgg

SEQ ID NO: 310672 - DNA, 769 bp, Homo sapiens
  misc_feature: GZ8MTXP01AK265.21.22.B11.1.454.CMB.2.raw
  modified_base (198)..(198): a, c, t, g, unknown or other
  misc_feature (198)..(198): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctctcactcactgcgcagggtcctgggcccagtctgtgctgactcacgccacctcagcgtcgtcgggaccccggnacggaggtcacctatcttcttgttccgtggaacgcctaactccaaactagtacgggtaaagttaattagttagtacttcgtaggtactacgacgacaaccgttaccgaacggtaactcccggaaccccctaaactcctacactaccgaagaaggtaaactacgtaccgacggtcccggtacccgtacggaccggggtccctacggacccgtactttccgtacgtcggacctacgtaacgtacgtcggacctaccctcaccgtccctccgtacgaacccagttcgaaccggtcgggtcccgtacggttacggaaggtacgtacggtacgtacgtacgtaacttacgttaccgtggttacgcgtaacctaccgggaacggacaacgaaacgtggtaacggtattaacgaacgttaacgtcggtacggttacgggggttacggggtttcgggggtaacgttacccgggggaaccgggttaaaccggggttaaacccgttaaaccggggtcccggttaaccccgggttaacgggtacgggttaacccggaacgggttaaccccggtaaacccggg

SEQ ID NO: 310673 - DNA, 673 bp, Homo sapiens
  misc_feature: GZ8MTXP01CN1T9.21.22.B11.1.454.CMB.2.raw
  modified_base (200)..(200): a, c, t, g, unknown or other
  misc_feature (200)..(200): n is a, c, g, or t
  modified_base (268)..(268): a, c, t, g, unknown or other
  misc_feature (268)..(268): n is a, c, g, or t
  modified_base (317)..(317): a, c, t, g, unknown or other
  misc_feature (317)..(317): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctcgggaccccccggnaggagggtcaccatctcttgttctggaggcaactccaaacatcggaaagtattatgttattctggtancagcaactcccgaggactccgaccccaactcctcatccaagagaatacncagccgcctcgacgggtcctgaccgtacttcacgtggtcctaccgaaagtccgtcggcctacccgtcacgcccctcctacgaccctagtcgaggtcgggccgttccgggtacggaggtgtggacggcttacgaacttagttaacgtgggggtacacgtagtaccgaaccgggggtaacaccggaaactaggtggggtaacttcggaaacctacgttcgggtacggttagggtccgggggttttggggtaccggggttaccgggacgggggttaacggaaccccgtttaaaacggtcccggttaaccccggttcggttaccggggttacctaacccgggttccccggtaaaccgggg

SEQ ID NO: 310674 - DNA, 772 bp, Homo sapiens
  misc_feature: GZ8MTXP01DF6MZ.21.22.B11.1.454.CMB.2.raw
  modified_base (202)..(202): a, c, t, g, unknown or other
  misc_feature (202)..(202): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcacgccaccctcacgccgtcgtcgggaccccggnaggacgggtcacctatctcttgtcgtggacgacaacctaccaaactagtacggtaagttaattagtgttattcgtaggtatcacgaccaaccgtaccgaaggaactacccggaacccctaaactccctacactacgaagaaggaaactaacgtcgaccgggccggtacccgtacggaccgggtccgtacgtaccgtacttccgtcgtcggtacctacgtaaacgttcgtcggccctaccctcgaaccgtcccctccgtacgtaccacgtacgtacgggtccgggccgttaccggttacggacggtacgtggacggtacgtacgtaacgtttacgttacgtaggggtacgtacgtaacgtacccgggaacggtacccgaacgtaaacgtacgggtaggtaacgtacgtaacctaacggtcggtaaggttcgggggtttacggggttcgggttaccggggtccgggggttaaaccgggggaaccggttaaaacccggttaacgggacccggttccccgggttaacggttaccgggttacccggaacccgggttaacccgttaaccccggggg

SEQ ID NO: 310675 - DNA, 709 bp, Homo sapiens
  misc_feature: GZ8MTXP01BI45Y.21.22.B11.1.454.CMB.2.raw
  modified_base (201)..(201): a, c, t, g, unknown or other
  misc_feature (201)..(201): n is a, c, g, or t
  modified_base (265)..(265): a, c, t, g, unknown or other
  misc_feature (265)..(265): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgagcgagggtcctgggcccagtctgtgctgactcagcccaccctcagcgtctcgggacccccggnagagggtcaccatctcttgtctggagcaactcaacatacggaagtaattatgtattctggtacncagcaactcccaaggaactcggacccccaaactcctacactccaagaacggtaaataaacgtccgaacgcccggtcccctacgaccgggggttcccctggaacccgtactttcctacgtcggcctacctaaacgtcgtcgaccacctccgactccctaccctagacccagtccgaagggtccggggtaccttcccggggaccgaaaggggtcgttacggaacgggtccttaagtaacccttaagtttacgcggggttaacggcctaaacgtcccgggaaacgggggacccaacctaaacggtaggtacgggtattacgaaccgtaaagttccgtaggggagggttccggggtttaggggtacgttcgggggaaccgggttacgggaaccctaaaggtccggtaacccggttaccggaggttacccgaaccggccccgtaagggg

SEQ ID NO: 310676 - DNA, 788 bp, Homo sapiens
  misc_feature: GZ8MTXP01AM3ZF.21.22.B11.1.454.CMB.2.raw
  modified_base (204)..(204): a, c, t, g, unknown or other
  misc_feature (204)..(204): n is a, c, g, or t
  modified_base (267)..(267): a, c, t, g, unknown or other
  misc_feature (267)..(267): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcacgccaccctcaggccgtcgtcggggacccccggnaggacgggtcacctatctcgttgttcgtggaggacaactccaactagtacggaaagttaattntagttattcgtaggtatcagaccaacctccgaaggaactcccggaacccccctaaactcccgttaccaacttacccgaagaacggtaaataacgtaccgacgggcccggtccccgttacggaccgggggttcccctacggtaccccgtaacgtttccctacgtcggtaccctaccgtaaaacgttcccgtcgggaccctaaccctaccgacccgtccccctacccgtacggaaccctacttccggaacggggtttccggggaccccgtttacccggggtaccgtaacggggtagttaccgggaacggtaccgttacgtaaaccgtttacgtttaaccgttcggggttacgaacctttaaccgggtacccggaaaccggggacgtaacccgaaaccgtagggtaggtaagtacgtaaacctaggtcgtgggagggttcgggttagggtcggttacgggacggacggttaaccgaacgttcggaacccgttacggacggttacgtaaccggaaccgtaaccgg

SEQ ID NO: 310677 - DNA, 703 bp, Homo sapiens
  misc_feature: GZ8MTXP01EU803.21.22.B11.1.454.CMB.2.raw
  modified_base (203)..(203): a, c, t, g, unknown or other
  misc_feature (203)..(203): n is a, c, g, or t
  modified_base (520)..(520): a, c, t, g, unknown or other
  misc_feature (520)..(520): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagcccaccctcagcgtcgtcggggacccccgggnaggagggtccaccatctcttgttctggaggacaactccaacatacggaagttaattatgtattcgtggtatcagacaactcccaaggtaactccggacccccaaactcctacactaccaagagaaatactcacggccgacctcggacggggtccctaggacccgtacttcctacgtcggcctacccgaaaagtcctcggacctaccctcgacgtcccctccctacgaaccctattcccgagggttccgggccgttacccggggtcccggaaagggtacgttcggaacgggtacttacgaaacctttaagtttaccgnggggttacgacccgtactacccgggaaacgggggacccacgaaacggtaggtggggaacttaggaaacccaagttccgtgggttaccgggtgggggtttgggtcggggtaccggacggggacggaccctaaacggttccggaacccgttacggacggttacgaacccggttccgtaacccggg

SEQ ID NO: 310678 - DNA, 654 bp, Homo sapiens
  misc_feature: GZ8MTXP01EZWK2.21.22.B11.1.454.CMB.2.raw
  modified_base (204)..(204): a, c, t, g, unknown or other
  misc_feature (204)..(204): n is a, c, g, or t
  modified_base (551)..(551): a, c, t, g, unknown or other
  misc_feature (551)..(551): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcacgcccaccctcagccgtcgtcggggacccccggnaggacgggtcacctatcttcttgttctggacgacaactcaacatacggtaattaattatgttattcgtggtactcagacaactccgaaggactccggacccccaaactcctacactaccgaagaagaaatagtccacgccggccctaggaacgggtccctacggtacctacttcctcgtacgtcctaccgtaaacgttcctcggacctaaccgtctaccgtcccctccgtacgacctactacgacggtcgggtccgtaccggtacggaaggacgtcggacggtctacgtaacttattcgtcgggtcgacgtacgtaccggaacgggccaagaaacgtggacgggtanaacgtaacgtagtcggtgggttagggttcgggttggggtacggtacgggacggttacggaacctaacgtcggtaacccgtcgtacggccgtaaccgccgtaag

SEQ ID NO: 310679 - DNA, 764 bp, Homo sapiens
  misc_feature: GZ8MTXP01EZRO8.21.22.B11.1.454.CMB.2.raw
  modified_base (201)..(201): a, c, t, g, unknown or other
  misc_feature (201)..(201): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagcccaccctcagcgtcgtcgggacccccggnaggagggtcaccatctcttgttctggagcaactcaacatcggaaattaattatgtattctggtatcagctaactccaaggaaactccggaccccctaaactccctacactaccaagaacggtaaataactcgaacggacccggtccctaccggaacgggggtcccctaggacccgtatttccgtcgtacgggccttacccgaaaacgttcgtccgggtacctacccgttacgacccggtcccccttaccccgttacggaaacccctacgttacccggtaacgggttccgggggtaacccgttccccggggttaccgggaaacgggtatttacgggggaaccgggtcttaacgtaacgttaacgtttaaccgtggggttacggaccgtaaacgtccggaaacgggggaccaccgaaacgtacggtcgggtaaatcggtaaactaaacgtcggtaaccggagggggttcgggttttggggacggtttaccggggacgggttacgggttaaccaaacggttccgggtaacctaccggtaggttaccaacggttaacccgtaacggg

SEQ ID NO: 310680 - DNA, 707 bp, Homo sapiens
  misc_feature: GZ8MTXP01B6NUP.21.22.B11.1.454.CMB.2.raw
  modified_base (201)..(201): a, c, t, g, unknown or other
  misc_feature (201)..(201): n is a, c, g, or t
  modified_base (254)..(254): a, c, t, g, unknown or other
  misc_feature (254)..(254): n is a, c, g, or t
  modified_base (267)..(267): a, c, t, g, unknown or other
  misc_feature (267)..(267): n is a, c, g, or t
  modified_base (282)..(282): a, c, t, g, unknown or other
  misc_feature (282)..(282): n is a, c, g, or t
  modified_base (336)..(336): a, c, t, g, unknown or other
  misc_feature (336)..(336): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagcccaccctcagcgtcgtcgggacccccggnagaggtcaccatctcttgttctggacgcaactaccaacagtacggaagtaatntgtattctggtancagcaactccagacncgccccaaatccacatccagaaggaatatcacggccgccctgaccgggttcccnggtacctacttcctagtcggcctaccgaaaagttcgtcggccctacctcgaccgtcccctccgtacgaaccctagtccgacgggttcgggcccgttacccgggttcccggaaagggtcgtaacgggtcggtaccgtacggttaactttacttaaccggtttggggacggttaccaaacggttccggaaacccgggggacctaaccgaaagtacggttggggaaccttggaaacctagtaaccggtgggaacgggttccggggttttgggggtaacgggttccggggaccgggttaacggttaaaccccgtaaacggtccggggttaacccttccgggttaacggaccgtaacccggttaacccgaaccggg

SEQ ID NO: 310681 - DNA, 719 bp, Homo sapiens
  misc_feature: GZ8MTXP01ED70S.21.22.B11.1.454.CMB.2.raw
  modified_base (200)..(200): a, c, t, g, unknown or other
  misc_feature (200)..(200): n is a, c, g, or t
  modified_base (235)..(235): a, c, t, g, unknown or other
  misc_feature (235)..(235): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtcgtcgggacccccggnagacgggtcaccatctcttgtctggagcactcaanatcggaataatatgtatcgtgtatcagcaactccaggaactccggacccccaactcctcactaccagaaggtaaataactacacgccggcctacgacgggtccctcgaccgtacttccgtcgtcggtcctaccgtaaacgttctcgggcctaacccgtccaccgtccccttaccccgttacgaaccctacgttccgtaaggttccggggcccgttaccccgggttaccggaacgggtacggttacgggtaacgggtccgttaacggtaacctttaacgtttaccgttcggggttacgtaccgtaaccgttacccggaaaccgggggaacccgtaaccgaaaccgtaacggtacgggtaattacgggaaacctaaggtccgttagggttacgggtcggggtttcggggtcgggttacgggaccgggttacggaaaccgtaacgtacgtaacccggtacgacggttacgcccgaaccggtaaccgg

SEQ ID NO: 310682 - DNA, 622 bp, Homo sapiens
  misc_feature: GZ8MTXP01DUSBW.21.22.B11.1.454.CMB.2.raw
  modified_base (298)..(298): a, c, t, g, unknown or other
  misc_feature (298)..(298): n is a, c, g, or t
  modified_base (339)..(339): a, c, t, g, unknown or other
  misc_feature (339)..(339): n is a, c, g, or t
  modified_base (348)..(348): a, c, t, g, unknown or other
  misc_feature (348)..(348): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccatcctcagcgtcgtcggggacccccggcaggagggtcaccatcttcttgttctggacggcaactccaacagtacggaaagtattatgtattctggtatcagcaactccgagactcgaccccaaancctcaatccaagagaatactcgacgcgcctcgacgggtccncgacccgtnttctcgtcgctaacccgaagtcgtcgcccactcacgtccctctcgacctagtcgaggtcgggccgtccggtaccggaggtactgggacgtcctagtaacttagttacgtgttcgacttacgacggaccgggacacgaaaccgtgtacggggtaatcggtaacgtaaacttggttaagggtccggttgggggttagggttcgggttacgggcggggttaaccgggaacctaaacggtccggtacccgtacggacggtaacgaacggtaaccccgg

SEQ ID NO: 310683 - DNA, 627 bp, Homo sapiens
  misc_feature: GZ8MTXP01CPFQT.21.22.B11.1.454.CMB.2.raw
  modified_base (266)..(266): a, c, t, g, unknown or other
  misc_feature (266)..(266): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagcccaccctcagcgtctcgggacccccggcaggagggtcaccatctcttgttctggagcaactccaacatcggaagtaattatgtattcgtggtancagcaactcccaggaactcggacccccaaactcctacactccagaaggaataatcacgcggccctcgacgggggtccctgaccgtacttcctctggcctcccgaaagttcctcggccacccgtcacgtccctccctagaccctatcaggtcgggctccggtcgaggactgaggctgactattacgtggtgctactcggaaccgggacacaacgagtacggggaatacggaaacaagttcgtgggacgggttcggggtttgggggtacggtttccgggggacggggttaaggggttaaacccctaaacggtcggtaaccccggttccggtaacgggttcccgtaaccggccccggtaacggg

SEQ ID NO: 310684 - DNA, 605 bp, Homo sapiens
  misc_feature: GZ8MTXP01DIVAM.21.22.B11.1.454.CMB.2.raw
  modified_base (201)..(201): a, c, t, g, unknown or other
  misc_feature (201)..(201): n is a, c, g, or t
  modified_base (235)..(235): a, c, t, g, unknown or other
  misc_feature (235)..(235): n is a, c, g, or t
  modified_base (247)..(247): a, c, t, g, unknown or other
  misc_feature (247)..(247): n is a, c, g, or t
  modified_base (251)..(251): a, c, t, g, unknown or other
  misc_feature (251)..(251): n is a, c, g, or t
  modified_base (254)..(255): a, c, t, g, unknown or other
  misc_feature (254)..(255): n is a, c, g, or t
  modified_base (276)..(276): a, c, t, g, unknown or other
  misc_feature (276)..(276): n is a, c, g, or t
  modified_base (278)..(278): a, c, t, g, unknown or other
  misc_feature (278)..(278): n is a, c, g, or t
  modified_base (313)..(313): a, c, t, g, unknown or other
  misc_feature (313)..(313): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagcccaccctcagcgtcgtcgggacccccggnagacgggtcaccatctcttgtctggagcactcanatacgatatatntatntgnnagcactccagatcgcccaacncncatccagagaatatcacgcggcctcgacgggtccngacccgtattcctcgtcggtcctcccgaaacgttctcggccacccgtccacgtccctcctcgactatcgaggtcggcgtccggtcgaggcgtgacggctacgacttatacgtggtgactaagtcgaccgggtacgcgaaactaggtgggtatggaactaacgttcgttggaaccgggttcgggtttgggtaggggtttaccgggaccggggttaacggggttaacccctaaaacggttcggtaaccccggttacggtaccgggttacgaacccgttccccggtaaacccggg

SEQ ID NO: 310685 - DNA, 666 bp, Homo sapiens
  misc_feature: GZ8MTXP01BGHAF.21.22.B11.1.454.CMB.2.raw
  modified_base (200)..(200): a, c, t, g, unknown or other
  misc_feature (200)..(200): n is a, c, g, or t
  modified_base (236)..(236): a, c, t, g, unknown or other
  misc_feature (236)..(236): n is a, c, g, or t
  modified_base (260)..(260): a, c, t, g, unknown or other
  misc_feature (260)..(260): n is a, c, g, or t
  modified_base (295)..(295): a, c, t, g, unknown or other
  misc_feature (295)..(295): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtcgtcgggacccccggnagagggtcaccatctcttgtctggagcaactccaantcggaagtatatgtattctggtancagcaactcccgagaactccggacccccaaatccncactaccaagaggaaatactcgacgccggccctacggaccggggtccctacggaccgtacttcccgtcgtggtccctacccgtaaagttcctcggtacccaacccgttcaccggtccccttccgtacgaaccctacgttccgacgggttcggggacccttcccggggtaccggaagggtagtcggacgggtctacgtaaccttaagttcctggggtacgtcgtaacgtcggaacggggacccagtaacgaagtggggacttacggaactaagttcgagggaggtcgggggtttgggcggttacgggacgggttagggaaccctaacggtcgtaaccccgtcggtacggttacctaaccggccccggaaggg

SEQ ID NO: 310686 - DNA, 600 bp, Homo sapiens
  misc_feature: GZ8MTXP01A63RP.21.22.B11.1.454.CMB.2.raw
  modified_base (202)..(202): a, c, t, g, unknown or other
  misc_feature (202)..(202): n is a, c, g, or t
  modified_base (308)..(308): a, c, t, g, unknown or other
  misc_feature (308)..(308): n is a, c, g, or t
  modified_base (325)..(325): a, c, t, g, unknown or other
  misc_feature (325)..(325): n is a, c, g, or t
  modified_base (375)..(375): a, c, t, g, unknown or other
  misc_feature (375)..(375): n is a, c, g, or t
  modified_base (389)..(389): a, c, t, g, unknown or other
  misc_feature (389)..(389): n is a, c, g, or t
  modified_base (458)..(458): a, c, t, g, unknown or other
  misc_feature (458)..(458): n is a, c, g, or t
  modified_base (489)..(489): a, c, t, g, unknown or other
  misc_feature (489)..(489): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagcccaccctcagcgtcgtcgggaccccccggnaggagggtccaccattctcttgttcgtggagcaactacaacatacggaattaattatgttattctaggtatcagacactacccgaggactccggacccccaatccncactccagacgaaatancagccggcctgacgggtcctgacctacttctgtcggctaccgaacgttcncggccacctcgacnccctcctagacctagtcgaggtcgggcctccgggtcgaagggatgggaacggctgtaacttagttacgngtcgtacagtccggaacgggcacgataaggnggtactacggactagtcgtgggacgggtcgggttaggtcgggtaacgggacgggttacggaaactaacggtcgtaacgttcccggaggttaccaacggttaacccgtaacg

SEQ ID NO: 310687 - DNA, 722 bp, Homo sapiens
  misc_feature: GZ8MTXP01B20DP.21.22.B11.1.454.CMB.2.raw
  modified_base (201)..(201): a, c, t, g, unknown or other
  misc_feature (201)..(201): n is a, c, g, or t
  modified_base (239)..(239): a, c, t, g, unknown or other
  misc_feature (239)..(239): n is a, c, g, or t
  modified_base (586)..(586): a, c, t, g, unknown or other
  misc_feature (586)..(586): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagcccaccctcagcgtcgtcgggacccccggnaggagggtcaccatctcttgttctggagcaactccaanatacggaattaattatgtattctggtatcagactaacctcccaaggaaactccggaccccccaaactcccctacactaccgaagaagaaataactcgacgcccggccctacggaccgggggtcccctaggacccgttacttcctcgtcggcccttaccgtaaaagttcctcggccctaacccgtccgaccgtccccttcccgtacgacccattccgaacgggttccggggacccttaccccggggtacggaacgggtacttcggggacggtcccgttagaacccgtttagtttaccgtggggttacgacgtacgtaccgggaacggggaccaccgtaaacgtagggnggtaatacgaactaagttcgtacgggttacgggttccggggtttgggggtacggtacggggacgggaccgggttaaaccctaaaggtcccggtaaccggttccggtaggttacccgaaccggttcccgtaaccggg

SEQ ID NO: 310688 - DNA, 744 bp, Homo sapiens
  misc_feature: GZ8MTXP01CKVRW.21.22.B11.1.454.CMB.2.raw
  modified_base (200)..(200): a, c, t, g, unknown or other
  misc_feature (200)..(200): n is a, c, g, or t
  modified_base (266)..(266): a, c, t, g, unknown or other
  misc_feature (266)..(266): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtcgtcgggacccccggnaggagggtcaccatctcttgttctggagcaactccaacatcggaagtaattatgtattcgtggtancagcaactcccgaaggaactccggaccccctaaactccctacactaccgaagaacggaaataactccgacggcccggcccctacggacgggggttcccctaggaacccggttactttccgtacgttcgggtaccctacccgtaaaacgttcccgtcgggaccctaaccctccgaccggtccccttaccccgtacgaacccctaagtccgaacgggttcggggtcccgttacccggggtaccgggaagggtacgttacgggacgggtcgttacgtaactttacgtttaccgttggggtacgactacgtacccggaaccggggaccacgaaacgtaggtacggggtaactacggaaactagtcggtacgggttacgggttcggggttaggggttcgggttacggggacggggttaacgggaacccgtaaacggtccggtaaccggttccgtacgggttaccaaccggaacccgtaacggg

SEQ ID NO: 310689 - DNA, 698 bp, Homo sapiens
  misc_feature: GZ8MTXP01EXIH7.21.22.B11.1.454.CMB.2.raw
  modified_base (201)..(201): a, c, t, g, unknown or other
  misc_feature (201)..(201): n is a, c, g, or t
  modified_base (242)..(242): a, c, t, g, unknown or other
  misc_feature (242)..(242): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagcccaccctcagcgtcgtcgggacccccggnaggacgggtccaccatcctcttgttctggagcaactccaanatacggaataattatgttattcgtggtatcagacctaacctcccgaaggaactccggacccccaactcctcactccaagaggtaaataacgtcgacggccgtccctcgaccgggggtccctacggtaccgtactttctcgtaggtccctacccgaaagttcctcgggacctaacccgtcgaccgtccccttccacgtacccattcgagggtcgggccgttcccgggacggtaggagttcggacggtactacgtacgttaagttacgttggggtacgtacgtacgtaccggaaccggggaccaccgaacgtaaggtcggtaactacgtaacctaagttcgtaggttacggggttcggggtttcggggtacggttacccggggagggttaaccgggttaacccgtaacgtcgggtaaccccgttaccggacggttaccgtaaccggccccggtaacgg

SEQ ID NO: 310690 - DNA, 719 bp, Homo sapiens
  misc_feature: GZ8MTXP01BH0N3.21.22.B11.1.454.CMB.2.raw
  modified_base (200)..(200): a, c, t, g, unknown or other
  misc_feature (200)..(200): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcacgcccacctcagcgtcgtcgggaccccggnagaggtcacatctcttgtctggagcaactcaacatacggaagttaattatgtattcgtaggtatacacgactaacctccgaaggaactccggaaccccctaaactcccgacaactacgaagaaggtaaataacgtacgacggcccggtccgtacggtacggggtccctggacccgtattcctcgtacggtcctaccgtaaagttccgtcgccaacccgtcaccgtcccctccgtacgaacctcgttacgacgggttcggcccgttaccgggacgtaacggtagtcggtacggcttaagacttagttaccgtggacgtacgactaccggaacgggacaccgaagttacggacggttaatacggaacttaaggttccggtaaggttccgggggtttccggggttaggggttacgggtttacgggggaaaccggggaacgggttaaaaccccgtaaagggttcccgggtaaccccggtttaacggaaccggttacgaaccccgggaacccggttaaccgggg

SEQ ID NO: 310691 - DNA, 814 bp, Homo sapiens
  misc_feature: GZ8MTXP01B0CA2.21.22.B11.1.454.CMB.2.raw
  modified_base (202)..(202): a, c, t, g, unknown or other
  misc_feature (202)..(202): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagcccaccctcacgcgtcgtcgggacccccggnaggagggtcaccatctcttgttctggagcaactccaacatcggaattattatgtattctgtatcagcactccaggactcggaccccaatcctcactccaagacggtaaatatccgaacggccggtacccctacggaccgggggttccctcggaaccggtactttcccgtcgtcgggtccccttacccgtaaaacgttcccgtaacggggccctaaccccgttaccgaaccggtcccccttacccccgttagaacccccgtacttcccggtaacggggttcggggacccgttaccccggggggttcccggaaagggggttacgtacggggtaaccgggccgtttaaacgggaccttttaaagtttacccggttgggggtttacgacccgtaacgttacccggggaacccgggggtaaccgtaccgaaaccggtacggttaagggggtacttaacgggaactaacggttaacccgtggggttaaacggggttccgggggtttgggggttcccgggttcgggggaaccgggggacggggttaaacccctaaagggtcccggtaacccggttaccgggtacggttacccggaacccgttaacccgggtaacccggg

SEQ ID NO: 310692 - DNA, 724 bp, Homo sapiens
  misc_feature: GZ8MTXP01EKQ7N.21.22.B11.1.454.CMB.2.raw
  modified_base (203)..(203): a, c, t, g, unknown or other
  misc_feature (203)..(203): n is a, c, g, or t
  modified_base (245)..(245): a, c, t, g, unknown or other
  misc_feature (245)..(245): n is a, c, g, or t
tcagtcgtcgctcgcacgaccggtgctcgatttagacgacagctcaggggagcttcagctgtggtagagaagacaggactcaggacaatctccagcatggccggcttccctctcctcctccaccctcctcactcactgcgcagggtcctgggcccagtctgtgctgactcagcccaccctcagcgtcgtcggggacccccggnaggacggtcacctatctcttgttcgtggacgcaactaccaanagtacggaaattaattatagtattctaggtatcagacaacctccgaaggaactccggacccccaaactccctacgactaccgaagaagaaataatcgacgccggtcccgagaccggggtccctagaccgtacttcctcgtcggccctaccgtaaaacgtcgtcggacctacccttccgaccgtcccccgtaccccgtcgtaaaccctacgtaccgtaacgggttcggggaccccgttcccggggtacggtaaacggggagttacgggaacgggtcttaacggtaactttaacgtttaaccgtggggttacgacgtaacgtaccggtaaccgggggaacacccgtaaacgtaggtaggtaataacgaactaaacgtcgtagggaacgggttcggggttagggtcgggttaaccggacggggaacgaacccgtaacgtacggtaaccgttacggtacgccgaaccgttaacccggaaccgg

SEQ ID NO: 310693 - DNA, 602 bp, Homo sapiens
  misc_feature: GZ8MTXP01AJ89S.21.22.B11.1.454.CMB.2.raw
  modified_base (198)..(198): a, c, t, g, unknown or other
  misc_feature (198)..(198): n is a, c, g, or t
  modified_base (257)..(257): a, c, t, g, unknown or other
  misc_feature (257)..(257): n is a, c, g, or t
  modified_base (470)..(470): a, c, t, g, unknown or other
  misc_feature (470)..(470): n is a, c, g, or t
  modified_base (498)..(498): a, c, t, g, unknown or other
  misc_feature (498)..(498): n is a, c, g, or t
  modified_base (573)..(573): a, c, t, g, unknown or other
  misc_feature (573)..(573): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctgggacccccggnagagggtcaccatctcttgttctggaggcactcaacatcggaagtatatgtatctgtancagcaactccaggaatcggcccccaaatcctcatccagagaatactcagcggccctcgacgggggtccctggaccgtactttcctacgtcgggtcctccgaaaacgttcccgtggccctaccctcacgtccccttccctagacccatccgaggtcgggtaccttcccgggtaccgagggtactggacgggtaccttagtaactaatttaccgngggttacggacctagtccgacggggacncgtaaacagtgggattcggaacaagtcgtagagggtccgggttggggtgttcggacgggttacgggacctaacgngaaccgtctagggcctaagcccgtaacgg

SEQ ID NO: 310694 - DNA, 750 bp, Homo sapiens
  misc_feature: GZ8MTXP01C3QHT.21.22.B11.1.454.CMB.2.raw
  modified_base (181)..(181): a, c, t, g, unknown or other
  misc_feature (181)..(181): n is a, c, g, or t
  modified_base (204)..(204): a, c, t, g, unknown or other
  misc_feature (204)..(204): n is a, c, g, or t
  modified_base (243)..(243): a, c, t, g, unknown or other
  misc_feature (243)..(243): n is a, c, g, or t
  modified_base (270)..(270): a, c, t, g, unknown or other
  misc_feature (270)..(270): n is a, c, g, or t
tcagtcgtcgctcgcacgaccggtgctcgatttagacgacagctcaggggagcttcagctgtggtagagaagacaggactcaggacaatctccagcatggccggcttccctctcctcctccaccctcctcactcactgcgcagggtcctgggcccagtctgtgctgactcagcccaccctnacgcgtccgtcgggacccccggnagacggttcaccatcttcttgttctggagcaactccaanatacggaattaattatgtattctgtancagacaactaccgaggaactccgaccccaaactcctcactcaagaagaaatactcgacgccggccctcgacggggtccctgaccgtacttcctcgtggccctaccgtaaaacgttcgtcgggacccacccttacgaccgtcccctaccccgtacgaaccctagttaccgacgggttccggggacccgttccccggggtaacccggtaagggtacgtacgggtaacggtccgttaacgtaactttaacgttaccgttggggttacgaccgtaacgtacccggaaccgggaaccgaacgaaacgtaagttaggggtaacttacggaaccgtaaacgttccggtagggttaacggggttcggggtttacggggtttaccggggttacggggaaccgggggttaacggggttaaaacccgaaaccggttacccggtaacccgggttccgtaacgggttaccgtaaccggttccccgtaaccggg

SEQ ID NO: 310695 - DNA, 741 bp, Homo sapiens
  misc_feature: GZ8MTXP01AJAZD.21.22.B11.1.454.CMB.2.raw
  modified_base (204)..(204): a, c, t, g, unknown or other
  misc_feature (204)..(204): n is a, c, g, or t
  modified_base (354)..(354): a, c, t, g, unknown or other
  misc_feature (354)..(354): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcacgcccaccctcacgcgtcgtcggggacccccggnaggacgggtcacctatctcttgttcgtggacggcaactccaacagtacggtaaagttaattagtgtacttcgtggtactcacgccaacctccgaggaactccggaccccaactcctacactcaagacggaaatacgtcgagcccggtccncgtaccgggtcctcgaccgtacttccacgtcgacctcgaaacttccggtcgcctaccctacgaccgtccctaccctcggaaccctatccgacgggtcggggacccgtttccggggaccggaagggtacgttacggacgggtaccttagtaactttaaccgtttcgacgggtacgtacggtaccgtaaccgggaaccgggtaccgaacgaaaccgtggttaaacgggacgttaaacggaactaggttaacgtcggggttacgggttcgggggttacggggttacgggttacgggggaccgggttaaacgggttaaccccgtaacgggttacgggtccccggtttacgggaaccgggttaccaacccggggttccccggtaaacccggg

SEQ ID NO: 310696 - DNA, 643 bp, Homo sapiens
  misc_feature: GZ8MTXP01ERUMR.21.22.B11.1.454.CMB.2.raw
  modified_base (201)..(201): a, c, t, g, unknown or other
  misc_feature (201)..(201): n is a, c, g, or t
  modified_base (264)..(264): a, c, t, g, unknown or other
  misc_feature (264)..(264): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagcccaccctcagcgtcgtcgggacccccggnagaggtcaccatctcttgttctggagacaactcaacatacggaataattatgtattctggtancagcaactaccgagactccgaccccaatcctacataccagagaaatatcagccgcctacgacgggtcccagaccgtacttcagtcggcctaccgaaagttctcggaccctacctcaccgtccccttcccagacccactcgtacgggtcgggaccgttaccgggtaccgtaagggtacgtagggaacggtcttacgtaacctttaagttaccgttgtacggtctaacgtaccgaaccggggaacgacaaacgtaggtgggaatacggaactaagtcgtaggttacgggtcgggtttagggtcggttacggggacgggttacggaacccgtaaacggtcgtaacccgttcggtacggttacccgaacggttcccgaaccgg

SEQ ID NO: 310697 - DNA, 722 bp, Homo sapiens
  misc_feature: GZ8MTXP01BYXHS.21.22.B11.1.454.CMB.2.raw
  modified_base (202)..(202): a, c, t, g, unknown or other
  misc_feature (202)..(202): n is a, c, g, or t
  modified_base (308)..(308): a, c, t, g, unknown or other
  misc_feature (308)..(308): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagcccaccctcagcgtcgtcgggacccccgggnaggagggtcaccatctcttgttctaggagcaactccaacagtacggaaagttaattatgtattctggtatcagacaacctccaggaactccggaccccaaactccncactccagagtaaatactcgacgccgccgtcgacggggtccctagaccgtattccgtatcggtctaccgtaaacgtccgtcggccctaacccgttcacccggtcccccttacccgtacggtaacccacgttcgtacggggttcggggccccgttaccggggtaccggaagggtacgtacgggaggtcccttagtaacctttaagttccgttggggtaccgtacgtacgtaccggtaacggggacctaaccgaagtacgggttgggaacttacggaaccttaaggttcccggtaagggttcggggttccggggttttggggtacccgggttacggggaaccggggttaacgggttaacccccgtaaagtccggtaacccggtttacggacggttacccgtcgaaccccggtcggg

SEQ ID NO: 310698 - DNA, 724 bp, Homo sapiens
  misc_feature: GZ8MTXP01ENN9X.21.22.B11.1.454.CMB.2.raw
  modified_base (201)..(201): a, c, t, g, unknown or other
  misc_feature (201)..(201): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcacgccaccctcagcgtcgtcgggacccccggnaggaggtcaccatctcttgtctggacgacaactccaacatacggaattaattatgtattctaggtatcagcaactccaggaactccggacccccaatccgacactaccgagaaggaataactcgacggccgtccctagtaccggggtccctaggaccgtacgttcctcgtacggcctaccgaaagttccgtcggaccctaccctccgtaccgtccccttaccggcgtaaacccctacgtacgtacgggtccgggtccgttaccgggttacccgaagggtcctagggtacggtcttaacggtaactttacgttaccgtagggtcgtaccgtacgtaccggaaaccgggaccgtaaccgtaaggtacggtaggggtaactacggtaaacgtaggtccggttgggaaacgggttccgggggttttggggtacgggttcccggggaacggggttaaaccggaacccggtaaacgtccggtaacccggtcggtacggttaccgaacccgggttaaccgtaaccccggg

SEQ ID NO: 310699 - DNA, 813 bp, Homo sapiens
  misc_feature: GZ8MTXP01A6I3Z.21.22.B11.1.454.CMB.2.raw
  modified_base (200)..(200): a, c, t, g, unknown or other
  misc_feature (200)..(200): n is a, c, g, or t
  modified_base (269)..(269): a, c, t, g, unknown or other
  misc_feature (269)..(269): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcacgccacctcagcgtcgtcgggacccccggnaggacggtcactatctcgttgtcgtaggagacaactacaacatacggaatattatgttattctaggtancagaccaactaccgaagtaactccgacccctaaactcctacaactccaagaagaatactcgaacggcccggtccctacggaaccggggtcccctacggtaccgttaccttcctacggtcggtacccctacccgtaaaacggttccgtccgggaccctaacccgtaccgacccgtcccccttaccccgtacgaaacccctgttaccggaacgggttccggggtcccgttacccggggttaccggaaaggtcgttacgggacgggtccttaaacgttaactttacgttaccgtgggggttacgaccgtacgtacccgggaacccggggacaaccgtaacggtaacgggttaggaaacgtaccggtaaaacgtaacgggttccggtaaaggggttacgggggttttaccgggggttcgggggtttaaccggggttaaccggggaacccgggggttaaaccgggttaaacccgtaaaccgggtttcccggaacccggtttacccggaagggggttacccctaacccggggttaacgtaacccccgggg

SEQ ID NO: 310700 - DNA, 695 bp, Homo sapiens
  misc_feature: GZ8MTXP01DY88C.21.22.B11.1.454.CMB.2.raw
  modified_base (238)..(238): a, c, t, g, unknown or other
  misc_feature (238)..(238): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagcccaccctcagcgtcgtcgggaccccccgggaggaggtcaccatctcttgtctggagcaactccaanatacggaattaattatgtattctagtatcagcaactccaggaactccggaccccaactcctacactccaagaagaataatcacgcgcctgacggtccagaccgtatctcgtcgcctaccgtaaagtccgtggcctacccttcgacgtcccctcctacgaccctatcgacggttcggccgttcccggtaccggaggtactggacgtctagtaaccttagttacgtcgggtacgacgtaacgtaccgggaacggggacctaaccgaaagttaaccgggtcggggtaatacggtaaacgtaacggttccgtaaggggttaccggggttgggggtttcgggggttaccgggttacgggggaccggggttaaaccgggaaacccgtaaaaccgggttccggtaacccggtttacccggtacgggttacccggtaaacccgggaacccccgttaaacccgggg

SEQ ID NO: 310701 - DNA, 661 bp, Homo sapiens
  misc_feature: GZ8MTXP01CNLU2.21.22.B11.1.454.CMB.2.raw
  modified_base (204)..(204): a, c, t, g, unknown or other
  misc_feature (204)..(204): n is a, c, g, or t
  modified_base (268)..(268): a, c, t, g, unknown or other
  misc_feature (268)..(268): n is a, c, g, or t
  modified_base (281)..(281): a, c, t, g, unknown or other
  misc_feature (281)..(281): n is a, c, g, or t
  modified_base (329)..(329): a, c, t, g, unknown or other
  misc_feature (329)..(329): n is a, c, g, or t
  modified_base (340)..(340): a, c, t, g, unknown or other
  misc_feature (340)..(340): n is a, c, g, or t
tcagtcgtcgctcgcacgaccggtgctcgatttagacgacagctcaggggagcttcagctgtggtagagaagacaggactcaggacaatctccagcatggccggcttccctctcctcctccaccctcctcactcactgcgcagggtcctgggcccagtctgtgctgactcagcccaccctcagccgtctcggggaccccccggnaggacgggtcaccatcttcttgttctggagcaactcaacatcggaagtattatgtattctgtancagcactccagancgaccccaactcacactccagagaatatcagccgcctcgacgggtccngacgtacttcncgtcgctcgaaacgttctcggccaccgtcacgccctcccgtcgacccagtccgacggtcgggtccgtcccggggtcccgaagggtacgtcggacggactacgtaacttagttacgtcgggttacgaccgtacgtaccgggaacgggacccaacgaaccgtaggtcggggtaacctagaaacgtagtaaccggtgggttacgggttcggggtttcggggtcggtttacgggggcgggaaccgggttaaaccctaaaacgggtccgttaaccccggttacggtacggggttacccgaaccgggttaaccccgtaacccggggg

SEQ ID NO: 310702 - DNA, 871 bp, Homo sapiens
  misc_feature: GZ8MTXP01EYFG2.21.22.B11.1.454.CMB.2.raw
  modified_base (270)..(270): a, c, t, g, unknown or other
  misc_feature (270)..(270): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtcgtcgggacccccggagagggtcaccatctcttgttctggagcaactaccaactagtacggtaaattaattatgttattctggtancagacaactccgagaactccggaccccaaactcctacactaccagaagaataatacacgccggtccgtacgacggggtcctacgaccgtacttcgtcgtcggacctaccgtaaaacgtcgttcggccctacccgttccgaaccgtcccccttacccgtacgtaaaccccgtacttaccggtacggggtccggggtcccgttaccccggggtaccgggtaacggggtaacgttacgggaacgggttacgttacggttaaacctttaaagttttaaccggttcggggttacggtaccgtaaaccggttcccgggaaaccggggtaccccgtaaaccgaaaccggttaaggttaaccggggggtaattaaaccgggtaaaccgttaaacggttaaccgggtttaacgggggttaaacccggggggtttcggggggttttacggggggtttacccgggggtttaccggggggaaaacccgggggttaacccgggggttaaaaaccccggttaaacccgggttaccgggttaaacccccgggttaacccggggttacccggggttaaccggaaaccccgggggtttaaccccggtaaccccggggg

SEQ ID NO: 310703 - DNA, 665 bp, Homo sapiens
  misc_feature: GZ8MTXP01EHXDB.21.22.B11.1.454.CMB.2.raw
  modified_base (198)..(198): a, c, t, g, unknown or other
  misc_feature (198)..(198): n is a, c, g, or t
  modified_base (213)..(213): a, c, t, g, unknown or other
  misc_feature (213)..(213): n is a, c, g, or t
  modified_base (232)..(232): a, c, t, g, unknown or other
  misc_feature (232)..(232): n is a, c, g, or t
  modified_base (255)..(255): a, c, t, g, unknown or other
  misc_feature (255)..(255): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccacctcagcgtcgtgggacccccggnagagggtcacatctnttgtctggagcactccaantcgaataattatgtatctggtancagcaactcccaggactcggaccccaaactcctacactcagaggaaattacacgacgaccggcctacgacggggtccctgaccgtacttctacgtggcctaccgtaaagtctggctaaacccgtcacgtcccctccgtagaccctagtgacgggtcggcctcccgggttacgaaggtacttagggaccggtactacggtaacttacttaaccgttggggttcgacgttacgaccggacgggggaaccacccgtaaagtacgttggggaacctaggtaaaccaggttcgtaagggttcgggtaacgggtttttgggggaacggtttccgggggacgggttaagggaaccccttaaaagtcgggcccgtttaaccggacggggttaccaaccggggttaaccctaaccgggg

SEQ ID NO: 310704 - DNA, 758 bp, Homo sapiens
  misc_feature: GZ8MTXP01BR2LY.21.22.B11.1.454.CMB.2.raw
  modified_base (203)..(203): a, c, t, g, unknown or other
  misc_feature (203)..(203): n is a, c, g, or t
  modified_base (279)..(279): a, c, t, g, unknown or other
  misc_feature (279)..(279): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcacgcccaccctcagccgtcgtcgggacccccggnaggagggtccaccatctcttgttctaggaggcaactaccaactagtacggaaagttaattagtgtattcgtggtancagaccaactaccgaggaactccggacccccaaactccctacactacgaacgaaggaaactaacgtccgacggcccggtaccccgtacggtaccgggggtcccctacggtaacccgtacgtttcccttcgtacggtacccttacccgtaaacggttcccgtcggtaccctaccccgtccgtaccgtcccccttaccccgtacgtaccctacgttaccgtacgggtcggggtcccgttacccgggtaccggtaacgggacgtagggacggtcgttacgtaacgttaacgttacgttcgggtacgaccgtacgtacggaaccgggtacgactaaacggtaggtaggagtacgtaagttacgtcggtagggacggggttcggggttgggtaccggggttcggggaacggggttaccggaaccgttaacgggtccgtaaccccggttacggttacggacgaacccgttaacccggtaaccggg

SEQ ID NO: 310705 - DNA, 828 bp, Homo sapiens
  misc_feature: GZ8MTXP01EAXS1.21.22.B11.1.454.CMB.2.raw
  modified_base (204)..(204): a, c, t, g, unknown or other
  misc_feature (204)..(204): n is a, c, g, or t
  modified_base (684)..(684): a, c, t, g, unknown or other
  misc_feature (684)..(684): n is a, c, g, or t
tcagtcgtcgctcgcacgaccggtgctcgatttagacgacagctcaggggagcttcagctgtggtagagaagacaggactcaggacaatctccagcatggccggcttccctctcctcctcacccctcctcactcactgcgctagggtcctgggcccagtctgtgctgactcagccctaccctcagcgtcgtcgggacccccggnaggacgggtcacctattctacttgtcgtggacgacaactacccaatgtacggaattaattgtgtatcgtaggtatcagactaactcccgaaggtaactcccggaaccccctaacgtccctacgactaccgaaggtaaggtaaacttaacgtcggaaccggccggttaccccctaggtacccgggttcccgacgtacccgttaacttcccggtacgtcggtacccttaacccgtaaacggttcgttccggaacccttaaccccgttcccggggaaccccgttccccctttaccgggtaccgaaaacccgtttcgtaacccgggttagggtacccggggttcccgttacccccggggtaggttaaaaccggggtcggttacgggaaccgtacgttaccgtaaacgtttacgttaccggtacgggtacgtaaccgtaccggtaaccgggaaaccgtaccgacgtaaatacgggtacggtaaanacgttaactggtaacggttcggggttacggttcggggtttacggtacggggtaaccgggttacgggttaaaccgttaaacctaaccgggttccggtaaccggttaccgtaacgggttaccgttaacccggaaccggttaaccgg

SEQ ID NO: 310706 - DNA, 805 bp, Homo sapiens
  misc_feature: GZ8MTXP01EME3W.21.22.B11.1.454.CMB.2.raw
  modified_base (199)..(199): a, c, t, g, unknown or other
  misc_feature (199)..(199): n is a, c, g, or t
  modified_base (212)..(212): a, c, t, g, unknown or other
  misc_feature (212)..(212): n is a, c, g, or t
  modified_base (254)..(254): a, c, t, g, unknown or other
  misc_feature (254)..(254): n is a, c, g, or t
  modified_base (285)..(285): a, c, t, g, unknown or other
  misc_feature (285)..(285): n is a, c, g, or t
  modified_base (317)..(317): a, c, t, g, unknown or other
  misc_feature (317)..(317): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctggggacccccggnaggacggtcactntctcttgtcaggacgacaactcaatagtacggtaattaattntgtattcgtgtatcacgacacctcgagtacnccgaccccaactcctcactcaagaagaatacncgacgccgtccacgtacggtcctacgtaccgtacttccgtcgtcgtcctaccgaaacgttcgtcgaccctaccctaccgaccgtccccttaccgtacgaaccctacgtacgtacggggtcggggtcccgtacccggggtaacggtaacgggtacgttacggggacgggtaccgttaacgttaaaccgtttacgtttaccggtacggggtaaccggtaaccgtaaacccggtacccggggaaacccggggtaacctaaaccgtaaacggtaacgggtaacggggtaacgttaaaccggtaaaccgttaacggttccgggtaacggggttacgggggttcggggggtttttacgggggtaccgggggttacccgggggaacgggggttaaaccccgggttaaaacccgggttaaccgtaccgggggttaacccccggttaacgggtaaccggggttacccgtaaccccgggttaaccccgggtaacccgg

SEQ ID NO: 310707 - DNA, 850 bp, Homo sapiens
  misc_feature: GZ8MTXP01EWX5J.21.22.B11.1.454.CMB.2.raw
  modified_base (202)..(202): a, c, t, g, unknown or other
  misc_feature (202)..(202): n is a, c, g, or t
  modified_base (242)..(242): a, c, t, g, unknown or other
  misc_feature (242)..(242): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcacgccaccctcagcgtccgtcgggacccccggnaggacggtccaccatctcttgttcgtggagcactaccaanagtacggaattaattatagttattctaggtactcgagacctaacctacccgaaggaacgtacccggaacccccctaaaccttcccctaccaacttacccgaaaggtaacggtaaaataacgtaccgaccggcccggtacccccgtccggtaaccgggggttcccctacggtacccgtactttccgtacgtcggtaccctacccgtaaaaccgttcgtccgggaccctacccgtcccgtacccgtcccccgttaccccgtacggaaaccccttacgtaccggaaccgggttcccgggggtccccgttacccccgggggtaacccgggtaaggggtacggtttacgggacggggtaccgttacgggtaaacctttaacgttttaacccggtggggttacggtaacccgttaacggtacccgggaaaccggggtaacccgaacggtaaaccgtagggtacggggtaataacgggtaactaacggtcggtttaggggacggggtttccgggggtttggggttaccgggttacggggaccggggaacggttaaacccgaacggtcggtaacccgttacggtacggttaccgaacccgttaaccggtaacccgg

SEQ ID NO: 310708 - DNA, 644 bp, Homo sapiens
  misc_feature: GZ8MTXP01BQSPA.21.22.B11.1.454.CMB.2.raw
  modified_base (200)..(200): a, c, t, g, unknown or other
  misc_feature (200)..(200): n is a, c, g, or t
  modified_base (332)..(332): a, c, t, g, unknown or other
  misc_feature (332)..(332): n is a, c, g, or t
  modified_base (379)..(379): a, c, t, g, unknown or other
  misc_feature (379)..(379): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtcgtcgggacccccggnagagggtcaccatctcttgtctggagcaactccaacatacggaattaattatgtattctggtatcagcaactccagactcggacccccaatcctacactccagaaggaataatcacgcgcctgacgggtccngacctcttctctgctacaaagtctcgcaccctcacgtccctcccganacccatcgaggtcgggacctccggaccggaggactgggacggcttacggtaacttaagtttccgagggtcgaccgtaacgtacccggaaccgggggtaacacccgtaaagtaacgggttcggggaattacggaaacccgtaagttaaccgggtagggttacgggttcgggggtttggggtacggggttccggacgggggttaaacggaaccctaaaacgtccgggtaaccgttccggtagggaccaaccggttccccgtaacggg

SEQ ID NO: 310709 - DNA, 756 bp, Homo sapiens
  misc_feature: GZ8MTXP01EU3J9.21.22.B11.1.454.CMB.2.raw
  modified_base (205)..(205): a, c, t, g, unknown or other
  misc_feature (205)..(205): n is a, c, g, or t
  modified_base (224)..(224): a, c, t, g, unknown or other
  misc_feature (224)..(224): n is a, c, g, or t
  modified_base (280)..(280): a, c, t, g, unknown or other
  misc_feature (280)..(280): n is a, c, g, or t
  modified_base (283)..(283): a, c, t, g, unknown or other
  misc_feature (283)..(283): n is a, c, g, or t
tcagtcgtcgctcgcacgaccggtgctcgatttagacgacagctcaggggagcttcagctgtggtagagaagacaggactcaggacaatctccagcatggccgcttccctctcctcctcaccctcctcactcactgcgcgagggtcctcgggcccagtctgtgctgactcacgcccaccctcacgcgtccgtcgggacccccggnaggaggtccactattcttnttgtcgtggagaccaactaccaaatagtacggtaaattaattatgttattctgtancanctaactaccgagacgtccgacccctaactcctacacgtacaagaaggtaactaacacgacggccggtacccctacggaccggggtcctaccgaccgttaccttcctacggtcggtaccttacccgaaaggttaccgtcggacctaccccgtacggtaccctcccctccgtacgaccctacgttcgacgggtcgggtcccgtaccgggtacgacgggttaagtcgggtaacggtcgtaacgttaaccttagtttacccgttaggacgggtaacttaccgggacggaaaccgggtaacccaaggtaaacccgtgggtaacgggtatacgggtaaacaccggtttaaggaggttaaacccgggggtgggttttacgggggtacgggtttacccgggacgggttaaccggttaaaccggtaaccgtcggtaaccggtttaccggacgggttaccaaccggttcccggtaaccccggg

SEQ ID NO: 310710 - DNA, 829 bp, Homo sapiens
  misc_feature: GZ8MTXP01ES2OD.21.22.B11.1.454.CMB.2.raw
  modified_base (203)..(203): a, c, t, g, unknown or other
  misc_feature (203)..(203): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcacgcccaccctcacgcgtcgtcgggacccccggnaggacgggtcacctatcttcgttgttcgtggacgtacaacctaccaacgtagtacggtaaagttaaattagtaggttacttcgtaggtatacaagacctaaccacccgtaaggaactccggaaccccctaatcctacactaccgaagaaacggtaaataacgtcgaacggtcccggtcccgtacgggtaccgggtcccttacgaaccgttccgttccgtcgtacggtacccttacccgtaaaacggttccgtccgggtaccctacccgttaccgacccggtcccccttaccccgtagtaaacccctcgtaacgtacggggttccggggtacccgttaccccgggttaagggtaaacgggttcgtacgggtacggtaccgttaaccgagttttaaacgttcggtaacggggttcgtaacccggtacgtacccgggaaaccggggacaacgtaaaccggttaggtaggggtaactaacccgtaagttacgggtcgtaacgggttacgggggttcgggggtttaacgggtcgggttaccgggggaaccgggaacggttaaaccccgtaagggttcccggtaaaccgggttccgggtaaccggttcaaccgggttaaccccggtcccggg

SEQ ID NO: 310711 - DNA, 646 bp, Homo sapiens
  misc_feature: GZ8MTXP01APY1T.21.22.B11.1.454.CMB.2.raw
  modified_base (204)..(204): a, c, t, g, unknown or other
  misc_feature (204)..(204): n is a, c, g, or t
  modified_base (244)..(244): a, c, t, g, unknown or other
  misc_feature (244)..(244): n is a, c, g, or t
  modified_base (273)..(273): a, c, t, g, unknown or other
  misc_feature (273)..(273): n is a, c, g, or t
  modified_base (397)..(397): a, c, t, g, unknown or other
  misc_feature (397)..(397): n is a, c, g, or t
  modified_base (425)..(425): a, c, t, g, unknown or other
  misc_feature (425)..(425): n is a, c, g, or t
  modified_base (430)..(430): a, c, t, g, unknown or other
  misc_feature (430)..(430): n is a, c, g, or t
  modified_base (488)..(488): a, c, t, g, unknown or other
  misc_feature (488)..(488): n is a, c, g, or t
  modified_base (627)..(627): a, c, t, g, unknown or other
  misc_feature (627)..(627): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcacgcccaccctcagccgtcgtccgggacccccggnaggagggtcaccatcttcttgttcgtggagcaactccaanagtacggaattattagtgtattctggtancagcaacctccaggtaactccggacccccaaatcctacatcccgaagaaggtaaatactcgagcccggccccttggaccgggggttccaggaccgtcttccgcgttcggccctacgaaagttcncggacctacctccacgtccctcccgtanaaccngttacgaggtcgggaccgttccgggacgaggtatggacggtctaagacgttattacgnggtacgctacgccggaacggacacgaagtagtacggactagtaaccagttcggtggttacgggtcggggtttgggtaccgggtaggggacggttaccggggaaaccctaacggtcggtaaccgttccgagggttacccncggttaacccgtaaccggg

SEQ ID NO: 310712 - DNA, 702 bp, Homo sapiens
  misc_feature: GZ8MTXP01AWSZP.21.22.B11.1.454.CMB.2.raw
  modified_base (201)..(201): a, c, t, g, unknown or other
  misc_feature (201)..(201): n is a, c, g, or t
  modified_base (239)..(239): a, c, t, g, unknown or other
  misc_feature (239)..(239): n is a, c, g, or t
  modified_base (251)..(251): a, c, t, g, unknown or other
  misc_feature (251)..(251): n is a, c, g, or t
  modified_base (298)..(298): a, c, t, g, unknown or other
  misc_feature (298)..(298): n is a, c, g, or t
  modified_base (359)..(359): a, c, t, g, unknown or other
  misc_feature (359)..(359): n is a, c, g, or t
  modified_base (689)..(689): a, c, t, g, unknown or other
  misc_feature (689)..(689): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagcccaccctcagcgtcgtcgggacccccggnagagggtcaccatcttcttgtcgtggacgcaactcaantacggaagtatntgtattgtgtatcagcaactcccgagaactccgaccccaatccgtanactcgagtaaggaatacgcacggccgtccctacgccggggttccaggaccgtattcccgtntaccgggtctaccggtaaacgtctcgggccctaacccgctaaccggtccccttaccccgtacgggaaaccctacttaaccggaggtttacccgggccggtttacccgggtacccgggtaaagggacgttacggaaacggggtcctaacgggttaaaccttaacgtttacgcggggtacgttacgtacgaccggaaccgggggtaacctaccgtaaactacgggagtaacgttaccggaattaaaccgttgaacggttacgggttccgggttaagggtcggttacggacgggcgggaaacctaaggtacgtaacccggaccttgggaaccncgaaccgtccggg

SEQ ID NO: 310713 - DNA, 715 bp, Homo sapiens
  misc_feature: GZ8MTXP01EVTU0.21.22.B11.1.454.CMB.2.raw
  modified_base (201)..(201): a, c, t, g, unknown or other
  misc_feature (201)..(201): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagcccaccctcagcgtcgtcgggacccccggnaggagggtccaccatctcttgtctggagcaactccaacatacggaattaattatgtattcgtggtatcagcctaactcccgaaggaactccggaacccccctaaactcctacactaccgaaggaacggtaaataacgtccgaaccgggcccggtaccccgtacgggtaccgggtacccctaggacccgtacttcctcgtggtccctacccgtaaacgttcgtcgccctacccttaccgcctacccctccccgtagtaccccagttcgacgggtcgggtacccgtcccgggtacggtaaggcgtaggacggtaccttaggtaacctttagttaccgtggggttacaccgtaagtccgaacgggacccagaactagggtagggacttagaactaggttcgagggaccgggggtttcgggtttcggggtagggttcccggggacgggttaaccggaacccgtaaacggttcggaaccccgttcggaacggttccgaacccggttaaccggaacccgg

SEQ ID NO: 310714 - DNA, 708 bp, Homo sapiens
  misc_feature: GZ8MTXP01B66FD.21.22.B11.1.454.CMB.2.raw
  modified_base (318)..(318): a, c, t, g, unknown or other
  misc_feature (318)..(318): n is a, c, g, or t
tcagtcgtcgctcgcacgaccggtgctcgattttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtcgtcgggacccccgggcaggagggtcaccattctcttgttctggaggcaactccaacatcggaaagttaattatgtattctggtatcagcaactcccaggaatccggaccccaaatcctcactcagagaatancagccgcctcgacgggtcctagaccgtattcctctgcctcgaaagttctcggcacccgtcacgccctccacgacctacgtcacgggtcgggccgttccgggtacgagggtacgtcggacgggcttacggaactttacgttaccgttagggtacggtccgtaacgttacccgggaaacgggaacccgtacgtaaaaccgtacgggtttaaggggaacgttacggaaacttaccgtaagggttaaacgggttcgggggttaaccggggttttggggggtaacgggtttaccgggggaccgggttaaacgggggaaaccccgtaaaccggttacgggtaaccccggttacggttaaccgggttccgtaaacccgggccccgggttaaaccggg

SEQ ID NO: 310715 - DNA, 635 bp, Homo sapiens
  misc_feature: GZ8MTXP01AGEXS.21.22.B11.1.454.CMB.2.raw
  modified_base (180)..(180): a, c, t, g, unknown or other
  misc_feature (180)..(180): n is a, c, g, or t
  modified_base (244)..(244): a, c, t, g, unknown or other
  misc_feature (244)..(244): n is a, c, g, or t
  modified_base (264)..(264): a, c, t, g, unknown or other
  misc_feature (264)..(264): n is a, c, g, or t
  modified_base (269)..(269): a, c, t, g, unknown or other
  misc_feature (269)..(269): n is a, c, g, or t
  modified_base (415)..(415): a, c, t, g, unknown or other
  misc_feature (415)..(415): n is a, c, g, or t
  modified_base (552)..(552): a, c, t, g, unknown or other
  misc_feature (552)..(552): n is a, c, g, or t
tcagtcgtcgctcgcacgaccggtgctcgatttagacgacagctcagggggagcttcagctgtggtagagaagacaggactcaggacaatctccagcatggccggcttccctctcctcctcaccctcctcactcactgcgcagggtcctgggcccagtctgtgctgactcagccaccctnagcgtccgtcggggacccccggcaggacgggtccaccgtatctcttgttctggagcaactcaanatcggaatattatgtattcnggtancagacactcccgaaggactcggaccccaaactcctacactccaagagaataactcgacgccggcccgtcgtaacgggtcctacggacctacgttcctcgtcggacctccaaaggttcctcgggccaccgttacacgtcccctaccncgtaaccagtcgtacgtcggggtaccttcccgggaccgtagggacgtggcggacttacgaatacttacgtggtcgcgtaacgcggaaacggtcgaacctaacgaggttcggaactagaactagtcgtagggttcggngggttggggtacggttacgggacgggacgggaaccctaagggtccctaaccggtcccggtaagcccgaacgccgtaacccggg

SEQ ID NO: 310716 - DNA, 696 bp, Homo sapiens
  misc_feature: GZ8MTXP01C7E4F.21.22.B11.1.454.CMB.2.raw
  modified_base (202)..(202): a, c, t, g, unknown or other
  misc_feature (202)..(202): n is a, c, g, or t
  modified_base (340)..(340): a, c, t, g, unknown or other
  misc_feature (340)..(340): n is a, c, g, or t
  modified_base (523)..(523): a, c, t, g, unknown or other
  misc_feature (523)..(523): n is a, c, g, or t
  modified_base (681)..(681): a, c, t, g, unknown or other
  misc_feature (681)..(681): n is a, c, g, or t
tcagtcgtcgctcgcacgaccggtgctcgatttagacgacagctcaggggagcttcagctgtggtagagaagacaggactcaggacaatctccagcatggccggcttccctctcctcctccaccctcctcactcactgcgcagggtcctgggcccagtctgtgctgactcagccacctcagcgtcgtcggggaccccccggnaggacgggtcaccatcttcttgttcgtggacggacaactaccaacagtacggaaagttaattatgtattcgtggtatcagcaaccttaccaaggaactccggacccctaactccctacataccgagaagtaaataacncacggccggccctacggacggggttccctcggaaccgtaccttcgtctcggtcctaccgaaaacgttccgttggaccctacctaccacgtcccctccctcgaccctactacgtacggtcgggtccgttacccgggtacggacggtacgtacggtaacggtccgtacgtaacttactttacggnggtttacggacctacgtaaccggaaccggggtaccgaccgtaaacgtaggtcggggtaatacggaaacttaagtaaccggtgggttaacggggtcggggttgggttacgggttcgggacgggttacggaaccgtaacgtacgccgtacgtcggttacncgaaccgtaaccggg

SEQ ID NO: 310717 - DNA, 342 bp, Homo sapiens
  misc_feature: GZ8MTXP01CH4D2.21.22.B11.1.454.CMB.2.raw
  modified_base (198)..(198): a, c, t, g, unknown or other
  misc_feature (198)..(198): n is a, c, g, or t
  modified_base (342)..(342): a, c, t, g, unknown or other
  misc_feature (342)..(342): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctgggacccccganagagggtcaccatctcttgttctggagcaactccaacatcggaagtaattatgtattctggtatcagcaactcccaggaatcggcccccaaatcctcatccagagaataatcagcggcctcgaggggtccctgaccgatttccn

SEQ ID NO: 310718 - DNA, 693 bp, Homo sapiens
  misc_feature: GZ8MTXP01B9JC4.21.22.B11.1.454.CMB.2.raw
  modified_base (301)..(301): a, c, t, g, unknown or other
  misc_feature (301)..(301): n is a, c, g, or t
tcagtcgtcgctcgcacgaccggtgctcgatttagacgacagctcagggggagcttcagctgtggtagagaagacaggactcaggacaatctccagcatggccggcttccctctcctcctcaccctcctcactcactgcgcagggtcctgggcccagtctgtgctgactcagccaccctcagcgtctcgggacccccggcagagggtcaccatctcttgttctggaggcaactccaacatcggaagtaatatgtattctggtatcagtcaactcccaaggactcggacccccaaatccctnactccagacgaaataatcagcgcctagacgggtccctgaacccgttctctcgtcgctacgaacgtctcgacctaccgtcacgtccctaccacgacctactcgacggtcgggcccgtccgggtaccgaggtagtacggacggtctagtaactttaacgttaccgtcgggttacggaccgtaacgtacccggaaaccgggtaacccgacgtaaacgtacgggttaggggtaactaacggtaaacgttaaacgtcggtaagggttaccggggttacgggggttttcgggggtaacgggttccggggaaacgggggttaaccgggttaacccggtaaaccggtccgggtaaacccggttccggacgggttacccggaacccggttcccggtaaagg

SEQ ID NO: 310719 - DNA, 705 bp, Homo sapiens
  misc_feature: GZ8MTXP01DWK40.21.22.B11.1.454.CMB.2.raw
  modified_base (201)..(201): a, c, t, g, unknown or other
  misc_feature (201)..(201): n is a, c, g, or t
  modified_base (270)..(270): a, c, t, g, unknown or other
  misc_feature (270)..(270): n is a, c, g, or t
  modified_base (273)..(273): a, c, t, g, unknown or other
  misc_feature (273)..(273): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagcccaccctcagcgtcgtcgggacccccggnagacggtcaccatctcttgttcgtggagcaactaccaactagtacggaaagttatatgtattcgtgtancanacaactccgaggaactaccggacccctaaactcctacaactacgaagaggtaaaatagtacgacggtccggtccctacggaaccggggttcctacggtaccgtaaccttccgtacgtccggtccctaccgtaaaacgttccgtcgggaccctaacctccgtaccgtccccgttccccgaggtaaacccactacggtcggttccgggcccgtttacccggggaggaacggtagacggtacggggaccttagtaacttaacgttacgtgggttacgacgtacgtaccggaacggccaacgaagtacgtaggtatacggaactagttaaccgagggttacggtggggtttacggggtacggttcgggaacgggacggttaaccctaaacgggcgttaacccggttccgaacggttcaacccggttccgtaaccgg

SEQ ID NO: 310720 - DNA, 671 bp, Homo sapiens
  misc_feature: GZ8MTXP01DLMMQ.21.22.B11.1.454.CMB.2.raw
  modified_base (203)..(203): a, c, t, g, unknown or other
  misc_feature (203)..(203): n is a, c, g, or t
  modified_base (248)..(248): a, c, t, g, unknown or other
  misc_feature (248)..(248): n is a, c, g, or t
  modified_base (417)..(417): a, c, t, g, unknown or other
  misc_feature (417)..(417): n is a, c, g, or t
  modified_base (478)..(478): a, c, t, g, unknown or other
  misc_feature (478)..(478): n is a, c, g, or t
  modified_base (527)..(527): a, c, t, g, unknown or other
  misc_feature (527)..(527): n is a, c, g, or t
  modified_base (564)..(564): a, c, t, g, unknown or other
  misc_feature (564)..(564): n is a, c, g, or t
  modified_base (568)..(568): a, c, t, g, unknown or other
  misc_feature (568)..(568): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcacgcccaccctcagcgtccgtcgggacccccggngagagggtcaccatcttcttgttcgtggacgtccaactcccaaantacgggaaagttaattatgttaattcgtggtatcagacacctacccgaggaaactccggacccccaaacgtcctacactaccaaggaagtaaatactacaacggcccggacctacggaccgggttcccgcgtaccgtaccttctaccgtcggacctccctaaaggttcncggaccacccgtcaccgtcccctacctacgaccagtcgcgggttcgggccgttaacccggnggacggtatcgggacggtctagtacttactacgttgggtcgacgtaacncggaaaccgggcaaccggataggggtaagccgtaaanagtncggtgggttcgtcggggttggggttacggtaccggggttaccggaacgttaccctaacggtactaacccgggtacgtacggacggtaacccgaaccgtaacgg

SEQ ID NO: 310721 - DNA, 692 bp, Homo sapiens
  misc_feature: GZ8MTXP01AXV08.21.22.B11.1.454.CMB.2.raw
  modified_base (200)..(200): a, c, t, g, unknown or other
  misc_feature (200)..(200): n is a, c, g, or t
  modified_base (359)..(359): a, c, t, g, unknown or other
  misc_feature (359)..(359): n is a, c, g, or t
  modified_base (528)..(528): a, c, t, g, unknown or other
  misc_feature (528)..(528): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtcgtcgggacccccggnaggagggtcaccatctcttgtctggagcaactcaactagtacggaagttaacttatgttattcgtggtatcagacaacctccgaggactccggaccccctaaatccctacatacccaagtaggaaatactcgacgccggtacctcgacggggttccccngaccgtacttctacgtcggcctaccgaaacgttcgtcggacctaacccgtcacgtcccctcctaggaccctatcgacggtcgggccctcgggtacgaggtatcggtaacgtcgtacgtacggttaccttagccgggttagacctaaccgttacgggaacccggggaacnccgtaaaagcgttaggggtaactacggtaacctaagttccggtcggggttaaggttccgggggttggggtaccggttcggggggaaaccgttcgggggaaacctaacccgggtcggtaaccccgttacgtaaggggacccaaccgggttaacccggtaaccggg

SEQ ID NO: 310722 - DNA, 522 bp, Homo sapiens
  misc_feature: GZ8MTXP02F26NY.21.22.B11.1.454.CMB.2.raw
  modified_base (198)..(198): a, c, t, g, unknown or other
  misc_feature (198)..(198): n is a, c, g, or t
  modified_base (414)..(414): a, c, t, g, unknown or other
  misc_feature (414)..(414): n is a, c, g, or t
  modified_base (429)..(429): a, c, t, g, unknown or other
  misc_feature (429)..(429): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctgggacccccggnagagggtcaccatctcttgttctggagcaactccaacatcggaagtaatatgtattctgtatcagcaactcccaggaatggcccccaaatcctcatccagaggaataatcagcggccctcgacggggtccctgaccgattctctggctccaagtctggcacctcacgcctcctgacccatcagtgggctccggtcgaggatgagctgactattacngtgcatcacgggacncaacgatgggatgacaatctagagtcggttgggtcgttcgggacggagggaacccaaaacgtgaacccgtcctaaggtcaacggccccaaagg

SEQ ID NO: 310723 - DNA, 522 bp, Homo sapiens
  misc_feature: GZ8MTXP02IMKVJ.21.22.B11.1.454.CMB.2.raw
  modified_base (196)..(196): a, c, t, g, unknown or other
  misc_feature (196)..(196): n is a, c, g, or t
  modified_base (339)..(339): a, c, t, g, unknown or other
  misc_feature (339)..(339): n is a, c, g, or t
  modified_base (423)..(423): a, c, t, g, unknown or other
  misc_feature (423)..(423): n is a, c, g, or t
  modified_base (428)..(428): a, c, t, g, unknown or other
  misc_feature (428)..(428): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccacctcagcgtctgggaccccggnagaggtcaccatctcttgttctggaggcaactccaacatcggaaagtaattatgtattctggtatcagcaactcccaggaatggcccccaaactcctcatccagaggaataatcagcggcctcaggggtccctgaccgattcnctgctcaagtctggcacctcacgcctcctgacccatcagtggctccggtcgagatgagctgactattactgtgcatcacgggcncaaanagtggatagaacaatacgtagtaggtcggttgggttcggttcgggtacggacggaacgaaacgtacgtacgtaccgtacgtacgacgaccgacg

SEQ ID NO: 310724 - DNA, 562 bp, Homo sapiens
  misc_feature: GZ8MTXP02FK8QI.21.22.B11.1.454.CMB.2.raw
  modified_base (199)..(199): a, c, t, g, unknown or other
  misc_feature (199)..(199): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctcgggacccccggnagagggtcaccatctcttgttctggagcaactccaacatcggaaagtaattatgtattctggtatcagcaactcccaggaatcggacccccaaactcctcatccagaggaataaatcagccggccctcgacggggtccctgaccgattctctggctccaagtctggccactcacgccctccctgacccatcaggtcgggcctccgggtccgagggactggacgctagacttattactgtcgcatcgacgggacgcaaacagtgggatgaacaatcgtaggaggtcgggttggggtcgttccgggacggggaacggaacccaaaacgtcggaacccgtcgtaaggtaccacggaccccaacggg

SEQ ID NO: 310725 - DNA, 560 bp, Homo sapiens
  misc_feature: GZ8MTXP02I8N2C.21.22.B11.1.454.CMB.2.raw
  modified_base (198)..(198): a, c, t, g, unknown or other
  misc_feature (198)..(198): n is a, c, g, or t
  modified_base (321)..(321): a, c, t, g, unknown or other
  misc_feature (321)..(321): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctgggacccccggnagagggtcaccatctcttgtctggaggcaactccaacatcggaagtaattatgtattctggtatcagcaactcccaaggaatcggaccccccaaatcctcatccagagaataatcagcgcctnacggggtcctgaccgattctctggctccaagtctggccacctcacgcctccctgaccatcagtcgggctccggtccgagactgagctgactattactgtcgctatccgaacgggacgacaaacgagtggggattaggaaccaaatctggaacggttccggggttgggtcggtttccgggacgggtaagggaacccaaaacgttcggaaccgtccgtaagggtccacggcccgaaacggg

SEQ ID NO: 310726 - DNA, 507 bp, Homo sapiens
  misc_feature: GZ8MTXP02I28OT.21.22.B11.1.454.CMB.2.raw
  modified_base (199)..(199): a, c, t, g, unknown or other
  misc_feature (199)..(199): n is a, c, g, or t
  modified_base (236)..(236): a, c, t, g, unknown or other
  misc_feature (236)..(236): n is a, c, g, or t
  modified_base (308)..(308): a, c, t, g, unknown or other
  misc_feature (308)..(308): n is a, c, g, or t
  modified_base (329)..(329): a, c, t, g, unknown or other
  misc_feature (329)..(329): n is a, c, g, or t
  modified_base (340)..(340): a, c, t, g, unknown or other
  misc_feature (340)..(340): n is a, c, g, or t
  modified_base (447)..(447): a, c, t, g, unknown or other
  misc_feature (447)..(447): n is a, c, g, or t
  modified_base (495)..(495): a, c, t, g, unknown or other
  misc_feature (495)..(495): n is a, c, g, or t
  modified_base (500)..(507): a, c, t, g, unknown or other
  misc_feature (500)..(507): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctcgggacccccggnagagggtcaccatctcttgttctggagcaactccaanatcggaataattatgtattctggtatcagcaactccaggaatcggacccccaatcctcatccagagaataancagcgcctcgacggggtcccngaccgacttcnctggctccaagtctggccacctcgacgccctccctgacccatcgaggtcgggcctccgggtccgaggactgaggctagacttattactgtcgcatcgaacgggacanaacgagtgggactagaacatcgagagcggggactggacgaacggcganaagtnnnnnnnn

SEQ ID NO: 310727 - DNA, 534 bp, Homo sapiens
  misc_feature: GZ8MTXP02IEI3E.21.22.B11.1.454.CMB.2.raw
  modified_base (201)..(201): a, c, t, g, unknown or other
  misc_feature (201)..(201): n is a, c, g, or t
  modified_base (296)..(296): a, c, t, g, unknown or other
  misc_feature (296)..(296): n is a, c, g, or t
  modified_base (428)..(428): a, c, t, g, unknown or other
  misc_feature (428)..(428): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtcgtcgggacccccgggnagagggtcaccatctcttgttctggaggcaactccaacatcggaaagtaattatgtattctggtatcagcaactcccagatcgacccccaatccncatccagagaataatcagcggccctcgacggggtccctgaccgtacttcctctggctccaagtctggccacctcacgccctctgaccatcgaggtcggcctcggcgaggctggacgctgactagttactgtncatcgacggacacaactgtggatagacaagtcgagaggtcggttagggcgttcggggacggtaggaaccaaacgtcggaccgttccgaggtcacgtacccgaacgg

SEQ ID NO: 310728 - DNA, 562 bp, Homo sapiens
  misc_feature: GZ8MTXP02G4JLS.21.22.B11.1.454.CMB.2.raw
  modified_base (199)..(199): a, c, t, g, unknown or other
  misc_feature (199)..(199): n is a, c, g, or t
  modified_base (294)..(294): a, c, t, g, unknown or other
  misc_feature (294)..(294): n is a, c, g, or t
  modified_base (426)..(426): a, c, t, g, unknown or other
  misc_feature (426)..(426): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctcgggacccccggnagagggtcaccatctcttgttctggaggcaactccaacatcggaaagtaattatgtattctggtatcagcaactccagatcgaccccaaatcctnatccagagaatatcagcgcctgacggggtccctgaccgacttctctggctaccaagtctggccacctcacgccctccctgacccatccgagtcgggcctccgggtccgaggatggacgctgaacttattacngtgcctagtccgaacggggacacaaacgagtggggatacggaacaaagtccgtggaacggtcgggtttggggtcggttccggggacgggaacggggaccaaaggcgttacggacccgtccgtaggcccagaccccg

SEQ ID NO: 310729 - DNA, 524 bp, Homo sapiens
  misc_feature: GZ8MTXP02IVF3Z.21.22.B11.1.454.CMB.2.raw
  modified_base (198)..(198): a, c, t, g, unknown or other
  misc_feature (198)..(198): n is a, c, g, or t
  modified_base (310)..(310): a, c, t, g, unknown or other
  misc_feature (310)..(310): n is a, c, g, or t
  modified_base (329)..(329): a, c, t, g, unknown or other
  misc_feature (329)..(329): n is a, c, g, or t
  modified_base (339)..(339): a, c, t, g, unknown or other
  misc_feature (339)..(339): n is a, c, g, or t
  modified_base (392)..(392): a, c, t, g, unknown or other
  misc_feature (392)..(392): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctgggacccccggnagagggtcaccatctcttgttctggaggcaactccaacatcggaagtaattatgtattctggtatcagcaactcccaggaatcggcccccaaatcctcatccagagaataancagcggcctcagggtcccngaccgattcnctgctcagtctggcacctcagccctcctgaccatcaggtggctccggtcgagntgaggctgacttatacgtgtgcagtcgaacgggcacaactagtgggatgaactaagtcgtagaggtcgggttgggtcgttcgggacggtacggacccaaagtcggaacccgttcgaggtcacggacccaagg

SEQ ID NO: 310730 - DNA, 508 bp, Homo sapiens
  misc_feature: GZ8MTXP02FYO24.21.22.B11.1.454.CMB.2.raw
  modified_base (361)..(361): a, c, t, g, unknown or other
  misc_feature (361)..(361): n is a, c, g, or t
  modified_base (395)..(395): a, c, t, g, unknown or other
  misc_feature (395)..(395): n is a, c, g, or t
  modified_base (446)..(446): a, c, t, g, unknown or other
  misc_feature (446)..(446): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctgggacccccggcagagggtcaccatctcttgttctggaggcaactccaacatcggaagtatatgtattctgtatcagcaactcccaggaatcggcccccaaatcctcatccagaggaataatcagcggccctcgaggggtccctgaccgattctctgctccaagtctggcacctnacgccctcctgaccatcagtgggctcggtcgagntgagctgactatactgtcgcatcgaacggacgcaacagtggatgacaatcnggagcggttgggcgttcggcggaggaaccaacgtcgaaccgttccaaggtcaggccccaagg

SEQ ID NO: 310731 - DNA, 551 bp, Homo sapiens
  misc_feature: GZ8MTXP02ITZFF.21.22.B11.1.454.CMB.2.raw
  modified_base (198)..(198): a, c, t, g, unknown or other
  misc_feature (198)..(198): n is a, c, g, or t
  modified_base (433)..(433): a, c, t, g, unknown or other
  misc_feature (433)..(433): n is a, c, g, or t
  modified_base (439)..(439): a, c, t, g, unknown or other
  misc_feature (439)..(439): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagtcaccctcagcgtctgggacccccggnagagggtcaccatctcttgttctggaggcaactccaacatcggaagtattatgtattctggtatcagcaactcccaaggaatcggcccccaaatcctcatccagagataatcagcgcctcaggggtccctgaccgattctctggctccaagtctggcacctcagcctcctgacccatcagtgggctccggtccgaggctggacggctagacttattactgtgcatcgaacgggcncaaacngtaggggattagacaaagttcgtaggagtcggggtttggggcgtttaccggggacgggtaggggaaccccaaagttcggaacccgttcgtaagggtcacggccccgaaaggg

SEQ ID NO: 310732 - DNA, 617 bp, Homo sapiens
  misc_feature: GZ8MTXP02J42ER.21.22.B11.1.454.CMB.2.raw
  modified_base (179)..(179): a, c, t, g, unknown or other
  misc_feature (179)..(179): n is a, c, g, or t
  modified_base (197)..(197): a, c, t, g, unknown or other
  misc_feature (197)..(197): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagtcaccctnagcgtctggaccccgggnagagggtcaccatctcttgttctggaggcactccaacatcggaagtaattatgtattctggtatcagcaacctcccaggaatcggcccccaaactcctcatccagaggataaatcagccgaccctcgacggggttccctgacccgtattcctctggacttccaagttctggcaccctcacgcctccctcgaccactactagtcggtcggtccgggtcccgtacggacgtagaggcgtcgtactacttaacttacgttgtcgtctacgacggaccggaccgaacgaacgaacggtaggtaggtaacgaacgtacgtacgtacggtacgggttcggggttcgggtttcggttcggggtacgggtaccgggtaaccggtaacggtaaccggtaccgtaccggtaccgtaccgtaccgtaccgg

SEQ ID NO: 310733 - DNA, 579 bp, Homo sapiens
  misc_feature: GZ8MTXP02H5GWI.21.22.B11.1.454.CMB.2.raw
  modified_base (198)..(198): a, c, t, g, unknown or other
  misc_feature (198)..(198): n is a, c, g, or t
  modified_base (329)..(329): a, c, t, g, unknown or other
  misc_feature (329)..(329): n is a, c, g, or t
  modified_base (371)..(371): a, c, t, g, unknown or other
  misc_feature (371)..(371): n is a, c, g, or t
  modified_base (422)..(422): a, c, t, g, unknown or other
  misc_feature (422)..(422): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctgggacccccggnagagggtcaccatctcttgttctggagcaactccaacatcggaagtaattatgtattctggtatcagcaactcccaggatcggcccccaaatcctcatccagaggaataatcagcgcctcgaggggtcccngaccgacttctctggctccaagtctggcacctcagccctccngaccatcagtggctccggtcgaggatgacggctgactatttaccgtgtcgntacgtcgacggggacgcaaacgtagtaggggacttggaaactaaagttcgtggaacgggtccggggtttgggggtcggttttccgggggacggttacgggggaaaccctaaacgtcggaaccccggttccgtaagggtcccacgaccccgaaacggg

SEQ ID NO: 310734 - DNA, 537 bp, Homo sapiens
  misc_feature: GZ8MTXP02JDWGY.21.22.B11.1.454.CMB.2.raw
  modified_base (198)..(198): a, c, t, g, unknown or other
  misc_feature (198)..(198): n is a, c, g, or t
  modified_base (401)..(401): a, c, t, g, unknown or other
  misc_feature (401)..(401): n is a, c, g, or t
  modified_base (434)..(434): a, c, t, g, unknown or other
  misc_feature (434)..(434): n is a, c, g, or t
  modified_base (439)..(439): a, c, t, g, unknown or other
  misc_feature (439)..(439): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctgggacccccggnagagggtcaccatctcttgttctggaggcaactccaacatcggaagtaattatgtattctggtatcagcaactcccaggaatcggacccccaaatcctcatccagaggaataatcagcggccctcgaggggtccctgaccgattctctggctccaagtctggcacctcagccctcctgacccatcagtgggctccggtcgagntgaggctgactattactgtgcatcgacgggacncaacngtgggatgaacaatctggagtcgggttagggtcgttcgggcgggaagggaacccaaaacgtcggaacccgttccgtaaggtccaacggccccaaaggg

SEQ ID NO: 310735 - DNA, 552 bp, Homo sapiens
  misc_feature: GZ8MTXP02G90PQ.21.22.B11.1.454.CMB.2.raw
  modified_base (237)..(237): a, c, t, g, unknown or other
  misc_feature (237)..(237): n is a, c, g, or t
  modified_base (337)..(337): a, c, t, g, unknown or other
  misc_feature (337)..(337): n is a, c, g, or t
  modified_base (459)..(459): a, c, t, g, unknown or other
  misc_feature (459)..(459): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagcccaccctcagcgtctcgggacccccggcagagggtcaccatctcttgttctggagcaactccaanatcggaataattatgtattctggtatcagcaactccaggaatcggacccccaaactcctcactccagaagaataatcagccggccctcgacggggtcccngaccgtacttcgtctggcctccgaagtctggccacctcacgccctccctgacccatcgaggtcgggcctccggtccgaggatgaggctagacttattactgtgacagtcgacgggacacaanagtgggatgaactagtcgaggagtcgggttgggtcgttcgggacggtacgggaaccaagtcggacccgtacgtaggtccacggacccgtacgg

SEQ ID NO: 310736 - DNA, 550 bp, Homo sapiens
  misc_feature: GZ8MTXP02JV4O0.21.22.B11.1.454.CMB.2.raw
  modified_base (310)..(310): a, c, t, g, unknown or other
  misc_feature (310)..(310): n is a, c, g, or t
  modified_base (428)..(428): a, c, t, g, unknown or other
  misc_feature (428)..(428): n is a, c, g, or t
  modified_base (455)..(455): a, c, t, g, unknown or other
  misc_feature (455)..(455): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctgggacccccggcagagggtcaccatctcttgttctggagcaactccaacatcggaagtaattatgtattctggtatcagcaactcccaggaatcggacccccaaatcctcatccagagaataancagcgcctgacggggtccctgaccgatctctgctcgaagtctggccaccgtcacgccctccgtgaccctatccgaggtcgggcctcccgggtcgaggactggacggctgacttattcngtcactatccgaacggggacacaacgngtgggatggaacaatcgtaggaggtcgggttagggtcgttcgggacgggacggaaccaaacgtccggaaccgttcgtacggcacggacccaacgg

SEQ ID NO: 310737 - DNA, 539 bp, Homo sapiens
  misc_feature: GZ8MTXP02F7J0Q.21.22.B11.1.454.CMB.2.raw
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctgggacccccggcagagggtcaccatctcttgttctggagcaactccaacatcggaataattatgtattctgtatcagcaactcccaggaatcggacccccaaactcctcatccagaggaataatcagccggccctcgacggggtccctagaccgtattctctggctccaagttctggccacctcacgccctcctagacccatcaggtcggctccggtccgaggactgatgctgaactattactgtgacagtcaacgggacacaaacgagtgggatagaacaagtcgtagacggtgggttggtcgttacgggcggaagggaaccaaaacgtcgaaccgtctacggcacgacccg

SEQ ID NO: 310738 - DNA, 588 bp, Homo sapiens
  misc_feature: GZ8MTXP02J2PDF.21.22.B11.1.454.CMB.2.raw
  modified_base (199)..(199): a, c, t, g, unknown or other
  misc_feature (199)..(199): n is a, c, g, or t
  modified_base (234)..(234): a, c, t, g, unknown or other
  misc_feature (234)..(234): n is a, c, g, or t
  modified_base (318)..(318): a, c, t, g, unknown or other
  misc_feature (318)..(318): n is a, c, g, or t
  modified_base (336)..(336): a, c, t, g, unknown or other
  misc_feature (336)..(336): n is a, c, g, or t
  modified_base (381)..(381): a, c, t, g, unknown or other
  misc_feature (381)..(381): n is a, c, g, or t
  modified_base (409)..(409): a, c, t, g, unknown or other
  misc_feature (409)..(409): n is a, c, g, or t
  modified_base (469)..(469): a, c, t, g, unknown or other
  misc_feature (469)..(469): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctcgggacccccggnagagggtcaccatctcttgtctggagcaactcaanatcgaatatatgtatctgtatcagcaactcccgaggaactccggacccccaaatcctcatccagaaggaataatcacgcgcccngacgggtccctgaccgtntcctgtcgctcgagtctcgcctacctcacgccctcccgtgacccntcgaggtcgggacctccgggtcgagggntcgggaagtctacgtaacttagttacgtggtacgctaatcccgggaacggcgacaaacgngggtcggatacgaacacgttcggagggtaccggtggggttcgggtcggttacccgggagggtaaccggtaacccaaacggtcggtacccgtcgttaacggccgaaccggccgtaaccgg

SEQ ID NO: 310739 - DNA, 624 bp, Homo sapiens
  misc_feature: GZ8MTXP02JXO0D.21.22.B11.1.454.CMB.2.raw
  modified_base (312)..(312): a, c, t, g, unknown or other
  misc_feature (312)..(312): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctcgggacccccggcagagggtcaccatctcttgttctggaggcaactccaacatcggaataattatgtattctggtatcagcaactcccaggaactcggacccccaaatcctcatccagagaataancagcggccctgacggggtccctgaccgtacttctcgtcggcctccgaagttctcggccaaccctcgacgtccctccctgacccatccgaggtcggggcctcccgggtccgaggtactcggacggctacggtaacttaagtttacgtggtcgactaacgtccggaacgggggacacgaaacgtagtggggaattcgaaactaacgttcgtaggacgggttccggggtttgggggtcggttaccggggacgggtaacgggtaacccaaacggttcggaacccggttcgtaggtacccacggaccccgtaacggg

SEQ ID NO: 310740 - DNA, 536 bp, Homo sapiens
  misc_feature: GZ8MTXP02IG211.21.22.B11.1.454.CMB.2.raw
  modified_base (429)..(429): a, c, t, g, unknown or other
  misc_feature (429)..(429): n is a, c, g, or t
  modified_base (445)..(445): a, c, t, g, unknown or other
  misc_feature (445)..(445): n is a, c, g, or t
  modified_base (450)..(450): a, c, t, g, unknown or other
  misc_feature (450)..(450): n is a, c, g, or t
  modified_base (482)..(482): a, c, t, g, unknown or other
  misc_feature (482)..(482): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctgggacccccgggcagagggtcaccatctcttgttctggaggcaactccaacatcggaagtaattatgtattctggtatcagcaactcccaggaatcggacccccaaatcctcatccagaggaataatcagcggccctcgacggggtccctgaccgtattcctcgtggcctccaagtctgggccacctcacgccctcctgacccatcagtgggctccggtcgaggatgaggctgacttattacngtgcatcgacgggacncaacntggggatgacaatctggagtcggggtttgggngttcgggcggtagggacccaaaagtcggaacccgtcctaggtcaacgcccaagg

SEQ ID NO: 310741 - DNA, 592 bp, Homo sapiens
  misc_feature: GZ8MTXP02G9NXU.21.22.B11.1.454.CMB.2.raw
  modified_base (199)..(199): a, c, t, g, unknown or other
  misc_feature (199)..(199): n is a, c, g, or t
  modified_base (311)..(311): a, c, t, g, unknown or other
  misc_feature (311)..(311): n is a, c, g, or t
  modified_base (335)..(335): a, c, t, g, unknown or other
  misc_feature (335)..(335): n is a, c, g, or t
  modified_base (339)..(339): a, c, t, g, unknown or other
  misc_feature (339)..(339): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctcgggacccccggnagagggtcaccatctcttgttctggagcaactccaacatacggaagtaattatgtattctggtatcagcaactccaggaactcggacccccaaatcctcatccagagaatancagcgcctcgacgggtcctgaccnttcnctggctcagtctgcacctcacgccctcctgaccctatcgaggtcggcctcccgggtacgaggtactgggacgtcgtacgtacttaattccgtagtcgactacgtaccgggaaccgggacaaccaagtaggtggaatacgaactacgtcggtaggtaggggttccgggttaggggttccggtacggggaacgggtacggaaacccgtaagtccgggacccgttacggtaggaccgaacccgaccgtaacccggg

SEQ ID NO: 310742 - DNA, 557 bp, Homo sapiens
  misc_feature: GZ8MTXP02I6JE1.21.22.B11.1.454.CMB.2.raw
  modified_base (198)..(198): a, c, t, g, unknown or other
  misc_feature (198)..(198): n is a, c, g, or t
  modified_base (310)..(310): a, c, t, g, unknown or other
  misc_feature (310)..(310): n is a, c, g, or t
  modified_base (331)..(331): a, c, t, g, unknown or other
  misc_feature (331)..(331): n is a, c, g, or t
  modified_base (373)..(373): a, c, t, g, unknown or other
  misc_feature (373)..(373): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctgggacccccggnagagggtcaccatctcttgttctggagcaactccaacatcggaataattatgtattctggtatcagcaactcccaggaatcggacccccaaatcctcatccagaggaataancagcggcctcgaggggtcccngaccgattctctggctccaagtctggcacctcacgcctcccngaccatcagtcgggcctccggtccgaggactgaggctagactattactgtatgtatttggcacagcgtctttagcgttcgttcggaaacgttcggggaaccctaagggttcccaaacccgttctaacgggtccaacggccccaaaacggtccccaaaacccccacgtcgtaccaccgttctccg

SEQ ID NO: 310743 - DNA, 536 bp, Homo sapiens
  misc_feature: GZ8MTXP02H2P3I.21.22.B11.1.454.CMB.2.raw
  modified_base (237)..(237): a, c, t, g, unknown or other
  misc_feature (237)..(237): n is a, c, g, or t
  modified_base (349)..(349): a, c, t, g, unknown or other
  misc_feature (349)..(349): n is a, c, g, or t
  modified_base (376)..(376): a, c, t, g, unknown or other
  misc_feature (376)..(376): n is a, c, g, or t
  modified_base (429)..(429): a, c, t, g, unknown or other
  misc_feature (429)..(429): n is a, c, g, or t
  modified_base (469)..(469): a, c, t, g, unknown or other
  misc_feature (469)..(469): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctcgggacccccgggcagagggtcaccatctcttgttctggagcaactccaanatcggaataattatgtattctggtatcagcaactcccaaggatcggacccccaaatcctacatccagaagaataatcagccggccctcgacggggtccctgaccgattctcngctcaagtctggcactccagccctccngaccatcagtcggcctccggtcgaggatggacggtctgactattactggtacncatcggacgggacacaacgagtgggatgaacaatcgtagnggtcggttgggtcgtacgggcggtaaggaccaaagtcgaaccgtccgtaggtccacgtacccgacgg

SEQ ID NO: 310744 - DNA, 539 bp, Homo sapiens
  misc_feature: GZ8MTXP02HQHD5.21.22.B11.1.454.CMB.2.raw
  modified_base (248)..(248): a, c, t, g, unknown or other
  misc_feature (248)..(248): n is a, c, g, or t
  modified_base (255)..(255): a, c, t, g, unknown or other
  misc_feature (255)..(255): n is a, c, g, or t
  modified_base (444)..(444): a, c, t, g, unknown or other
  misc_feature (444)..(444): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctgggacccccgggcagagggtcaccatctcttgtctggagcaactcaacatcggaataattangtattcnggtatcagcaactcccaggaatcggcccccaaatcctcatccagagaataatcagcggcctgaggggtccctgaccgacttctctggctcaagttctggcacctcacgcctccctgacccatcgagtgggcctccggtcgagatgaggctgactattactgtcgacagtccgaacggggacacaaacgngtgggatacgaactagtcgtaggacgggtcgggttgggtcgtcggggacggaacggaccgaaggcgtacggaccgtcgtacggtaccgacgaccg

SEQ ID NO: 310745 - DNA, 619 bp, Homo sapiens
  misc_feature: GZ8MTXP02GM6JL.21.22.B11.1.454.CMB.2.raw
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctcgggacccccggcagagggtcaccatctcttgttctggagcaactccaacatcggaagtaattatgtattctggtatcagcaactcccaggaatcggacccccaaactcctacactccagaggaataatcagccgccctcgacggggtccctagaccgattcctctggcctccgaagttctcggccacctcacgtccctccctagaccctatcaggtcgggcctcccgggtccgaggacgtggacggctagtaacttattaccgtgtcgctacgtaccggaacgggaccgacgaaaagtcggggaaataggaacctaaagtcgtaggtaggtcggggtttggggtcggttaccggggacggggtaacggaacccgtaaaacgtccggaacccggttaccgtaacgggtccgaacggaccccgaaaggtccccg

SEQ ID NO: 310746 - DNA, 513 bp, Homo sapiens
  misc_feature: GZ8MTXP02F0HLE.21.22.B11.1.454.CMB.2.raw
  modified_base (198)..(198): a, c, t, g, unknown or other
  misc_feature (198)..(198): n is a, c, g, or t
  modified_base (395)..(395): a, c, t, g, unknown or other
  misc_feature (395)..(395): n is a, c, g, or t
  modified_base (411)..(411): a, c, t, g, unknown or other
  misc_feature (411)..(411): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctgggacccccggnagagggtcaccatctcttgttctggagcaactccaacatcggaataattatgtattctggtatcagcaactcccaggaatggcccccaaatcctcatccagaggaataatcagcggccctcaggggtccctgaccgattctctggctccaagtctggcacctcacgcctcctgacccatcagtggctcggtcgaggntgagctgactattacngtgcatcgacgggacacaacagtgggatgacaatctggagtcgggttgggtgttcgggcggagggaccaaacgtcgaaccgtcgtaaggtcacgcccaaggg

SEQ ID NO: 310747 - DNA, 515 bp, Homo sapiens
  misc_feature: GZ8MTXP02H185T.21.22.B11.1.454.CMB.2.raw
  modified_base (198)..(198): a, c, t, g, unknown or other
  misc_feature (198)..(198): n is a, c, g, or t
  modified_base (328)..(328): a, c, t, g, unknown or other
  misc_feature (328)..(328): n is a, c, g, or t
  modified_base (380)..(380): a, c, t, g, unknown or other
  misc_feature (380)..(380): n is a, c, g, or t
  modified_base (464)..(464): a, c, t, g, unknown or other
  misc_feature (464)..(464): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctgggacccccggnagagggtcaccatctcttgttctggaggcaactccaacatcggaaagtaattatgtattctggtatcagcaaactcccaggaatcggaccccccaaatcctcatccaagaggaataaatcagcggccctnaggggtcccctgaccgattcctctggctccaagtctggcactcagccctccngacccatcagtggctccggtcgagactgaggctgactattactgtgcatccgaacgggcacaaacagtgggatgaaccaattcngagcggttggcgtcggcggaggaccaaagtgaccgtctaggcagcccgaag

SEQ ID NO: 310748 - DNA, 523 bp, Homo sapiens
  misc_feature: GZ8MTXP02JHENY.21.22.B11.1.454.CMB.2.raw
  modified_base (198)..(198): a, c, t, g, unknown or other
  misc_feature (198)..(198): n is a, c, g, or t
  modified_base (327)..(327): a, c, t, g, unknown or other
  misc_feature (327)..(327): n is a, c, g, or t
  modified_base (434)..(434): a, c, t, g, unknown or other
  misc_feature (434)..(434): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctgggacccccggnagagggtcaccatctcttgttctggagcaactccaacatcggaagtattatgtattctgtatcagcaactcccaggaatggcccccaaatcctcatccagaggaataatcagcggcctcaggggtcccngaccgattctctggctccaagtctggcacctcacgcctccctgaccatcagtcgggctcccggtccgaggactggaggctagacttatactgtgcatcgacggggcncaacatgggatgacaatcgtagagcgggttggcgttcgggacggagggaccaaacgtcggaaccgtccgtaggtcaacggcccgaacgg

SEQ ID NO: 310749 - DNA, 591 bp, Homo sapiens
  misc_feature: GZ8MTXP02I26S9.21.22.B11.1.454.CMB.2.raw
  modified_base (292)..(292): a, c, t, g, unknown or other
  misc_feature (292)..(292): n is a, c, g, or t
  modified_base (329)..(329): a, c, t, g, unknown or other
  misc_feature (329)..(329): n is a, c, g, or t
  modified_base (339)..(339): a, c, t, g, unknown or other
  misc_feature (339)..(339): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctgggacccccggcagagggtcaccatctcttgttctggagcaactccaacatcggaagtaattatgtattctggtatcagcaactcccagatcggcccccaaatccncatccagaggaataatcagccgcctcgaggggtcccngaccgattcnctgctccaagtctggccacctcacgccctcctgaccatcaggtgggcctccgggtcgaggtactgaggtctgaccttattaccgtgttcgactagtcgaacggggaccacaaacgtggtaggggacttaggaaacctaaattccgtaggtaacggtcggggtttggggtcggtttacggggaccggggtaaggggaaacccaaaacgtcggtaacccggtaccgttagggtaccacggaccccgtaaacggg

SEQ ID NO: 310750 - DNA, 547 bp, Homo sapiens
  misc_feature: GZ8MTXP02I0ZFQ.21.22.B11.1.454.CMB.2.raw
  modified_base (198)..(198): a, c, t, g, unknown or other
  misc_feature (198)..(198): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctgggacccccggnagagggtcaccatctcttgtctggagcaactccaacatcggaatattatgtattctggtatcagcaactcccaggaatcggaccccccaaatcctcactccagagaataatcagccgccctcgacggggtccctgaccgattctctcgctcaagttctggcacctcacgccctcctgaccatcaggtcggccttcccggtcgaggctggacggctagacttattactggtcgcatcgaacgggcacaagcgtagggatgaactaatcgtgacggtcgggttggtcggttcgggacggtacgggaaccaaacggtcggaacccgttcgtaaggtccacggaccctaaggg

SEQ ID NO: 310751 - DNA, 565 bp, Homo sapiens
  misc_feature: GZ8MTXP02F4A57.21.22.B11.1.454.CMB.2.raw
  modified_base (298)..(298): a, c, t, g, unknown or other
  misc_feature (298)..(298): n is a, c, g, or t
  modified_base (312)..(312): a, c, t, g, unknown or other
  misc_feature (312)..(312): n is a, c, g, or t
  modified_base (434)..(434): a, c, t, g, unknown or other
  misc_feature (434)..(434): n is a, c, g, or t
  modified_base (459)..(459): a, c, t, g, unknown or other
  misc_feature (459)..(459): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctcgggacccccggcagagggtcaccatctcttgttctggagcaactccaacatcggaagtaattatgtattctggtatcagcaactcccaaggaactcggacccccaaatccncatccagagaatancagcgccctgacggggtcctagaccgattctctggcctcgaagttctcggccacctcacgtccctccctgacccatcgaggtcgggctcccgggtcgaggatggaggctagacttagttacngtcgacatacgacgggacacaacgngtgggatgaacaatcgtaggaggttcggttaggggtcgttacggggacggacggggaaaccaacggttcggacccgttacgtagggtaccacggacccgaaacggg

SEQ ID NO: 310752 - DNA, 504 bp, Homo sapiens
  misc_feature: GZ8MTXP02JJS38.21.22.B11.1.454.CMB.2.raw
  modified_base (198)..(198): a, c, t, g, unknown or other
  misc_feature (198)..(198): n is a, c, g, or t
  modified_base (235)..(235): a, c, t, g, unknown or other
  misc_feature (235)..(235): n is a, c, g, or t
  modified_base (293)..(293): a, c, t, g, unknown or other
  misc_feature (293)..(293): n is a, c, g, or t
  modified_base (402)..(402): a, c, t, g, unknown or other
  misc_feature (402)..(402): n is a, c, g, or t
  modified_base (453)..(453): a, c, t, g, unknown or other
  misc_feature (453)..(453): n is a, c, g, or t
  modified_base (499)..(499): a, c, t, g, unknown or other
  misc_feature (499)..(499): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctgggacccccggnagagggtcaccatctcttgtctggaggcaactccaanatcggaataattatgtattctggtatcagcaactcccaggaatcggcccccaaatccnatccagagaatatcagcggcctcgaggggtccctgaccgattctcgtgcctcgaagttctgggccaccgtcagccctcctgacccatccagtcggcctcggtcccgagntggaggctagattatactgtgcagcatgtgatgacgctgagtggtccggtntcgggcggacggccagccgtagacgtctaggcacggcccagcgtcnccccg

SEQ ID NO: 310753 - DNA, 584 bp, Homo sapiens
  misc_feature: GZ8MTXP02H04M3.21.22.B11.1.454.CMB.2.raw
  modified_base (199)..(199): a, c, t, g, unknown or other
  misc_feature (199)..(199): n is a, c, g, or t
  modified_base (215)..(215): a, c, t, g, unknown or other
  misc_feature (215)..(215): n is a, c, g, or t
  modified_base (237)..(237): a, c, t, g, unknown or other
  misc_feature (237)..(237): n is a, c, g, or t
  modified_base (340)..(340): a, c, t, g, unknown or other
  misc_feature (340)..(340): n is a, c, g, or t
  modified_base (345)..(345): a, c, t, g, unknown or other
  misc_feature (345)..(345): n is a, c, g, or t
  modified_base (350)..(350): a, c, t, g, unknown or other
  misc_feature (350)..(350): n is a, c, g, or t
  modified_base (376)..(376): a, c, t, g, unknown or other
  misc_feature (376)..(376): n is a, c, g, or t
  modified_base (427)..(427): a, c, t, g, unknown or other
  misc_feature (427)..(427): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctcgggacccccggnagagggtcaccatctnttgttctggaggcaactccaanatcggaaagtaattatgtattctggtatcagcaactcccaggaactcggaccccccaaatccctacactccaagaagaataatcagccgcctgacgggtcccngaccntctcngctcagtctgccactcacgccctccngaccatcgaggtcggcctccgggaccgagactgaggtctgtaactattacnggtcacagtcggaacgggacacgaaacgtggtacgggaattcgaaaactaacgttcgtagggtagggtccggtttagggggtcggttaccggggacgggaacggaaccctaaacgtcggaacccgttaccgtagggtacccaacggaccccgaacgg

SEQ ID NO: 310754 - DNA, 591 bp, Homo sapiens
  misc_feature: GZ8MTXP02H3D0Q.21.22.B11.1.454.CMB.2.raw
  modified_base (198)..(198): a, c, t, g, unknown or other
  misc_feature (198)..(198): n is a, c, g, or t
  modified_base (220)..(220): a, c, t, g, unknown or other
  misc_feature (220)..(220): n is a, c, g, or t
  modified_base (233)..(233): a, c, t, g, unknown or other
  misc_feature (233)..(233): n is a, c, g, or t
  modified_base (244)..(244): a, c, t, g, unknown or other
  misc_feature (244)..(244): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctgggacccccggnagagggtcaccatctcttttcnggagcaatccaantcggaatattntgtattctggtatcagcaactcccaggaatggacccccaaactcctcatccagagaatatcagcggccctcgacggggtccctgacgtattccctctgctccaagtctgccacctcagccctcctgaccatccgagtcggctccggtccgagactgaggctaggacttagttaacctggttcgactacgtaccgaccggggacgtccaaacgagttacggggaactcggtaaacaaagttccgttaggaacggtccgggggtttagggtacgttcggggcggtaaacggggtcctaaaacgtcggtaacccgttccgtacggttccacggtaccccgaaaggtcccg

SEQ ID NO: 310755 - DNA, 498 bp, Homo sapiens
  misc_feature: GZ8MTXP02IXOEA.21.22.B11.1.454.CMB.2.raw
  modified_base (197)..(197): a, c, t, g, unknown or other
  misc_feature (197)..(197): n is a, c, g, or t
  modified_base (233)..(233): a, c, t, g, unknown or other
  misc_feature (233)..(233): n is a, c, g, or t
  modified_base (251)..(251): a, c, t, g, unknown or other
  misc_feature (251)..(251): n is a, c, g, or t
  modified_base (334)..(334): a, c, t, g, unknown or other
  misc_feature (334)..(334): n is a, c, g, or t
  modified_base (360)..(360): a, c, t, g, unknown or other
  misc_feature (360)..(360): n is a, c, g, or t
  modified_base (401)..(401): a, c, t, g, unknown or other
  misc_feature (401)..(401): n is a, c, g, or t
  modified_base (416)..(416): a, c, t, g, unknown or other
  misc_feature (416)..(416): n is a, c, g, or t
  modified_base (422)..(422): a, c, t, g, unknown or other
  misc_feature (422)..(422): n is a, c, g, or t
  modified_base (439)..(439): a, c, t, g, unknown or other
  misc_feature (439)..(439): n is a, c, g, or t
tcagtcgtcgctcgcacgaccggtgctcgatttagacgacagctcagggagcttcagctgtggtagagaagacaggactcaggacaatctccagcatggccggcttccctctcctcctcaccctcctcactcactgcgcagggtcctgggcccagtctgtgctgactcagccaccctcagcgtctgggacccccggnagagggtcaccatctcttgtctggagcaactcaacntcggaatattatgtatcngtatcagcaactccaggaatggacccccaaatcctcatccagaggaataatcagcggccctcgaggggtccctgaccgattcnctgctcaagtctgcactcagcctccngaccatcaggtggctccggtccgagatgagctgactatacngtcgcatcgacggcnaaacgngtggatgaacatcgagnggtcgggttggttcgtcgggacggacggaaccaagtcgaccgtcacgtacacgaccgag

SEQ ID NO: 310756 - DNA, 565 bp, Homo sapiens
  misc_feature: GZ8MTXP02IYD4O.21.22.B11.1.454.CMB.2.raw
  modified_base (378)..(378): a, c, t, g, unknown or other
  misc_feature (378)..(378): n is a, c, g, or t
  modified_base (425)..(425): a, c, t, g, unknown or other
  misc_feature (425)..(425): n is a, c, g, or t
  modified_base (444)..(444): a, c, t, g, unknown or other
  misc_feature (444)..(444): n is a, c, g, or t
  modified_base (450)..(450): a, c, t, g, unknown or other
  misc_feature (450)..(450): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctgggacccccggcagagggtcaccatctcttgttctggagcaactccaacatcggaagtattatgtattctggtatcagcaactcccaggaatcggacccccaaatccctcactccaagaggaataatcagccggccctcgacggggtccctgaccgattctctgctcaagtctggccacctcacgccctccngaccatcagtcggctccggtcgaggctggacggctagacttattacngtcgcatccgaacgggacncaaacngtgggatagaacaagtcgtggacggtcggtttagggtcgttaccgggacggggtaacgggaacccaaaacggttcggaaccccggttacgtagggtaccacgtacccccgaaggg

SEQ ID NO: 310757 - DNA, 546 bp, Homo sapiens
  misc_feature: GZ8MTXP02HFPAA.21.22.B11.1.454.CMB.2.raw
  modified_base (236)..(236): a, c, t, g, unknown or other
  misc_feature (236)..(236): n is a, c, g, or t
  modified_base (428)..(428): a, c, t, g, unknown or other
  misc_feature (428)..(428): n is a, c, g, or t
  modified_base (446)..(446): a, c, t, g, unknown or other
  misc_feature (446)..(446): n is a, c, g, or t
  modified_base (453)..(453): a, c, t, g, unknown or other
  misc_feature (453)..(453): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctcgggacccccggcagagggtcaccatctcttgttctggagcaactccaanatcggaagtaattatgtattctggtatcagcaactcccaggaatcggaccccccaaatcctacactccaagaaggaataaatcagccggccctacgacggggtcccctgaccgattctctggctcaagtctggcactcacgcctcctgaccatcagtggcctcccggtcgagactgaggctagactaattcngtgcagtacgacgggacncaaacgngtagggatacgacaaaagtcgtaggaggcggttagggtcggttcgggacggagggaaccaacgtcgaccggtccaaggtccacgtaccaacgg

SEQ ID NO: 310758 - DNA, 558 bp, Homo sapiens
  misc_feature: GZ8MTXP02F8M20.21.22.B11.1.454.CMB.2.raw
  modified_base (199)..(199): a, c, t, g, unknown or other
  misc_feature (199)..(199): n is a, c, g, or t
  modified_base (429)..(429): a, c, t, g, unknown or other
  misc_feature (429)..(429): n is a, c, g, or t
  modified_base (451)..(451): a, c, t, g, unknown or other
  misc_feature (451)..(451): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctcgggacccccggnagagggtcaccatctcttgttctggagcaactccaacatcggaataattatgtattctggtatcagcaactcccaggaatcggacccccaaatcctcatccagagaataatcagccggccctcgacggggtccctgaccgtacttctctggcctcaagtctggccacctcacgccctccctgacccatcgagtcgggcctccggtccgaggatggaggctgactattacngtgcagtcgacgggacacaacngtagggatgaacaattcgtaggaggtcggggtttgggtcggttccggggacggtaacgggaaccaaacgtcggaacccgttccgtaggtccgacggacccgtaacgg

SEQ ID NO: 310759 - DNA, 590 bp, Homo sapiens
  misc_feature: GZ8MTXP02H3196.21.22.B11.1.454.CMB.2.raw
  modified_base (198)..(198): a, c, t, g, unknown or other
  misc_feature (198)..(198): n is a, c, g, or t
  modified_base (235)..(235): a, c, t, g, unknown or other
  misc_feature (235)..(235): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctgggacccccggnagagggtcaccatctcttgttctggagcaactccaanatcggaatattatgtattctggtatcagcaactcccaggaatcggacccccaaatccctcatccagaggaataatcagccggccctcgacggggtcccctggaccgtattcctctcggctccaagttcctgggccacctcacgtccctccctgacccatcaggtcgggctcccggcgaggatgaggctgacttattactgtgcatcgacgggacgcaacagtggggaatggaactaaagtcgtaggaacggtcggggtttaggggtacggtttccggggacgggtaacggggaacccgtaaaacgtcgggtaaacccgttccggttaaggtacccgaacggaccccggaaacggg

SEQ ID NO: 310760 - DNA, 541 bp, Homo sapiens
  misc_feature: GZ8MTXP02JML90.21.22.B11.1.454.CMB.2.raw
  modified_base (352)..(352): a, c, t, g, unknown or other
  misc_feature (352)..(352): n is a, c, g, or t
  modified_base (410)..(410): a, c, t, g, unknown or other
  misc_feature (410)..(410): n is a, c, g, or t
  modified_base (429)..(429): a, c, t, g, unknown or other
  misc_feature (429)..(429): n is a, c, g, or t
  modified_base (443)..(443): a, c, t, g, unknown or other
  misc_feature (443)..(443): n is a, c, g, or t
  modified_base (449)..(449): a, c, t, g, unknown or other
  misc_feature (449)..(449): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtatcgggacccccggcagagggtcaccatctcttgtctggagcaactccaacatcggaataattatgtattctggtatcagcaactcccaggaactcggacccccaaatccctcactccaagaaggaataatcagccggccctcgacggggtcccctagaccgtattcncgtgcctaccaagtctggcacctcagccctcctgaccatcagtcggctccggtcgagntgagctgacttatactgtncatcgaacgggacncaaacngtgggatgaacaatcgtagaggtcggggttaggcggttcgggacggaaggtaacccaacgtcggaacccgtcgtaggccacggtacccaagg

SEQ ID NO: 310761 - DNA, 558 bp, Homo sapiens
  misc_feature: GZ8MTXP02F5K38.21.22.B11.1.454.CMB.2.raw
  modified_base (349)..(349): a, c, t, g, unknown or other
  misc_feature (349)..(349): n is a, c, g, or t
  modified_base (411)..(411): a, c, t, g, unknown or other
  misc_feature (411)..(411): n is a, c, g, or t
  modified_base (429)..(429): a, c, t, g, unknown or other
  misc_feature (429)..(429): n is a, c, g, or t
  modified_base (432)..(432): a, c, t, g, unknown or other
  misc_feature (432)..(432): n is a, c, g, or t
  modified_base (446)..(446): a, c, t, g, unknown or other
  misc_feature (446)..(446): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctgggacccccggcagagggtcaccatctcttgttctggaggcaactccaacatcggaagtaattatgtattctggtatcagcaactcccaggaatcggacccccaaactcctcactccagaggaataatcagccggccctcgacggggtccctgaccgacttcncgtggcctcaagtctggccacctcacgccctcctgaccatcaggtgggcctccggtcgaggntgagctagacttattacngtnctatcgacgggacncaacgagtgggatagacaagtcgaggaggtcgggtttagggtcgttaccgggacggagggaacctaaaacggtcggaacccttaccggtaggtccgaacggcccgtaacggg

SEQ ID NO: 310762 - DNA, 551 bp, Homo sapiens
  misc_feature: GZ8MTXP02GFBIM.21.22.B11.1.454.CMB.2.raw
  modified_base (423)..(423): a, c, t, g, unknown or other
  misc_feature (423)..(423): n is a, c, g, or t
  modified_base (440)..(440): a, c, t, g, unknown or other
  misc_feature (440)..(440): n is a, c, g, or t
  modified_base (445)..(445): a, c, t, g, unknown or other
  misc_feature (445)..(445): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctgggacccccggcagagggtcaccatctcttgtctggaggcaactccaacatcggaagtaattatgtattctggtatcagcaactcccaggaatcggcccccaaatcctcatccaagaggaaataatcagccggccctcgacggggtcccctgaccgattctcgtggctccaagtctggccactcagccctcctgacccatcagtggctccggtccgagactgaggctgactattacngtcgcatcgagggaccncaacngtgggatgacaatctaggaggtcggttggggcgtttcgggacgggtaggggaaccctaaaacgtcggaaacccgttccgtaaggtccgacggaccccgtaaacggg

SEQ ID NO: 310763 - DNA, 666 bp, Homo sapiens
  misc_feature: GZ8MTXP02G7RG8.21.22.B11.1.454.CMB.2.raw
  modified_base (199)..(199): a, c, t, g, unknown or other
  misc_feature (199)..(199): n is a, c, g, or t
  modified_base (235)..(235): a, c, t, g, unknown or other
  misc_feature (235)..(235): n is a, c, g, or t
  modified_base (312)..(312): a, c, t, g, unknown or other
  misc_feature (312)..(312): n is a, c, g, or t
  modified_base (547)..(547): a, c, t, g, unknown or other
  misc_feature (547)..(547): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctcgggacccccggnagagggtcaccatctcttgtctggagcaactccaanatcggaatattatgtattctggtatcagcaactccaggactcggacccccaatcctacactccgaggaagaataacncacggccggtccctcggaacggggttccctaggtaccgtactttcctcgtcgggtaccttaccgtaacggttccgtcggggcctacccgttccgaccgtcccccgttaccgtacgaaccctacttccggaacggttccgggtacccgttccgggtacccgaaggtactacgggacgggtacctacgtaccgtttaagttaccggtagtccggtactacgttaccgggaaacccgnacaagtttacgggtaggtactacgtaactacgttcggtacgggtaggttcgggttgggtacggtacgggacggtacggtaacctaacggtcgtaccgtcgtacggcctacggacgacgg

SEQ ID NO: 310764 - DNA, 578 bp, Homo sapiens
  misc_feature: GZ8MTXP02H386G.21.22.B11.1.454.CMB.2.raw
  modified_base (200)..(200): a, c, t, g, unknown or other
  misc_feature (200)..(200): n is a, c, g, or t
  modified_base (237)..(237): a, c, t, g, unknown or other
  misc_feature (237)..(237): n is a, c, g, or t
  modified_base (410)..(410): a, c, t, g, unknown or other
  misc_feature (410)..(410): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctcgggacccccgggnagagggtcaccatctcttgttctggagcaactccaanatcggaagtaattatgtattctggtatcagcaactcccaaggaatcggacccccaaatcctcatccagagaataatcaagcggcctcgacggggtccctgaccgatctctggctcaagtctggcacctcacgccctccctgacccatcgaggtcgggacctccgggtcgaggntggaggctgacttattacgtgtcgacagtcgacggggacacaaacgtagtcggggaataggaactaaacgtcgtaggacgggtcgggtttaggggtcgttacggggacggtaggggaaccctaaaacgtcggaacccgttccggtaggtaccgacgtaccccgaacgg

SEQ ID NO: 310765 - DNA, 705 bp, Homo sapiens
  misc_feature: GZ8MTXP02IMDCP.21.22.B11.1.454.CMB.2.raw
  modified_base (198)..(198): a, c, t, g, unknown or other
  misc_feature (198)..(198): n is a, c, g, or t
  modified_base (237)..(237): a, c, t, g, unknown or other
  misc_feature (237)..(237): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctgggacccccggnaggagggtcaccatctcttgttctggaggcaactccaanatcggaagtaattatgtattctggtatcagcaactcccaggaactcggaccccccaaactccctacactacccaaggaaggtaaataactacgaacggcccggccctacggaccggggtcccctacggaccgtactttcctcgtcggtcctaccgtaacgttcgtcggcctaccctaccgaccgtccccctcccgtacgaaaccctcgttaccgagggttccgggcccgtttcccggggtacccggaaggtacgtacgggaaccgggtcgttacgtaaactttaactttaccggttggtaccgtacaacgtcccgggaaaccgggacaccgaaaacgtggtacggggaatacggaactaaagttcgagggtagggttcgggtttgggggtcggttaccggggacgggtaacggaaacctaacggttcggaaccccggttcgtaacggtaccacccggacccgaacggg

SEQ ID NO: 310766 - DNA, 573 bp, Homo sapiens
  misc_feature: GZ8MTXP02GC9FR.21.22.B11.1.454.CMB.2.raw
  modified_base (199)..(199): a, c, t, g, unknown or other
  misc_feature (199)..(199): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctcgggacccccggnagagggtcaccatctcttgttctggaggcaactccaacatcggaaagtaattatgtattctggtatcagcaactcccaaggaactcggacccccaaactcctacactccagaacggaaataactcaaggccggaccctcgacggggtccctcgaccgtacttcctcgtggacctccgaagttctcggccacctcacgccctccctgacccatcagtcggctcggccgagctgacggtctagactagttactgtcgcagtcgaacggggaccacaaagtgtagggatggaaacaattcgaggagtcgggtttgggcggttacggacggaggtaaccgaaaacgttcgaccgtacgaggtacgacgacccgaacgg

SEQ ID NO: 310767 - DNA, 568 bp, Homo sapiens
  misc_feature: GZ8MTXP02GMHJN.21.22.B11.1.454.CMB.2.raw
  modified_base (331)..(331): a, c, t, g, unknown or other
  misc_feature (331)..(331): n is a, c, g, or t
  modified_base (416)..(416): a, c, t, g, unknown or other
  misc_feature (416)..(416): n is a, c, g, or t
  modified_base (435)..(435): a, c, t, g, unknown or other
  misc_feature (435)..(435): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctcgggacccccgggcagagggtcaccatctcttgttctggaggcaactccaacatcggaagtaattatgtattctggtatcagcaactcccaggaatcggcccccaaatcctcatccagagaatatcagcgcctcgaggggtcccngaccgattctctgctcaagtctggccacctcagccctcctgaccatcagtgggctccggtcgaggatgaggtctagactattacngtgcatcgaacggggaccncgaacagtgggatcgaactaatcgtaggaggtccggggtttggggtcgttacggggacgggtaacgggggtaaccctaaaacgtcgggtaacccgttaccgtacgggtacccaacgggacccccgaaacgggg

SEQ ID NO: 310768 - DNA, 511 bp, Homo sapiens
  misc_feature: GZ8MTXP02J1XHJ.21.22.B11.1.454.CMB.2.raw
  modified_base (179)..(179): a, c, t, g, unknown or other
  misc_feature (179)..(179): n is a, c, g, or t
  modified_base (199)..(199): a, c, t, g, unknown or other
  misc_feature (199)..(199): n is a, c, g, or t
  modified_base (329)..(329): a, c, t, g, unknown or other
  misc_feature (329)..(329): n is a, c, g, or t
  modified_base (433)..(433): a, c, t, g, unknown or other
  misc_feature (433)..(433): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctnagcgtctgggaccccccggnagagggtcaccatctcttgtctggagcaactcaacatcggaagtaattatgtattctggtatcagcaactcccaggaatcggcccccaaactcctcatccagagaatatcagcgcctcgacggggtcccngaccgatctctgctcaagttctggcacctcagccctcctgacccatcagtcggctccggtcgaggatgaggctgactattactgtgcatcgacgggacacaacngtgggatgaacatcgtgaggcggttgggtcggttcggcggaaggaccaagtcgacccgtcgtaggtcacgcccaacgg

SEQ ID NO: 310769 - DNA, 524 bp, Homo sapiens
  misc_feature: GZ8MTXP02IZPHU.21.22.B11.1.454.CMB.2.raw
  modified_base (198)..(198): a, c, t, g, unknown or other
  misc_feature (198)..(198): n is a, c, g, or t
  modified_base (235)..(235): a, c, t, g, unknown or other
  misc_feature (235)..(235): n is a, c, g, or t
  modified_base (292)..(292): a, c, t, g, unknown or other
  misc_feature (292)..(292): n is a, c, g, or t
  modified_base (331)..(331): a, c, t, g, unknown or other
  misc_feature (331)..(331): n is a, c, g, or t
  modified_base (404)..(404): a, c, t, g, unknown or other
  misc_feature (404)..(404): n is a, c, g, or t
  modified_base (439)..(439): a, c, t, g, unknown or other
  misc_feature (439)..(439): n is a, c, g, or t
  modified_base (444)..(444): a, c, t, g, unknown or other
  misc_feature (444)..(444): n is a, c, g, or t
  modified_base (460)..(460): a, c, t, g, unknown or other
  misc_feature (460)..(460): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctgggacccccggnagagggtcaccatctcttgttctggagcaactccaantcggaagtattatgtattctggtatcagcaactcccaggatcggacccccaaatccncatccagaggaataatcagcggccctcgacggggtcccngaccgattcctctggcctccaagtctggccacctcacgcctccctgacccatcaggtcggcctccggtcgagntgaggctagacttagtctgtgctatcgacgggacncaacngtggatgaactagtcnggacgtcggttgggtcgtcgggacgagggaccaaagtcggaaccgtcgaggtccacgccaacgg

SEQ ID NO: 310770 - DNA, 561 bp, Homo sapiens
  misc_feature: GZ8MTXP02HUXTU.21.22.B11.1.454.CMB.2.raw
  modified_base (462)..(462): a, c, t, g, unknown or other
  misc_feature (462)..(462): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctcggggacccccggcaggagggtcaccatctcttgttctggagcaactcaacatcggaataattatgtattctggtatcagcaaactcccaggaatcggacccccaaatcctcatccaagacggaataatcagcggccctcgacggggtccctgaccgattctcgtggcctcaagttctcggcctacctcacgtcctccctagacccatcaggtgggcctcccgggtcgaggactggaggctagacttattactgtgcatcgacgggtacacaacgngtgggatcgaacaatcgtaggaggtcgggttgggttcgtacgggacgggaacggaacctaaacgtcgaaccggtctacgggtccacggacccgtaacgg

SEQ ID NO: 310771 - DNA, 585 bp, Homo sapiens
  misc_feature: GZ8MTXP02IJC76.21.22.B11.1.454.CMB.2.raw
  modified_base (198)..(198): a, c, t, g, unknown or other
  misc_feature (198)..(198): n is a, c, g, or t
  modified_base (296)..(296): a, c, t, g, unknown or other
  misc_feature (296)..(296): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctgggacccccggnagagggtcaccatctcttgttctggaggcaactccaacatcggaagtaattatgtattctggtatcagcaactcccaggaatcggacccccaaatccncatccagagaataatcagcgccctcgacggggtccctgaccgacttctctcggctccaagtctggcacctcacgcctcctgaccatcagtggctccggtccgaggactgacggctgacttattactgtcgcactcgaacgggggaccacgaacagttaggggatacggaacaattcgtggaggtcggggtttgggggtcgtttaccggggacggggaaggggtaaccccaaaaaggttcgggaaacccggttacccgtaagggggttccaacggtacccccgaaagggg

SEQ ID NO: 310772 - DNA, 618 bp, Homo sapiens
  misc_feature: GZ8MTXP02GYDM5.21.22.B11.1.454.CMB.2.raw
  modified_base (200)..(200): a, c, t, g, unknown or other
  misc_feature (200)..(200): n is a, c, g, or t
  modified_base (294)..(294): a, c, t, g, unknown or other
  misc_feature (294)..(294): n is a, c, g, or t
  modified_base (330)..(330): a, c, t, g, unknown or other
  misc_feature (330)..(330): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctcgggacccccgggnagagggtcaccatctcttgttctggagcaactccaacatcggaatattatgtattctggtatcagcaactccaggaatcggacccccaaatccncatccagagaataatcagcggcctcgacggggtccngaccgattctctcgctcaagtctggcacctcacgccctcctgacccatcgaggtcgggcctcccgggtccgaggactggacggtcctaggacctttaagttacgtcggtcgaccgaacgtcccggaaaccgggggaccacgaaaaccgtggtaggggacttacggaaactaaagtttccgagggacgggttcgggggtttgggggtacggtttccgggggacgggtaacgggaaaccgtaaacgttcggaacccggttaccggttaggaccacggaccccgtaacggg

SEQ ID NO: 310773 - DNA, 603 bp, Homo sapiens
  misc_feature: GZ8MTXP02IAZBW.21.22.B11.1.454.CMB.2.raw
  modified_base (179)..(179): a, c, t, g, unknown or other
  misc_feature (179)..(179): n is a, c, g, or t
  modified_base (199)..(199): a, c, t, g, unknown or other
  misc_feature (199)..(199): n is a, c, g, or t
  modified_base (236)..(236): a, c, t, g, unknown or other
  misc_feature (236)..(236): n is a, c, g, or t
  modified_base (251)..(251): a, c, t, g, unknown or other
  misc_feature (251)..(251): n is a, c, g, or t
  modified_base (384)..(384): a, c, t, g, unknown or other
  misc_feature (384)..(384): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctnagcgtctgggacccccgggnagagggtcaccatctcttgttctggagcaactccaanatcggaagtaattangtattctggtatcagcaactccccaggaatcggacccccccaaatccctcatccagaaggaataatcagcggccctcgaggggtcccctgaccgatctctgctcaagtctggccacctcacgtccctcccgtnacccactcaggtcgggcccttcccgggtccgaggatggaggtcctagacttaaattctgtgctatcgaacggggtacaccaagagtggggaatggaaccaaagttctagggaggtccgggttttagggggtgttaccgggggacggggtaacgggaaaccctaaaacggttcggaaaccccggttacgtaacgggtccaacggtacccccgaaacgggg

SEQ ID NO: 310774 - DNA, 536 bp, Homo sapiens
  misc_feature: GZ8MTXP02J22WJ.21.22.B11.1.454.CMB.2.raw
  modified_base (198)..(198): a, c, t, g, unknown or other
  misc_feature (198)..(198): n is a, c, g, or t
  modified_base (318)..(318): a, c, t, g, unknown or other
  misc_feature (318)..(318): n is a, c, g, or t
  modified_base (423)..(423): a, c, t, g, unknown or other
  misc_feature (423)..(423): n is a, c, g, or t
  modified_base (441)..(441): a, c, t, g, unknown or other
  misc_feature (441)..(441): n is a, c, g, or t
  modified_base (448)..(448): a, c, t, g, unknown or other
  misc_feature (448)..(448): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctgggacccccggnagagggtcaccatctcttgtctggagcaactccaacatcggaagtaatatgtattctgtatcagcaactcccaggaactcggacccccaaatcctcatccagagaataatcagcggcccngacggggtccctgaccgattcctctcggctcaagttctggcacctcagcctcctgacccatcgagtcgggctccggtccgaggactggaggcctgactagttacngtagcatccgacgggacncgtaacngtgggatggaacaagtctaggaggtcgggttgggtgttcgggcggtaacgggaccaaacgtcgaccgtaccgtaggcaacgcccaagg

SEQ ID NO: 310775 - DNA, 543 bp, Homo sapiens
  misc_feature: GZ8MTXP02IZGC1.21.22.B11.1.454.CMB.2.raw
  modified_base (198)..(198): a, c, t, g, unknown or other
  misc_feature (198)..(198): n is a, c, g, or t
  modified_base (345)..(345): a, c, t, g, unknown or other
  misc_feature (345)..(345): n is a, c, g, or t
  modified_base (456)..(456): a, c, t, g, unknown or other
  misc_feature (456)..(456): n is a, c, g, or t
  modified_base (475)..(475): a, c, t, g, unknown or other
  misc_feature (475)..(475): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctgggacccccggnagagggtcaccatctcttgttctggaggcaactccaacatcggaagtaattatgtattctggtatcagcaactcccaggaatcggacccccaaatcctcatccagagaataatcagccgccctcgacggggtccctgaccgattccnctggctccaagtctggccacctcgacgccctccctgaccctatcaggttcgggacctcccgggtcgaggctggaggtctgaacttattacgtgtcgacatcgaacgggacnaacagtgggatgacatcgnggagtcgggttggcgttcggacgggtaggacctaaagtcggacccgtcgaaggtccacgaccctaagg

SEQ ID NO: 310776 - DNA, 617 bp, Homo sapiens
  misc_feature: GZ8MTXP02JPN0S.21.22.B11.1.454.CMB.2.raw
  modified_base (199)..(199): a, c, t, g, unknown or other
  misc_feature (199)..(199): n is a, c, g, or t
  modified_base (389)..(389): a, c, t, g, unknown or other
  misc_feature (389)..(389): n is a, c, g, or t
  modified_base (476)..(476): a, c, t, g, unknown or other
  misc_feature (476)..(476): n is a, c, g, or t
tcagtcgtcgctcgcacgaccggtgctcgatttagacgacagctcagggcagcttcagctgtggtagagaagacaggactcaggacaatctccagcatggccggcttccctctcctcctcaccctcctcactcactgcgcagggtcctgggcccagtctgtgctgactcagccaccctcagcgtctcgggacccccggnagagggtcaccatctcttgttctggaggcaactccaacatcggaatattatgtattctggtatcagcaactcccaggaatcggcccccaaatcctcatccagaggaataatcgagccggcccctgacggggtcccctgacccccgtattcctcgtggctaccaagtctgggcctacctcacgccctcccngacccatccaggtcgggcctcccgggtccgaggatggaggctagacttagttacgtgtgactagtaccgaccggggacacgaaacgnggtagggataggaacctaaagttccgtagggagtaccggttaaggtttcgggggtacggtttccggggacggggtaaccggggaaacccctaaaacggttccggaaccccggttacccggttaacggggtcccaaaccggg

SEQ ID NO: 310777 - DNA, 600 bp, Homo sapiens
  misc_feature: GZ8MTXP02J0RID.21.22.B11.1.454.CMB.2.raw
  modified_base (493)..(493): a, c, t, g, unknown or other
  misc_feature (493)..(493): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctcgggacccccggcagagggtcaccatctcttgttctggaggcaactccaacatcggaaagtaattatgtattctggtatcagcaactcccaggaatcggacccccaaatcctcactccagaggaataatcagccggccctcgacggggtcccctgaccgtacttcctcgtggcctaccaacgttctcgggcctaaccctcacgtcccctcccgtacgacccattccgaggtcggggcctcccgggtccgaggtactggacggtctgaacttattacgtgtgcctatccggaacggggacacaaacgngttaggggattagaacaagttcgtaggaggtcgggggtttgggtcgttcggggaccgggagggaaaccctaacgtcgacccgtcgtacggacgacggacccgaacgg

SEQ ID NO: 310778 - DNA, 579 bp, Homo sapiens
  misc_feature: GZ8MTXP02HLRI9.21.22.B11.1.454.CMB.2.raw
  modified_base (239)..(239): a, c, t, g, unknown or other
  misc_feature (239)..(239): n is a, c, g, or t
  modified_base (338)..(338): a, c, t, g, unknown or other
  misc_feature (338)..(338): n is a, c, g, or t
  modified_base (362)..(362): a, c, t, g, unknown or other
  misc_feature (362)..(362): n is a, c, g, or t
  modified_base (382)..(382): a, c, t, g, unknown or other
  misc_feature (382)..(382): n is a, c, g, or t
  modified_base (432)..(432): a, c, t, g, unknown or other
  misc_feature (432)..(432): n is a, c, g, or t
  modified_base (458)..(458): a, c, t, g, unknown or other
  misc_feature (458)..(458): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagcccaccctcagcgtctcggggacccccggcagagggtcaccatctcttgttctggaggcaactccaanatcggaagtaattatgtattctggtatcagcaactcccaaggactcggacccccaaatcctcatccagagaataatcagccgccctgacggggtccccngaccgattctcgtgcctcaagtcnggccacctcacgccctcccngacccatcgaggtcgggcctcccggtcgagatggagctagacttattacngtgactagtcgacgggacacaaacgngtgggatagaaacaagttcgaggaggtcgggtttggggtacgttccggggacgggaacgggaaaccctaaaacggtcggtaaccccgttcggacggttaccgaccggtaccctaaacgggg

SEQ ID NO: 310779 - DNA, 587 bp, Homo sapiens
  misc_feature: GZ8MTXP02JKSQ6.21.22.B11.1.454.CMB.2.raw
  modified_base (358)..(358): a, c, t, g, unknown or other
  misc_feature (358)..(358): n is a, c, g, or t
  modified_base (388)..(388): a, c, t, g, unknown or other
  misc_feature (388)..(388): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtcgtcggggacccccggcaggagggtcaccatctcttgttctggaggcaactccaacatacggaagtaattatgtattcgtggtatcagcaactcccaaggaactcggacccccaaatcctcactccaagaaggaataatcagccggcctcgacggggtcctgacctattctcgngcctacaagtctgccacctcacgcctcccngacccatcgaggtcgggcctccggtcgaggcgtggacggtctagtacttagttacgtgtacgactagtccggaacgggacacgaaacgtggtagggatacgaacaagttcgaggtaggtcggggttagggtcggttacggggacggtaacgggactaaacggtcggtaacccgtcgacggtaccacggacccgtaacgg

SEQ ID NO: 310780 - DNA, 581 bp, Homo sapiens
  misc_feature: GZ8MTXP02F5C19.21.22.B11.1.454.CMB.2.raw
  modified_base (200)..(200): a, c, t, g, unknown or other
  misc_feature (200)..(200): n is a, c, g, or t
  modified_base (238)..(238): a, c, t, g, unknown or other
  misc_feature (238)..(238): n is a, c, g, or t
  modified_base (256)..(256): a, c, t, g, unknown or other
  misc_feature (256)..(256): n is a, c, g, or t
  modified_base (287)..(287): a, c, t, g, unknown or other
  misc_feature (287)..(287): n is a, c, g, or t
  modified_base (301)..(301): a, c, t, g, unknown or other
  misc_feature (301)..(301): n is a, c, g, or t
  modified_base (420)..(420): a, c, t, g, unknown or other
  misc_feature (420)..(420): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctcgggaccccccggnagagggtcaccatctcttgttctggagcaactccaacntcggaatatatgtattcngtatcagcactccagaatcgaccccaatccnactccagagaatancagcgcctacgacggggtcctagaccgattctcgtggcctcaagtctggccacctcgacgccctctacgacatcgagtcggcctccggtcgaaggctgacggctacgacttaatttcgngtcgacacgtaccggacggaccacgaacgtaggtacggatacgaactagttcggtaggtacgggttcgggggtttggggtcggtaccgggggaaccggaacggtaaacccgtaacgtaccggtacccggtaccggtacgaccggaaccgtacccgtaacgg

SEQ ID NO: 310781 - DNA, 559 bp, Homo sapiens
  misc_feature: GZ8MTXP02JVE87.21.22.B11.1.454.CMB.2.raw
  modified_base (235)..(235): a, c, t, g, unknown or other
  misc_feature (235)..(235): n is a, c, g, or t
  modified_base (332)..(332): a, c, t, g, unknown or other
  misc_feature (332)..(332): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctgggacccccggcagagggtcaccatctcttgtctggagcaactccaacntcggaagtattatgtattctggtatcagcaactcccaggaatcggacccccaaatcctcatccagaggaataatcagccggcctcgacggggtcccngaccgtattctctggctccgaagtctggccacctcacgccctccctgacccatcgaggtcgggcctccggtcgaggactggaggctagattatactgtcgcagctagtgtagatcggacggcctaggacgttcgggtcccggtggttcgggcgggtacgggaccaggccgttacggacccggttcgtaaggtccacggacccgtaacgggcctaccggtccccccgg

SEQ ID NO: 310782 - DNA, 802 bp, Homo sapiens
  misc_feature: GZ8MTXP02I28EM.21.22.B11.1.454.CMB.2.raw
  modified_base (199)..(199): a, c, t, g, unknown or other
  misc_feature (199)..(199): n is a, c, g, or t
  modified_base (234)..(234): a, c, t, g, unknown or other
  misc_feature (234)..(234): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctgggaccccccggnaggaggtcaccatctcttgtctggagcactccaanagtacggaatattatgtattcgtggtatcagacaactcccgaggaactccggacccccaaactccctacactaccgaagaaggaaataactaccgacggcccggtacccctacggacggggttcccctacggaccgtaccttcctccgtcggtacctaccgtaacgttccgtcggacctaccctacgaccgtccccctacccgtacgaaccctagtccgtacgggttccggggcccgttacccggggtaccggaagggtacgtacggggacgggtaccttacggtaaacctttaagtttacccgttggtacgttaccctaacggttacccgggaaacccgggggtaacccgaaccgtaaaaccgttagggttacgggggaacttaacggaaaaccgttaacgtttaccggtaagggtacggggtttccgggggttttacgggggttaccgggtttaccgggggaacccgggggtaaaccggggtaaaacccctaaaaccggttccggggtaaacccccggtttacccggtaacggggttaccccgaaaccgggtacccccggaaaggg

SEQ ID NO: 310783 - DNA, 569 bp, Homo sapiens
  misc_feature: GZ8MTXP02HEEUF.21.22.B11.1.454.CMB.2.raw
  modified_base (198)..(198): a, c, t, g, unknown or other
  misc_feature (198)..(198): n is a, c, g, or t
  modified_base (316)..(316): a, c, t, g, unknown or other
  misc_feature (316)..(316): n is a, c, g, or t
  modified_base (326)..(326): a, c, t, g, unknown or other
  misc_feature (326)..(326): n is a, c, g, or t
  modified_base (335)..(335): a, c, t, g, unknown or other
  misc_feature (335)..(335): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctgggacccccggnagagggtcaccatctcttgtctggagcaactccaacatcggaagtaattatgtattctggtatcagcaactcccaggaatggacccccaaatcctcatccagagaatatcagcgcctnaggggtcccngacgattcnctgctcaagtctggcacctcacgccctcctgacccatcaggtcggctcggtcgagatgagctgactatactgtgcctagtccgaacggggaccacaaccgtagtaggggattacggaactaaacgttccgtagggaaggttccggggtttagggggtcgtttccgggggacgggttacgggaaacctaaacgtcggaacccggtttcgaaggtaccgacgaccccgtaaacggg

SEQ ID NO: 310784 - DNA, 553 bp, Homo sapiens
  misc_feature: GZ8MTXP02GYL87.21.22.B11.1.454.CMB.2.raw
  modified_base (339)..(339): a, c, t, g, unknown or other
  misc_feature (339)..(339): n is a, c, g, or t
  modified_base (348)..(348): a, c, t, g, unknown or other
  misc_feature (348)..(348): n is a, c, g, or t
  modified_base (380)..(380): a, c, t, g, unknown or other
  misc_feature (380)..(380): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctcgggacccccggcagagggtcaccatctcttgttctggaggcaactccaaacatcggaagttaattatgtattctggtatcagcaactcccaggaactcggacccccaaatccctcactccagaggaataatcagcggcctcgacggggtccngaccattcnctggctccaagtctggcacctcacgccctccngacccatccgaggtcggcctccggtccgagctgacgctgacttatcgtgtgacagtcggacgggacaccaagagtcgggaatgaacgtaatcgagaggtcgggtttagggtcggttcgggacggaggggaaccctaaggtccggaaccgtcgaggtccaacggtcccgaacgg

SEQ ID NO: 310785 - DNA, 601 bp, Homo sapiens
  misc_feature: GZ8MTXP02I98YR.21.22.B11.1.454.CMB.2.raw
  modified_base (198)..(198): a, c, t, g, unknown or other
  misc_feature (198)..(198): n is a, c, g, or t
  modified_base (484)..(484): a, c, t, g, unknown or other
  misc_feature (484)..(484): n is a, c, g, or t
  modified_base (492)..(492): a, c, t, g, unknown or other
  misc_feature (492)..(492): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctgggacccccggnagagggtcaccatctcttgttctggaggcaactccaacatcggaataattatgtattctggtatcagcaactcccaggaatcggacccccaaatcctcactccagagaataatcagccggcctcgacggggtccctagaccgtattcctcgtcggcctaccgaaagttcctgggacctaaccctcgacgtccccttacccgtgaacccattccgaggttcggggcctcccgggtccgaggactggacggctaggacttattacgtgtcgctagtcgaacggggacncaaaacgngtaggatacgaactaagttcgaggacgggtcgggtttgggtacgtcggggacggtaacggaaccctaaacggtcggtaacccgtcgtaggaccgacggacccgtaacgg

SEQ ID NO: 310786 - DNA, 542 bp, Homo sapiens
  misc_feature: GZ8MTXP02GAM87.21.22.B11.1.454.CMB.2.raw
  modified_base (198)..(198): a, c, t, g, unknown or other
  misc_feature (198)..(198): n is a, c, g, or t
  modified_base (422)..(422): a, c, t, g, unknown or other
  misc_feature (422)..(422): n is a, c, g, or t
  modified_base (439)..(439): a, c, t, g, unknown or other
  misc_feature (439)..(439): n is a, c, g, or t
  modified_base (446)..(446): a, c, t, g, unknown or other
  misc_feature (446)..(446): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctgggacccccggnagagggtcaccatctcttgttctggagcaactccaacatcggaataattatgtattctgtatcagcaactccagaatcggcccccaaatcctcatccagaggaataatcagccggccctcacggggtccctagaccgattctctggctccaagttctggccacctcacgccctcctgacctactcagtcgggctccgggtccgaggctgaggctgactattacngtcgcatcgacgggacncaaacgngtgggatagacaagtcgtgaggtcggttgggcggttcggacggtacgggaacctaaagttcggaaccgttccgtaaggtccgacgacccgtaacgg

SEQ ID NO: 310787 - DNA, 810 bp, Homo sapiens
  misc_feature: GZ8MTXP02GQ323.21.22.B11.1.454.CMB.2.raw
  modified_base (199)..(199): a, c, t, g, unknown or other
  misc_feature (199)..(199): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctcgggacccccggnagagggtcaccatctcttgttctggaggcaactccaaacagtacggaaattaattatgtattctggtatcagcaactcccaaggaactcggacccccaaactcctacactaccgaagaaggaaaacttaactacgaacggcccggaccccttacggaacgggggtcccctaggaacccgtatttcctccgtgggccttaccgaaacgttcctacgggcccaaacccttcgaccgtcccccttaccccgtagaaccccctaagttccgaacgggttcggggtacccttccccgggggttacccggaaagggaacttcggggaacgggtccttaaggtaacctttaaatttaccgtagggttcgactaacgttacccggaacgggggaacccacaaaacgaggttcgggggaattacgggaaaacctaaaagttcccgtaaggggtaaccggggttcgggggttttagggggttaccggtttaccgggggaaacccgggggtaaaccgggggtaaaaaccccctaaaaaccgggtttccggggtaaacccccggttttaaccccggtaaagggggtttcccaaaacccgggggtaccccccgtaaaacggggg

SEQ ID NO: 310788 - DNA, 622 bp, Homo sapiens
  misc_feature: GZ8MTXP02IVG67.21.22.B11.1.454.CMB.2.raw
  modified_base (294)..(294): a, c, t, g, unknown or other
  misc_feature (294)..(294): n is a, c, g, or t
  modified_base (343)..(343): a, c, t, g, unknown or other
  misc_feature (343)..(343): n is a, c, g, or t
  modified_base (413)..(413): a, c, t, g, unknown or other
  misc_feature (413)..(413): n is a, c, g, or t
  modified_base (439)..(439): a, c, t, g, unknown or other
  misc_feature (439)..(439): n is a, c, g, or t
  modified_base (465)..(465): a, c, t, g, unknown or other
  misc_feature (465)..(465): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctgggacccccggcagagggtcaccatctcttgttctggagcaactccaacatcggaagtattatgtattctggtatcagcaactcccaggaatcggacccccaaatccncatccagaggaataatcagccgccctcgaggggtccctgaccgattccnctggcctccaagtctggccacctcacgtccctccctgacccatcgaggtcgggactcccgggtccgaggntggaggtctagtaccttaatttaccnggtcgctaacgtcgaaccgggggacncaaacgtagtacgggatagaacctaagttcgtggaacggtcgggggtttaggggtcggtttccggggaacgggaacgggggtaaaacccctaaaacgttccgggtaaccccggttacccgttaacggggtacccgaacgggacccccgtaaacgggg

SEQ ID NO: 310789 - DNA, 588 bp, Homo sapiens
  misc_feature: GZ8MTXP02GEAPU.21.22.B11.1.454.CMB.2.raw
  modified_base (199)..(199): a, c, t, g, unknown or other
  misc_feature (199)..(199): n is a, c, g, or t
  modified_base (258)..(258): a, c, t, g, unknown or other
  misc_feature (258)..(258): n is a, c, g, or t
  modified_base (438)..(438): a, c, t, g, unknown or other
  misc_feature (438)..(438): n is a, c, g, or t
  modified_base (461)..(461): a, c, t, g, unknown or other
  misc_feature (461)..(461): n is a, c, g, or t
  modified_base (467)..(467): a, c, t, g, unknown or other
  misc_feature (467)..(467): n is a, c, g, or t
  modified_base (475)..(475): a, c, t, g, unknown or other
  misc_feature (475)..(475): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctcgggacccccggnagagggtcaccatctcttgttctggagcaactccaacatcggaagtaattatgtattcnggtatcagcaactcccaaggaactcggacccccaaatcctcactccagagaaataatcacgccgccctcgacggggtccctagaccgtatttcctctggcctaccgaagtctcggccacctcacgccctcctgaccatcgagtcgggcctcggtcgagctggacgctagacttaattcgngtcgactagtccgaacgggaccncaaagngtgggaanagaactaagtcgtaggtagggtcgggtttagggtcgttccggggaacgggaacggaaaaccctaaacggttcggtaacccggttaccgtaggtaccaaccggtacccgaacgg

SEQ ID NO: 310790 - DNA, 586 bp, Homo sapiens
  misc_feature: GZ8MTXP02GQIMM.21.22.B11.1.454.CMB.2.raw
  modified_base (200)..(200): a, c, t, g, unknown or other
  misc_feature (200)..(200): n is a, c, g, or t
  modified_base (344)..(344): a, c, t, g, unknown or other
  misc_feature (344)..(344): n is a, c, g, or t
  modified_base (420)..(420): a, c, t, g, unknown or other
  misc_feature (420)..(420): n is a, c, g, or t
  modified_base (441)..(441): a, c, t, g, unknown or other
  misc_feature (441)..(441): n is a, c, g, or t
  modified_base (461)..(461): a, c, t, g, unknown or other
  misc_feature (461)..(461): n is a, c, g, or t
  modified_base (468)..(468): a, c, t, g, unknown or other
  misc_feature (468)..(468): n is a, c, g, or t
tcagtcgtcgctcgcacgaccggtgctcgatttagacgacagctcaggggatcttcagctgtggtagagaagacaggactcaggacaatctccagcatggccggcttccctctcctcctcaccctcctcactcactgcgcagggtcctgggcccagtctgtgctgactcagccaccctcagcgtctcgggacccccgggnagagggtcaccatctcttgttctggagcaactccaacatcggaataattatgtattctgtatcagcaactcccaggaatcggacccccaaatcctacactcccaaggaacggaataactcaagccggccctcgacggggtcccnggaccgacttctctcggctaccaagttctggccacctcagccctcctagacccatcaggtggcctccggtcgaggntggagtctagacttattacgngtgctaagtcgaacgggacncaaacgnggtaggatagaactaagtcgtaggacggtcgggtttggggtcggttaccggggacggggaacgtaaaccgtaaacgtcggtaacccgtacgtacgggtaccgaccggacccgtaacgg

SEQ ID NO: 310791 - DNA, 567 bp, Homo sapiens
  misc_feature: GZ8MTXP02F77CO.21.22.B11.1.454.CMB.2.raw
  modified_base (198)..(198): a, c, t, g, unknown or other
  misc_feature (198)..(198): n is a, c, g, or t
  modified_base (297)..(297): a, c, t, g, unknown or other
  misc_feature (297)..(297): n is a, c, g, or t
  modified_base (456)..(456): a, c, t, g, unknown or other
  misc_feature (456)..(456): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctgggacccccggnagagggtcaccatctcttgttctggaggcaactccaacatcggaagtaattatgtattctggtatcagcaactcccaggaactcggacccccaaatccncactccagaggaataatcagccgccctcgacggggtccctgaccgacttcctcgtggcctaccaagttcgtggccacctcacgccctccctgaccctatcaggtcgggcctccgggtccgaggatgacggctagacttattactgtgcatcgacggacnaacagtggatagactaagtcgtaggaggtcggggttagggtcgggttacggggaccgggggaacctaaacggtcgtacccggtctacgggtcacggtacccgaaggtcccg

SEQ ID NO: 310792 - DNA, 533 bp, Homo sapiens
  misc_feature: GZ8MTXP02FH2ZT.21.22.B11.1.454.CMB.2.raw
  modified_base (198)..(198): a, c, t, g, unknown or other
  misc_feature (198)..(198): n is a, c, g, or t
  modified_base (429)..(429): a, c, t, g, unknown or other
  misc_feature (429)..(429): n is a, c, g, or t
  modified_base (445)..(445): a, c, t, g, unknown or other
  misc_feature (445)..(445): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctgggacccccggnagagggtcaccatctcttgttctggagcaactccaaacatcggaaataattatgtattctggtatcagcaaactcccaggaatcggacccccaaactcctcatccagaggaataatcagcggccctcgacggggtccctgaccgattctctggctcaagtctggcacctcacgccctccctgacccatcagtcgggctcccggtccgaggatggaggctagacttattacngtgcatcgacgggacnaaacagtgggatgaacaatctggagtcggttgggtcgttacgggcggaggaacccaaagtcgaaccgtcgtaggtcaacgcccaaagg

SEQ ID NO: 310793 - DNA, 556 bp, Homo sapiens
  misc_feature: GZ8MTXP02HLKU5.21.22.B11.1.454.CMB.2.raw
  modified_base (199)..(199): a, c, t, g, unknown or other
  misc_feature (199)..(199): n is a, c, g, or t
  modified_base (341)..(341): a, c, t, g, unknown or other
  misc_feature (341)..(341): n is a, c, g, or t
  modified_base (387)..(387): a, c, t, g, unknown or other
  misc_feature (387)..(387): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctgggacccccgggnagagggtcaccatctcttgttctggaggcaactccaacatcggaagtaattatgtattctggtatcagcaactcccaggaatcggaccccccaaatccctcatccaagaaggaataatcagccggccctcgacggggtcccngaccgacttctctggctcaagtctcggccacctcacgcccttcccngacccatcgaggtcggcctcccggtcgaggatggacgctgactattactgtcgcagtccgacgggacacaacgagtgggatagaacaatcgaggaggtcggttggggtcgttcggggacggaacgggaacccaaacgtcgacccgtcgtaggtccgacgacccgaacgg

SEQ ID NO: 310794 - DNA, 544 bp, Homo sapiens
  misc_feature: GZ8MTXP02JA6RX.21.22.B11.1.454.CMB.2.raw
  modified_base (199)..(199): a, c, t, g, unknown or other
  misc_feature (199)..(199): n is a, c, g, or t
  modified_base (298)..(298): a, c, t, g, unknown or other
  misc_feature (298)..(298): n is a, c, g, or t
  modified_base (408)..(408): a, c, t, g, unknown or other
  misc_feature (408)..(408): n is a, c, g, or t
  modified_base (429)..(429): a, c, t, g, unknown or other
  misc_feature (429)..(429): n is a, c, g, or t
  modified_base (442)..(442): a, c, t, g, unknown or other
  misc_feature (442)..(442): n is a, c, g, or t
  modified_base (447)..(447): a, c, t, g, unknown or other
  misc_feature (447)..(447): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctcgggacccccggnagagggtcaccatctcttgttctggagcaactccaacatcggaagtaattatgtattctggtatcagcaaactcccaggaactcggacccccaaatccncatccagagaatatcagcggcctgacggggtccctgaccattcctctgcctccaagtctggccacctcacgccctccctagacccatcagtcgggcctccgggtcgaggntggagctgactattactgtcncatccgacggacncaagngtggatagacgaatcgtaggaggtcgggtttagggtcgttcgggacgggacggaacaaacgtcggaacccgtcgtaggtaccacggtacccgaacgg

SEQ ID NO: 310795 - DNA, 561 bp, Homo sapiens
  misc_feature: GZ8MTXP02FJZPW.21.22.B11.1.454.CMB.2.raw
  modified_base (198)..(198): a, c, t, g, unknown or other
  misc_feature (198)..(198): n is a, c, g, or t
  modified_base (221)..(221): a, c, t, g, unknown or other
  misc_feature (221)..(221): n is a, c, g, or t
  modified_base (236)..(236): a, c, t, g, unknown or other
  misc_feature (236)..(236): n is a, c, g, or t
  modified_base (261)..(261): a, c, t, g, unknown or other
  misc_feature (261)..(261): n is a, c, g, or t
  modified_base (296)..(296): a, c, t, g, unknown or other
  misc_feature (296)..(296): n is a, c, g, or t
  modified_base (350)..(350): a, c, t, g, unknown or other
  misc_feature (350)..(350): n is a, c, g, or t
  modified_base (376)..(376): a, c, t, g, unknown or other
  misc_feature (376)..(376): n is a, c, g, or t
  modified_base (443)..(443): a, c, t, g, unknown or other
  misc_feature (443)..(443): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagcccaccctcagcgtctggacccccggnagagggtcaccatctcttgttcnggagcaactccaacntcggaataattatgtattctggtancagcaactcccaggaactcggacccccaaatcctnatcccagaggaaataatcagccggccctgacggggtccctggacccgatttccnctggcctcccgaagtctggccacctnacgccctcctgacccattcaggtcgggcttccggccgaggactggacggctagacttattactgtcncatcgacggaccacgaaacgtgtacgggatacgaactaatcgtaggacggttcgggttagggtcggtcgggacggaacggtaaccaacgtcgaccgtcgtacgacgaccgaccgaagg

SEQ ID NO: 310796 - DNA, 509 bp, Homo sapiens
  misc_feature: GZ8MTXP02JUJGR.21.22.B11.1.454.CMB.2.raw
  modified_base (198)..(198): a, c, t, g, unknown or other
  misc_feature (198)..(198): n is a, c, g, or t
  modified_base (290)..(290): a, c, t, g, unknown or other
  misc_feature (290)..(290): n is a, c, g, or t
  modified_base (302)..(302): a, c, t, g, unknown or other
  misc_feature (302)..(302): n is a, c, g, or t
  modified_base (323)..(323): a, c, t, g, unknown or other
  misc_feature (323)..(323): n is a, c, g, or t
  modified_base (348)..(348): a, c, t, g, unknown or other
  misc_feature (348)..(348): n is a, c, g, or t
  modified_base (432)..(432): a, c, t, g, unknown or other
  misc_feature (432)..(432): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctgggacccccggnagagggtcaccatctcttgttctggaggcaactccaacatcggaagtaattatgtattctggtatcagcaactcccaggatcgccccaatcnatcagagaatancagccgcctcgacgggtcccngaccgattctctggctccaagttcnggccactcacgccctccctgaccatcaggtcgggctccggtccgagatgaggctgactatctgtgctatcgacgggacacaacngtgggatgaacatcgtagaggcggttgggcgttcggcggtaggaccaaagtcgaaccgtctaggtcacggacccagg

SEQ ID NO: 310797 - DNA, 628 bp, Homo sapiens
  misc_feature: GZ8MTXP02JKJWH.21.22.B11.1.454.CMB.2.raw
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctcgggacccccgggcagagggtcaccatctcttgttctggaggcaactccaacatcggaagtaattatgtattctggtatcagcaactccaggaactcggacccccaaactcctcactccagagaataatcagccgacctcgacggggtccctagtaccgacttctcgtcgcctaccgaagttctcgggccaaccctcgacgccctccctacgaccctagtccgaggttcggggcccgttcccgggtaccggaaggaccgttgggaacggtctaggaactttagttactggtcgaccagttccggaacggggacacaaacgtgtacgggatacggaactaagttcgtagggaggtccggggttaggggttcgttaccgggggacggtaacgggaacccaaaggttccggtaaacccgtcgtaggtaccacggacccggtaacg

SEQ ID NO: 310798 - DNA, 586 bp, Homo sapiens
  misc_feature: GZ8MTXP02JNOT9.21.22.B11.1.454.CMB.2.raw
  modified_base (199)..(199): a, c, t, g, unknown or other
  misc_feature (199)..(199): n is a, c, g, or t
  modified_base (237)..(237): a, c, t, g, unknown or other
  misc_feature (237)..(237): n is a, c, g, or t
  modified_base (416)..(416): a, c, t, g, unknown or other
  misc_feature (416)..(416): n is a, c, g, or t
  modified_base (440)..(440): a, c, t, g, unknown or other
  misc_feature (440)..(440): n is a, c, g, or t
  modified_base (462)..(462): a, c, t, g, unknown or other
  misc_feature (462)..(462): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctcgggacccccggnagagggtcaccatctcttgttctggaggcaactccaanatcggaagtaattatgtattctggtatcagcaactcccaggaatcggacccccaaatcctcactccagagaataatcagccggcctcgacggggtccctggaccgtacttcctctcggcctacgaagtctcggccacctcacgccctccctgacccatcaggtcggctcccggtcgagntgacggctagacttattcgtgtcncatccgaacgggacacaaacgngtgggatagaactaagtcgtaggaggtcggggtttggggtacggttccggggacggggtaacgggaaaccctaaaggttccggaacccggttaccgtaagggtccaaccggccccgtaaagggg

SEQ ID NO: 310799 - DNA, 600 bp, Homo sapiens
  misc_feature: GZ8MTXP02IBG37.21.22.B11.1.454.CMB.2.raw
  modified_base (179)..(179): a, c, t, g, unknown or other
  misc_feature (179)..(179): n is a, c, g, or t
  modified_base (236)..(236): a, c, t, g, unknown or other
  misc_feature (236)..(236): n is a, c, g, or t
  modified_base (475)..(475): a, c, t, g, unknown or other
  misc_feature (475)..(475): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctnagcgtctcggggacccccggcaggagggtcaccatctcttgtctggagcaactcaantacggaagtaattatgtattctggtatcagcaactccaggaactcggaccccctaaatccctacactaccgaagaaggaaaataacgtacaacggccggaccctacggaaccggggtcccctggaaccgtacttctcgtggcctacaacgttcgtcgaccacctcacgtccctccacgaccatccgaggtcgggccttccggcgaggcgtggacgtctagtaacttagtactggtacanacgtacggacggacgacctaagaacgtggaaactgaacaagtcgtaggacggtcgggttggggtcggtacgggacggtaaacggacctaaacgtcggaaccgttccgaggaccgacgaaccgcgg

SEQ ID NO: 310800 - DNA, 683 bp, Homo sapiens
  misc_feature: GZ8MTXP02GNU34.21.22.B11.1.454.CMB.2.raw
  modified_base (198)..(198): a, c, t, g, unknown or other
  misc_feature (198)..(198): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctgggacccccggnagagggtcaccatctcttgttctggaggcaactccaacatcggaagttaattatgtattctggtatcagcaactcccaaggatcggaccccaaactcctcactccaagagaatatcagccggcctagacggggtccctgaccgtacttcctcgtggctacgtaagtccgtgggcctaaccctcgaccgtccccttcccgtagaaccctagtccacggggttcgggcccttcccgggtacccggaaggacgttcgggaacggctaggtaacttaaattccgtaggtcgacctagtaccgggaaccggggaccacaaacggtagttacgggaactaggaaactaaagttccgttaggggaacgggtttcggggttagggggttcggttaccggggaacgggggtaaccggggaaaaccctaaaacggtttccgggaacccgggtttaacccggtacggtaccgaaccggtaccccggtaaaccgggg

SEQ ID NO: 310801 - DNA, 637 bp, Homo sapiens
  misc_feature: GZ8MTXP02HFA5V.21.22.B11.1.454.CMB.2.raw
  modified_base (199)..(199): a, c, t, g, unknown or other
  misc_feature (199)..(199): n is a, c, g, or t
  modified_base (490)..(490): a, c, t, g, unknown or other
  misc_feature (490)..(490): n is a, c, g, or t
  modified_base (500)..(500): a, c, t, g, unknown or other
  misc_feature (500)..(500): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctcgggacccccggnagagggtcaccatctcttgttctggagcaactccaacatcggaataattatgtattctggtatcagcaactcccaaggaactcggacccccaaatccctacactccagagaataatcagccggccctcgacggggtccctaggaccgacttctcgtcggactccaagtcctggcctaacctccacgcccctcctgaccctatccgaaggttcgggaccttcccgggtaccgaggactggaacggtctagacttaaagtttccgtgtggacctagtcccggaacggggaccncgtaaaacgnggtacgggaatacgtaactaacgttcgtagggtacgggttacggggttggggtacgggtaccggggacgggtaaccggaaaaccgtaaccggtcggtaacccggtaccgtaacggtaccgaaccggacccgtaacgg

SEQ ID NO: 310802 - DNA, 574 bp, Homo sapiens
  misc_feature: GZ8MTXP02FW10V.21.22.B11.1.454.CMB.2.raw
  modified_base (198)..(198): a, c, t, g, unknown or other
  misc_feature (198)..(198): n is a, c, g, or t
  modified_base (235)..(235): a, c, t, g, unknown or other
  misc_feature (235)..(235): n is a, c, g, or t
  modified_base (414)..(414): a, c, t, g, unknown or other
  misc_feature (414)..(414): n is a, c, g, or t
  modified_base (454)..(454): a, c, t, g, unknown or other
  misc_feature (454)..(454): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctgggacccccggnagagggtcaccatctcttgttctggagcaactccaanatcggaataattatgtattctggtatcagcaactcccaaggaactcggacccccaaatcctcactccagaggaataatcagccgccctcgacggggtccctgaccgtattcctcgtggcctccaagttctggccacctcacgccctccctgacccatcgagtcggcctccggtccgagntggagctagacttagtactgtcgcatcgacgggacacaangtgggatagactaatcgtaggacggtcggggtttggggtcgttaccggggacgggaacggggtaacctaaaacggttcggaacccggttcgtaacgggtaccaaccggacccgtaacggg

SEQ ID NO: 310803 - DNA, 526 bp, Homo sapiens
  misc_feature: GZ8MTXP02JN62E.21.22.B11.1.454.CMB.2.raw
  modified_base (199)..(199): a, c, t, g, unknown or other
  misc_feature (199)..(199): n is a, c, g, or t
  modified_base (339)..(339): a, c, t, g, unknown or other
  misc_feature (339)..(339): n is a, c, g, or t
  modified_base (423)..(423): a, c, t, g, unknown or other
  misc_feature (423)..(423): n is a, c, g, or t
  modified_base (425)..(425): a, c, t, g, unknown or other
  misc_feature (425)..(425): n is a, c, g, or t
  modified_base (427)..(427): a, c, t, g, unknown or other
  misc_feature (427)..(427): n is a, c, g, or t
tcagtcgtcgctcgcacgaccggtgctcgatttagacgacagctcaggggagccttcagctgtggtagagaagacaggactcaggacaatctccagcatggccggcttccctctcctcctcaccctcctcactcactgcgcagggtcctgggcccagtctgtgctgactcagccaccctcagcgtctgggacccccggnagagggtcaccatctcttgtctggaggcaactccaacatcggaatatatgtatctgtatcagcaactcccaggaatcggcccccaaaatcctcatacccaagacggaaataaatccaagccggccctcgaggggtccccngaccgattcctctgcctacaagtctggcaacctcagcctcctgaccatccagtgggctccggcaggatgaggctgactattacngngnatcgaacgggacacaaacagtgggatacgaacaatactagagacggtggtcggtcggacggacggaacgaacgtacgacgacgtacgacgacgacgacg

SEQ ID NO: 310804 - DNA, 567 bp, Homo sapiens
  misc_feature: GZ8MTXP02HKOJS.21.22.B11.1.454.CMB.2.raw
  modified_base (199)..(199): a, c, t, g, unknown or other
  misc_feature (199)..(199): n is a, c, g, or t
  modified_base (249)..(249): a, c, t, g, unknown or other
  misc_feature (249)..(249): n is a, c, g, or t
  modified_base (254)..(254): a, c, t, g, unknown or other
  misc_feature (254)..(254): n is a, c, g, or t
  modified_base (256)..(256): a, c, t, g, unknown or other
  misc_feature (256)..(256): n is a, c, g, or t
  modified_base (261)..(261): a, c, t, g, unknown or other
  misc_feature (261)..(261): n is a, c, g, or t
  modified_base (302)..(302): a, c, t, g, unknown or other
  misc_feature (302)..(302): n is a, c, g, or t
  modified_base (384)..(384): a, c, t, g, unknown or other
  misc_feature (384)..(384): n is a, c, g, or t
  modified_base (468)..(468): a, c, t, g, unknown or other
  misc_feature (468)..(468): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctcgggacccccggnagagggtcaccatctcttgtctggagcaactcacatcgaatatatgtatntgatnanacacncgagacgtccgaccccaactccacactaccagaagaaatancgaggccgcctggaccgggtccacgactacttcctcgtcgacctacgagtcgtcgccacctcacgtcccctccgacgacccngtacgcggttcggaccgttcccggaggaagtcgtggacgtctagactttagtacgtgtacactagaccggacggtacactaagnggtaggacagtaacagttcgagggcgtttcggggtggtaccggtacgggacgggaacggaacctaacgtcggtaacccgtcggtacgcaaccgaccgcg

SEQ ID NO: 310805 - DNA, 614 bp, Homo sapiens
  misc_feature: GZ8MTXP02JFYNX.21.22.B11.1.454.CMB.2.raw
  modified_base (199)..(199): a, c, t, g, unknown or other
  misc_feature (199)..(199): n is a, c, g, or t
  modified_base (236)..(236): a, c, t, g, unknown or other
  misc_feature (236)..(236): n is a, c, g, or t
  modified_base (497)..(497): a, c, t, g, unknown or other
  misc_feature (497)..(497): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctcgggacccccggnagagggtcaccatctcttgttctggagcaactccaanatcggaataattatgtattctggtatcagcaactcccaggaatcggacccccaaatcctacatccaagaaggaataatcagccggccctcgacggggtcccctaggaccgtattcctctggccttaccaagttctggccaccctcgacgccctccctagaccctatccgaggttcggggaccttcccggggtccgaaggactcggacggcctaggaacctttattacgtggtcgctaagtccgaacggggaccacaaacgngtggggataggaactaagtccgtaggacggtcggggtttggggtacggttcgggacgggtaacggggaaccctaaaggtcgggaacccgttcgtaagggtcaaccggcccgaaaggg

SEQ ID NO: 310806 - DNA, 558 bp, Homo sapiens
  misc_feature: GZ8MTXP02GKS1O.21.22.B11.1.454.CMB.2.raw
  modified_base (456)..(456): a, c, t, g, unknown or other
  misc_feature (456)..(456): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctgggacccccggcagagggtcaccatctcttgttctggaggcaactccaacatcggaagtaattatgtattctggtatcagcaactcccaggaatcggacccccaaatcctcatccagagaataatcagccggccctcgacggggtccctgaccgtacttcctctggcctccaagttctggccacctcacgccctccctgacccatcaggtcggcctccgggtccgaggatggacggctagacttattactgtcgacatccgacggaccgnaaacgagtcgggatggaacaatcgtaggaggtcgggttgggtcggttcgggacgggaacggaccaaacgtcggacccgttacgaggtcacggccctaaacgg

SEQ ID NO: 310807 - DNA, 646 bp, Homo sapiens
  misc_feature: GZ8MTXP02GLC2E.21.22.B11.1.454.CMB.2.raw
  modified_base (200)..(200): a, c, t, g, unknown or other
  misc_feature (200)..(200): n is a, c, g, or t
  modified_base (238)..(238): a, c, t, g, unknown or other
  misc_feature (238)..(238): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagcccaccctcagcgtctcgggacccccggnaggagggtcaccatctcttgttctggagcaactccaanatcggaataattatgtattctggtatcagcaactcccgaaggaactcggacccccaaactcctacactccaagaaggaataactcgacgccggccctcgacggggtcccagaccgtacttctcgtgcctacaagtcgtggccacctcacgtccctccgtacgacccatccgaggttcggggcccttacccggggtaccgaagggtactcggggaacgggtcctacggtaaacctttagtttaaccgttgggtacgtacctacgttacccgggaacgggggaacctacgaaacgtaggtacgggatacggaaactaagtcgtaggaggttcggggtttagggtcggttccggggacggaaggtacccaaacgtcggtaaccgtcgtaggaccgaacgtacccggaacgg

SEQ ID NO: 310808 - DNA, 557 bp, Homo sapiens
  misc_feature: GZ8MTXP02HUNE5.21.22.B11.1.454.CMB.2.raw
  modified_base (198)..(198): a, c, t, g, unknown or other
  misc_feature (198)..(198): n is a, c, g, or t
  modified_base (291)..(291): a, c, t, g, unknown or other
  misc_feature (291)..(291): n is a, c, g, or t
  modified_base (306)..(306): a, c, t, g, unknown or other
  misc_feature (306)..(306): n is a, c, g, or t
  modified_base (329)..(329): a, c, t, g, unknown or other
  misc_feature (329)..(329): n is a, c, g, or t
  modified_base (427)..(427): a, c, t, g, unknown or other
  misc_feature (427)..(427): n is a, c, g, or t
  modified_base (432)..(432): a, c, t, g, unknown or other
  misc_feature (432)..(432): n is a, c, g, or t
  modified_base (451)..(451): a, c, t, g, unknown or other
  misc_feature (451)..(451): n is a, c, g, or t
  modified_base (458)..(458): a, c, t, g, unknown or other
  misc_feature (458)..(458): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctcgggaccccggnagagggtcacatctcttgtctggagcaactccaacatcggaagtaattatgtattctggtatcagcaactcccaggaatcgaccccaaatccncatccagagaataancagcggccctcgacggggtcccngaccgtattcctctggcctacaacgtctcggacacctcacgccctccagaccatcaggtcggctccggtaccgaggctgacggctagaccttaattcngtcgnagtcggaacgggcacaacngtcgganagacaagtcgtaaggcggtcggtttaggggtcgtacggggacggtaacggtaaaccaaacgttcggaacccgtttcgaaggtaccacggtacccgacgg

SEQ ID NO: 310809 - DNA, 544 bp, Homo sapiens
  misc_feature: GZ8MTXP02GLH6F.21.22.B11.1.454.CMB.2.raw
  modified_base (259)..(259): a, c, t, g, unknown or other
  misc_feature (259)..(259): n is a, c, g, or t
  modified_base (297)..(297): a, c, t, g, unknown or other
  misc_feature (297)..(297): n is a, c, g, or t
  modified_base (311)..(311): a, c, t, g, unknown or other
  misc_feature (311)..(311): n is a, c, g, or t
  modified_base (341)..(341): a, c, t, g, unknown or other
  misc_feature (341)..(341): n is a, c, g, or t
  modified_base (446)..(446): a, c, t, g, unknown or other
  misc_feature (446)..(446): n is a, c, g, or t
  modified_base (452)..(452): a, c, t, g, unknown or other
  misc_feature (452)..(452): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctgggacccccggcaggagggtcaccatctcttgttctggagcaactccaacatcggaaagtaattatgtattcnggtatcagcaactcccaggaatcggacccccaaatccncatccagagaatancagcgcctcgacggggtcctgaccgattcnctggctcaagtctggccacctcacgccctcctcgaccatccgagtcgggcctccgggtcccgaggctggacggctagaccttattacctgtgcatcgacgggacncaaacngtcgggatgaacgatcgtaggaggcggggttgggtggttccgggacggaaggggacccaaagtcggaaccgtccgaggtcacgacccgaagg

SEQ ID NO: 310810 - DNA, 524 bp, Homo sapiens
  misc_feature: GZ8MTXP02JZ2HJ.21.22.B11.1.454.CMB.2.raw
  modified_base (295)..(295): a, c, t, g, unknown or other
  misc_feature (295)..(295): n is a, c, g, or t
  modified_base (329)..(329): a, c, t, g, unknown or other
  misc_feature (329)..(329): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctcgggacccccggcagagggtcaccatctcttgttctggaggcaactccaacatcggaagtaattatgtattctggtatcagcaactcccaggaatcggaccccaatccncatccagagaatatcagcgcctgacggggtcccngaccgacttctctggcctcaagtctggccacctcacgccctccctagaccatcaggtcgggcctcccggtcgaggctggagtctagacttattcgtgtcgcatcgacgggacacaacgagtgggatgaacatcgtggaggtcgggttgggtgtcgggacggacggacaagcgtacgaccgtctaggcacgtcccg

SEQ ID NO: 310811 - DNA, 796 bp, Homo sapiens
  misc_feature: GZ8MTXP02F49ZD.21.22.B11.1.454.CMB.2.raw
  modified_base (197)..(197): a, c, t, g, unknown or other
  misc_feature (197)..(197): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccacctcagcgtctgggacccccggnagaggtcaccatctcttgtctggagcaactccaacagtacggaaagttaattatgttattcgtaggtatcgagaccaactcccgaaggactaccggaccccctaaactccctacactaccgaaggaacggtaaataactcacggcccggaccccgtacggaccggggttcccctacggaaccgtacttccgtcgtcggtaccttaccgtaaacggttccgtccgggacctaaccccgttaccgaccgtcccccttaccccgtacgaaaccctacgtccgtaacgggtccggggtacccggttaccccgggtacccgggtaaagggtacgttacgggtaacggttaccctttaaaccgttaacgtttaccgttcggttacgtaccgtaacgttacccgggaaaccggggaccgaaaccgaaacgtaaggtacggggaatacggaaacgtaaacgttcggtacgggtaccgggttacggggtttacgggggttacgggtttaccgggggaaccggggtaaccggggaaaacccttaaaacggtccggtaaaccccggttaccgttacgggtacccgaaccggaccccggtaacgggtcccg

SEQ ID NO: 310812 - DNA, 689 bp, Homo sapiens
  misc_feature: GZ8MTXP02FLZ99.21.22.B11.1.454.CMB.2.raw
  modified_base (243)..(243): a, c, t, g, unknown or other
  misc_feature (243)..(243): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagcccaccctcagcgtcgtcgggacccccggcaggagggtccaccatccttcttgttctggagacaactccaanagtcggaaattaattatgttattctggtatcagacaacctccgaaggaactccggacccccaaactcctacactaccgagaaggaaataatcaggcccggtaccctcggaaccggggtccctacggaccgtactttccgtcgtcggtccttaccgaaagttccgttcgggaccctaccccgttacgaaccgtcccccttaccccgtacgaaacccctagttaccgtaacggggttcggggtcccgttacccggggttacccggtaaggacttggggaacggtcgtacgtaactttacgttacgtgtcgacacgtacggaacggggacacgaaacgtaggtaggatacgaacaagtcgtaggaggtcgggttagggtcgtcggggaacggacgggaaacctaaacggtcggtaaacccgtcgtaacggccaacggacccgtaacggg

SEQ ID NO: 310813 - DNA, 620 bp, Homo sapiens
  misc_feature: GZ8MTXP02JNE9G.21.22.B11.1.454.CMB.2.raw
  modified_base (336)..(336): a, c, t, g, unknown or other
  misc_feature (336)..(336): n is a, c, g, or t
  modified_base (341)..(341): a, c, t, g, unknown or other
  misc_feature (341)..(341): n is a, c, g, or t
  modified_base (345)..(345): a, c, t, g, unknown or other
  misc_feature (345)..(345): n is a, c, g, or t
  modified_base (347)..(347): a, c, t, g, unknown or other
  misc_feature (347)..(347): n is a, c, g, or t
  modified_base (369)..(369): a, c, t, g, unknown or other
  misc_feature (369)..(369): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctcgggacccccgggcaggacgggtcaccatctcttgtctggagcaactcaacatcggaagtattatgtattctggtatcagcaactcccaaggaactcggacccccaaatcctcactccaagaggaataatcagccgcctgacggggtccngaccnttcncngctcagtctgccactcacgccncctgacccatccgagttcgggcctccgggtccgaggtactggaacggtctacgactttacgtttactggtacgtactacgttaccgaaccgggggaaccagaaaccgtaggttcggggaattaggaaccttaaagttccgtagggagggttccggggtttggggtaggttccggggaaccgggtacggggaaaccctaaaacggtgggaacccccgttaccggtaaggtcccaacggacccgtaaacgggg

SEQ ID NO: 310814 - DNA, 652 bp, Homo sapiens
  misc_feature: GZ8MTXP02JIQQ8.21.22.B11.1.454.CMB.2.raw
  modified_base (199)..(199): a, c, t, g, unknown or other
  misc_feature (199)..(199): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctcgggacccccggnagagggtcaccatctcttgttctggagcaactccaacatcggaataattatgtattctggtatcagcaactcccaggaactcggacccccaaatcctcatccagagaataatcagccgcctcgacggggtccctgaccgtattcctcgtcggcctccgaagttctggccaacccttcacgtccctcccgtacgacccatccgaggttcgggccctcccggtaccgaggtacgtggaacgggcttacgtaacttagttacgtgttacgcaaacgttccggaaaccggggacacgaaaacctaggtaggggtaactaggaacctaaaagttcgtagggacgggttcggggtttgggggttacggttaccggggacggggtaaccggaaaccgtaaaacgtcggtaaacccccggttccgtaaaggggtcccaaccggtaccccgtaaacccgggg

SEQ ID NO: 310815 - DNA, 612 bp, Homo sapiens
  misc_feature: GZ8MTXP02G4KBO.21.22.B11.1.454.CMB.2.raw
  modified_base (200)..(200): a, c, t, g, unknown or other
  misc_feature (200)..(200): n is a, c, g, or t
  modified_base (236)..(236): a, c, t, g, unknown or other
  misc_feature (236)..(236): n is a, c, g, or t
  modified_base (487)..(487): a, c, t, g, unknown or other
  misc_feature (487)..(487): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtcgtcgggacccccggnagagggtcaccatctcttgtctggagcaactccaanatcggaagtaattatgtattctggtatcagcaactcccaggaatcggacccccaaatcctacactccaagagaataatcagccgcctcgacgggtccctgaccgattctcgtgcctcgaagtctcggccaccctcgaccgccctacccgtgacccatccgaggtcgggacctcccgggtccgaggtagtcggaacggtctaggtaccttaattaccgtgttcgactaacgtccgaacggggacacgaaacnggtagatgaacaattcgacgtagggtcgggttaggggtacgttccgggggaacgggtacgggtaacccgaaaaggttcggtaccccggttacgttacgggacctaaccggacccgtaaaccgggg

SEQ ID NO: 310816 - DNA, 617 bp, Homo sapiens
  misc_feature: GZ8MTXP02IY6XV.21.22.B11.1.454.CMB.2.raw
  modified_base (295)..(295): a, c, t, g, unknown or other
  misc_feature (295)..(295): n is a, c, g, or t
  modified_base (309)..(309): a, c, t, g, unknown or other
  misc_feature (309)..(309): n is a, c, g, or t
  modified_base (339)..(339): a, c, t, g, unknown or other
  misc_feature (339)..(339): n is a, c, g, or t
  modified_base (490)..(490): a, c, t, g, unknown or other
  misc_feature (490)..(490): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctgggacccccggcagagggtcaccatctcttgttctggagcaactccaacatcggaagtaattatgtattctggtatcagcaactcccaggaatcggacccccaaatccncatccagagaatancagcggcctgaggggtccctgaccgattcnctggctcaagtctggccacctcacgcccctccctgaacccatcgacggtcggggccttcccgggtacgagggtactcgggacgggtccttaggacctttaagttaccgtggttacgtccaagttcccggaaaccgggggaccacaaaacgnggtaggggattacgaaacgaaatttcgaggaacgggtcggggttttagggcggtttccggggacggggacggggtaacccaaacggtcggaaaccggttcccgtaagggccacggtaccccaacggg

SEQ ID NO: 310817 - DNA, 561 bp, Homo sapiens
  misc_feature: GZ8MTXP02FWYGT.21.22.B11.1.454.CMB.2.raw
  modified_base (424)..(424): a, c, t, g, unknown or other
  misc_feature (424)..(424): n is a, c, g, or t
  modified_base (444)..(444): a, c, t, g, unknown or other
  misc_feature (444)..(444): n is a, c, g, or t
  modified_base (450)..(450): a, c, t, g, unknown or other
  misc_feature (450)..(450): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctgggacccccggcagagggtcaccatctcttgttctggagcaactccaacatcggaagtaattatgtattctggtatcagcaactcccaggaatcggaccccaatcctcatccagaggaatatcagccggcctcgacggggtccctgaccgattcctctggctccaagtctggcacctcacgccctcctgaccatcaggtcgggcctccgggtcgaggactgacggctgacttattacngtcgcatcgaacggggaccncaaacngtcgggatcgaacaagtctaggagtcggggttgggtcggttcggggaacgggacggggaaaccctaaacgtcggtaacccgtcccgtaaggtccaacggccctaaacgggg

SEQ ID NO: 310818 - DNA, 535 bp, Homo sapiens
  misc_feature: GZ8MTXP02GXN1J.21.22.B11.1.454.CMB.2.raw
  modified_base (342)..(342): a, c, t, g, unknown or other
  misc_feature (342)..(342): n is a, c, g, or t
  modified_base (440)..(440): a, c, t, g, unknown or other
  misc_feature (440)..(440): n is a, c, g, or t
  modified_base (445)..(445): a, c, t, g, unknown or other
  misc_feature (445)..(445): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctcgggacccccggcagagggtcaccatctcttgttctggagcaactccaacatcggaagtaattatgtattctggtatcagcaactccaggaatcggcccccaaatcctcatccagagaataatcagccggccctcgaggggtccctgaccgattcnctggctccaagtctggccacctcacgtccctccctgacccatcagtcgggctccgggtcgagctgacggctgacttatactgtgctatcgacgggacncaacngtgggatgaactaagtcgtagagtcgggttgggtcgttcgggacggtaggaccaaagtcgaaccgtccgtaggtccacggtaccgaacgg

SEQ ID NO: 310819 - DNA, 607 bp, Homo sapiens
  misc_feature: GZ8MTXP02I6Y7U.21.22.B11.1.454.CMB.2.raw
  modified_base (475)..(475): a, c, t, g, unknown or other
  misc_feature (475)..(475): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctcgggacccccggcaggagggtcaccatctcttgttctggagcaactccaacatcggaagtaattatgtattctggtatcagcaactccagaatcgaccccaaatcctcatccagagaataatcagcggccctcgacggggtccctagaccgtattcctcgtggtcctacgaacgttcgtcggcctacctcaccgtccctccctagacccatcgaggtcgggcctcccggtccgaggactggacggctagtacttaaattcgtgttcgctaagttccggaaccggggacnccgaaacgtagtggggtaatagaactaagttcgtaggacggtcggggtttgggtcggtttacggggacggtaacggggaacctaaaacgtcgggtaacccgttcgtaacggggtccaacggacccgtaacgg

SEQ ID NO: 310820 - DNA, 572 bp, Homo sapiens
  misc_feature: GZ8MTXP02I15KG.21.22.B11.1.454.CMB.2.raw
  modified_base (198)..(198): a, c, t, g, unknown or other
  misc_feature (198)..(198): n is a, c, g, or t
  modified_base (314)..(314): a, c, t, g, unknown or other
  misc_feature (314)..(314): n is a, c, g, or t
  modified_base (449)..(449): a, c, t, g, unknown or other
  misc_feature (449)..(449): n is a, c, g, or t
  modified_base (456)..(456): a, c, t, g, unknown or other
  misc_feature (456)..(456): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctcgggaccccggnagagggtcaccatctcttgttctggaggcaactccaaacatcggaagtaattatgtattctggtatcagcaactcccaaggaatcggacccccaaatcctcactccagagaataancagcggccctcgacggggtccctgaccgattcctctcggctccaagtctggccacctcagccctccctgaccatcgaggtcgggctccgggtcgaggctgacggctgacttattacgtgtgcatcgacgggaccncgaaacngtggggactaggaacaacgttcgaggaggtcggggtttggggtcggttaccggggacgggaacggggaccaaaacgtcggaccccgtacgtaacggggccaacggaccccgaaggg

SEQ ID NO: 310821 - DNA, 779 bp, Homo sapiens
  misc_feature: GZ8MTXP02IEL4I.21.22.B11.1.454.CMB.2.raw
  modified_base (199)..(199): a, c, t, g, unknown or other
  misc_feature (199)..(199): n is a, c, g, or t
  modified_base (236)..(236): a, c, t, g, unknown or other
  misc_feature (236)..(236): n is a, c, g, or t
  modified_base (294)..(294): a, c, t, g, unknown or other
  misc_feature (294)..(294): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctgggacccccgggnagagggtcaccatctcttgttctggagcaactccaanatcggaaatattatgtattctgtatcagcaactccagaactcggacccccaaactccncatccagagaataatcacgcggccctcgacggggtccctcgaccgtacttcctcgtcggtcctaccgaaacgttcctcggggacctacccgttaccgaccgtcccccttacccgtacgaacccctaacgttccgaacgggttccgggggtcccgttcccgggggttacccggaagggggtacgttacggggaacgggtccgttacgggtaaacctttaaacgtttaacccggttggtttacggtacctaaacggtttacccgggaaacccgggggtaaccggtaacccaaaaccgtacgggttaacgggggaaattacgggaaactaaaacgttccggttaggggtaacgggttcgggggtttagggggttcgggtttaccgggggaaccgggggtaaacgggaaaccccgtaaaaacggttcccggtaaaaccccgggtttaccggtaacgggttacccgaacgggtacccccgtaaaccgggg

SEQ ID NO: 310822 - DNA, 600 bp, Homo sapiens
  misc_feature: GZ8MTXP02HFDCA.21.22.B11.1.454.CMB.2.raw
  modified_base (199)..(199): a, c, t, g, unknown or other
  misc_feature (199)..(199): n is a, c, g, or t
  modified_base (237)..(237): a, c, t, g, unknown or other
  misc_feature (237)..(237): n is a, c, g, or t
  modified_base (337)..(337): a, c, t, g, unknown or other
  misc_feature (337)..(337): n is a, c, g, or t
  modified_base (341)..(341): a, c, t, g, unknown or other
  misc_feature (341)..(341): n is a, c, g, or t
  modified_base (462)..(462): a, c, t, g, unknown or other
  misc_feature (462)..(462): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagtcaccctcagcgtctcgggacccccggnaggagggtcaccatctcttgttctggagcaactccaanatcggaagtaattatgtattctggtatcagcaactcccgaggactcgacccccaatcctacatccagagaataatcacgcgcctcgacgggtccagaccnttcncgtcgctacagtctcggctacctcacgtccctcccgtgacccatcgaggttcgggccttacccgggtcgaggactggacgtctagacttagtaccgtgcgacactacgacgggacacaagngtagggatacggaactaagttcgaggtagggttcgggttggggtacggttaccggggaccggggtaacggaaacccgaaacgttcgggtaaaaccccgttcggtaacggtacccgaaccgggttacccgaaaccgggg

SEQ ID NO: 310823 - DNA, 559 bp, Homo sapiens
  misc_feature: GZ8MTXP02FPRYK.21.22.B11.1.454.CMB.2.raw
  modified_base (198)..(198): a, c, t, g, unknown or other
  misc_feature (198)..(198): n is a, c, g, or t
  modified_base (368)..(368): a, c, t, g, unknown or other
  misc_feature (368)..(368): n is a, c, g, or t
  modified_base (405)..(405): a, c, t, g, unknown or other
  misc_feature (405)..(405): n is a, c, g, or t
  modified_base (422)..(422): a, c, t, g, unknown or other
  misc_feature (422)..(422): n is a, c, g, or t
  modified_base (438)..(438): a, c, t, g, unknown or other
  misc_feature (438)..(438): n is a, c, g, or t
  modified_base (444)..(444): a, c, t, g, unknown or other
  misc_feature (444)..(444): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctgggacccccggnagagggtcaccatctcttgttctggaggcaactccaacatcggaataattatgtattctggtatcagcaactcccaggaatcggacccccaaatcctcatccagaggaataatcagcggccctgacggggtccctgaccgattcctctggcctccaagtctggccacctnacgccctcctgacccatcagtcgggctccggtcaggntgagctgacttattacngtgcatcgacgggacnaaacgngtaggatagaactaagtcgtaggaggtcggggtttgggtcggttacgggacgggaacgggaaaccctaaacgtcggaacccggttaccgtacggtaccgaaccggacccgtaagg

SEQ ID NO: 310824 - DNA, 641 bp, Homo sapiens
  misc_feature: GZ8MTXP02IZWO0.21.22.B11.1.454.CMB.2.raw
  modified_base (199)..(199): a, c, t, g, unknown or other
  misc_feature (199)..(199): n is a, c, g, or t
  modified_base (235)..(235): a, c, t, g, unknown or other
  misc_feature (235)..(235): n is a, c, g, or t
  modified_base (302)..(302): a, c, t, g, unknown or other
  misc_feature (302)..(302): n is a, c, g, or t
  modified_base (325)..(325): a, c, t, g, unknown or other
  misc_feature (325)..(325): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctcgggacccccggnaggagggtcaccatctcttgtctggagcactccaanatcggaatatatgtattctgtatcagcaactccaggatcgaccccaactcctcatccagagaataancagccggcctcgacggggtcccngaccgtattcctcgtcggacctccgaagttccgtacgggcctacccgtcaccgtcccctcccgtagacccaattccgaacggtcgggcccgttcccggggtaccgaagggtagtcgggaacgggtcctacggtaacttacgtttaccgttgtcggactacgtccggaacggggaaccaccgaataggtcggggatacggaaacctaagtccgttaggacgggtcggggtttacggggtcggttaccggggacggtaacggggaaaccctaaggtcggtaacccggtccggttaacgccgaccggtacccgaacggg

SEQ ID NO: 310825 - DNA, 746 bp, Homo sapiens
  misc_feature: GZ8MTXP02G8IUO.21.22.B11.1.454.CMB.2.raw
  modified_base (307)..(307): a, c, t, g, unknown or other
  misc_feature (307)..(307): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccatcctcagcgtctcgggacccccggcagagggtcaccatctcttgttctggagcaactccaacatacggaataattatgtattctgtatcagcactccaggaatcgacccccaatcctcatccaagagaataancagccggcctcgacggggtccctgaccccgtattcctcgtcggacctaccgaaggttcctcgggacctaaccccgtccgacgtcccccgtccctacgaacccacttaccgacgggtcggggtcccttcccgggggacccggagggtaacgttcgggaacgggtccttacgggtaaacctttagttttaaccggtcggtttacgaccgtacgttacccgggaaaccgggggaccgtaaccaaaaccggtaggtacggggtaaagttacggaaaaccttaaagttccggtttaggggaacgggtttcgggggtttcgggggtaacggttttacccggggggaaccgggaaacgggggttaaaccccgtaaaacgggtttacccggggtaaccccggtttaccccggttaacggggttaccccggaacggtaaccccccggg

SEQ ID NO: 310826 - DNA, 529 bp, Homo sapiens
  misc_feature: GZ8MTXP02GJQ3C.21.22.B11.1.454.CMB.2.raw
  modified_base (198)..(198): a, c, t, g, unknown or other
  misc_feature (198)..(198): n is a, c, g, or t
  modified_base (327)..(327): a, c, t, g, unknown or other
  misc_feature (327)..(327): n is a, c, g, or t
  modified_base (391)..(391): a, c, t, g, unknown or other
  misc_feature (391)..(391): n is a, c, g, or t
  modified_base (408)..(408): a, c, t, g, unknown or other
  misc_feature (408)..(408): n is a, c, g, or t
  modified_base (424)..(424): a, c, t, g, unknown or other
  misc_feature (424)..(424): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctgggacccccggnagagggtcaccatctcttgttctggaggcaactccaacatcggaagtaattatgtattctggtatcagcaactcccaggatcgcccccaaatcctcatccagagaataatcagcgcctgaggggtcccngaccgattctctgctcaagtctggcacctcagccctcctgacccatcagtggctccggtcgagntgaggctgactattacngtgcatcgacgggacncaacagtgggatgaacaatcgtaggaggtcgggtttggggcgttcgggacggacgggaaacccaaaagtcggaacccgttcgtagggtacaccggaccccgaagg

SEQ ID NO: 310827 - DNA, 570 bp, Homo sapiens
  misc_feature: GZ8MTXP02GXUEE.21.22.B11.1.454.CMB.2.raw
  modified_base (198)..(198): a, c, t, g, unknown or other
  misc_feature (198)..(198): n is a, c, g, or t
  modified_base (334)..(334): a, c, t, g, unknown or other
  misc_feature (334)..(334): n is a, c, g, or t
  modified_base (345)..(345): a, c, t, g, unknown or other
  misc_feature (345)..(345): n is a, c, g, or t
  modified_base (458)..(458): a, c, t, g, unknown or other
  misc_feature (458)..(458): n is a, c, g, or t
  modified_base (465)..(465): a, c, t, g, unknown or other
  misc_feature (465)..(465): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctgggacccccggnagagggtcaccatctcttgttctggagcaactccaacatcggaagtaattatgtattctggtatcagcaactcccaggaatcggacccccaaatcctcactccagagaataatcagcggccctcgacggggtcccngaccgattccnctggctccaagtctcggcacctcacgtccctccgtagacccatccaggtcgggcctcccgggtccgaggtactggaacggctcggacttattacgtgtcgcatcgacgggacncgaacgngtcgggatggactaatcgtgaggtcgggttggtacggttcgggacggtacggaaccctaaacgtcggaacccggttccaggggtaccacggtaccccgaaacggg

SEQ ID NO: 310828 - DNA, 624 bp, Homo sapiens
  misc_feature: GZ8MTXP02IOF6D.21.22.B11.1.454.CMB.2.raw
  modified_base (198)..(198): a, c, t, g, unknown or other
  misc_feature (198)..(198): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctcgggaccccggnagagggtcaccatctcttgttctggagcactccacatcggaagtattatgtattctggtatcagcaactcccaggaatcggacccccaactcctcactccagacggaataatcagccggcctcgacggggtccctagaccgactttcctctacggtctaccaagttccgtgggccaacccgttcacgtcccctcctcgaccactcaggtcgggcctcccggtcgaggtactggacggctagacttattacgtgcgtacacttcgaaccggggacgacaaacgtagttacgggggattaggaacaacgttacgtcgggaggggttccgggggtttgggggtcgttaccgggggaacggggacggggtaaaccctaaaacgtccgggtaacccggtccgttagggtaccacgggacccccgtaacggg

SEQ ID NO: 310829 - DNA, 648 bp, Homo sapiens
  misc_feature: GZ8MTXP02IV31Q.21.22.B11.1.454.CMB.2.raw
  modified_base (199)..(199): a, c, t, g, unknown or other
  misc_feature (199)..(199): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctgggaccccccggnagaggtcaccatctcttgtctggagcaactccaacagtacggaaattaattatgttattctgtatcagcaactcccaggaactccgacccccaaactcctacactaccaagaaggaaataactcgacgccggccctacgacggggtccctagaccgtacttccgtcgtcggcctaccgaagttcgtcggaccaccctcgaccgtcccctccctacgaccctatccgacggtcgggccttcccgggacgaggacgtcggacggtcctagtacttaacttcgtgtgtaccagtccgaaccgggacacgaaacgtagtaggatacgaactaattcggtaggacgggttcggggtttaggggttacggtcccggggaacgggtaaccgggtaaacccgtaaacggttcggtaacccgttacccggtaacggtaccgaaccgacccgtaaacgg

SEQ ID NO: 310830 - DNA, 559 bp, Homo sapiens
  misc_feature: GZ8MTXP02JKT77.21.22.B11.1.454.CMB.2.raw
  modified_base (297)..(297): a, c, t, g, unknown or other
  misc_feature (297)..(297): n is a, c, g, or t
  modified_base (481)..(481): a, c, t, g, unknown or other
  misc_feature (481)..(481): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctcgggacccccggcagagggtcaccatctcttgttctggagcaactccaacatcggaataattatgtattctggtatcagcaactcccaggaatcggaccccccaaatcctnactccagaggaataatcagccggccctcgacggggtccctagaccgattctctgcctccaagtctcggccacctcacgcctcctgacccatcagtcgggctcccgggtccgagatggaggctgaacttagttactggttgctagtcgaacggggacacgaacagtggggattgaacaagttcgnggaggtcggggttggggtcgttcgggacgggtagggaaccctaaaggtcgaacccggtctaggccacggacccaacgg

SEQ ID NO: 310831 - DNA, 539 bp, Homo sapiens
  misc_feature: GZ8MTXP02FWJAU.21.22.B11.1.454.CMB.2.raw
  modified_base (198)..(198): a, c, t, g, unknown or other
  misc_feature (198)..(198): n is a, c, g, or t
  modified_base (331)..(331): a, c, t, g, unknown or other
  misc_feature (331)..(331): n is a, c, g, or t
  modified_base (366)..(366): a, c, t, g, unknown or other
  misc_feature (366)..(366): n is a, c, g, or t
  modified_base (409)..(409): a, c, t, g, unknown or other
  misc_feature (409)..(409): n is a, c, g, or t
  modified_base (431)..(431): a, c, t, g, unknown or other
  misc_feature (431)..(431): n is a, c, g, or t
  modified_base (449)..(449): a, c, t, g, unknown or other
  misc_feature (449)..(449): n is a, c, g, or t
  modified_base (456)..(456): a, c, t, g, unknown or other
  misc_feature (456)..(456): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctgggacccccggnagagggtcaccatctcttgttctggagcaactccaacatcggaagtattatgtattctggtatcagcaactcccaggaatcggacccccaaatcctcatccagaggaataatcagccgcctcgacggggtccngaccgattcctctggcctcaagttctggccacctnacgccctcctgacccatcaggtcgggccttcccggtccgaggntggacggtctagacttattacngtcgcatcgacggggacncaaacgngtgggatagactatcgaggagtcgggttgggtcgttcgggacggaggaaccaaacgtgaacccgtcgtaggcacggcccaagg

SEQ ID NO: 310832 - DNA, 624 bp, Homo sapiens
  misc_feature: GZ8MTXP02IIPKP.21.22.B11.1.454.CMB.2.raw
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctcggggaccccggcagagggtcaccattctcttgttctggaggcaactccaacatcggaagtaattatgtattctggtatcagcaactcccaggaactcggacccccaaatccctacatccaagaggaataatcacgccggaccctcgacggggtcccctaggacccgtatttccgtcgtcggcctaccaagttcctgggcctacctcacgcccctctacgacccatcgaggttcggctccggtcgaggactgaggctagactagttactgtcgctatcgaacgggtacacaaacgagtacggggaatacggaaactaattccgtaggaacgggttccgggtttagggggtacggttccggggaacgggtaacggaaccccgtaaaaacggttcggaacccgttaccggtaacgtccgaaaccggacccgtaaaccggg

SEQ ID NO: 310833 - DNA, 845 bp, Homo sapiens
  misc_feature: GZ8MTXP02GQOHT.21.22.B11.1.454.CMB.2.raw
  modified_base (199)..(199): a, c, t, g, unknown or other
  misc_feature (199)..(199): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctcgggacccccggnagagggtcaccatctcttgttctggaggcaactccaacatcggaaagttaattatgtattctggtatcagcaactcccaaggaactccggaccccccaaactccctacactacccgaagaaggaaaataactaccgaacggcccggacccccttacggaaccgggggttcccctacggtaacccgtaccgtttcccgtaccgtcgggtaccccttacccgtaaacggttccgttaccggggaccctaaccccgttaccgacccggtccccccttacccccgttacgaaaccccctaaacgttcccgtaaacggggttccgggggtaacccccgtttccccgggggttacccggaaacgggggtaaccgtttggggaaaccggggttccttacggtaaaccgttttaacgttttaacccgtgggtttacgaccgtaaacgttacccgggaaacccgggggaaacccgtacgaaaacggttacggttaaggggactttaacggaaacctaaagttccggtagggtaacgggttcggggtttgggggttacggttaccgggggaacggggtaaccggggaaaacccctaaaaggttcccggtaaacccggttacccgtaaggggtccaaccggtacccgaaacccgggg

SEQ ID NO: 310834 - DNA, 543 bp, Homo sapiens
  misc_feature: GZ8MTXP02IRNDG.21.22.B11.1.454.CMB.2.raw
  modified_base (237)..(237): a, c, t, g, unknown or other
  misc_feature (237)..(237): n is a, c, g, or t
  modified_base (310)..(310): a, c, t, g, unknown or other
  misc_feature (310)..(310): n is a, c, g, or t
  modified_base (352)..(352): a, c, t, g, unknown or other
  misc_feature (352)..(352): n is a, c, g, or t
  modified_base (369)..(369): a, c, t, g, unknown or other
  misc_feature (369)..(369): n is a, c, g, or t
  modified_base (396)..(396): a, c, t, g, unknown or other
  misc_feature (396)..(396): n is a, c, g, or t
  modified_base (432)..(432): a, c, t, g, unknown or other
  misc_feature (432)..(432): n is a, c, g, or t
  modified_base (439)..(439): a, c, t, g, unknown or other
  misc_feature (439)..(439): n is a, c, g, or t
  modified_base (452)..(452): a, c, t, g, unknown or other
  misc_feature (452)..(452): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctgggacccccgggcagagggtcaccatctcttgttctggaggcaactccaanatcggaagtaattatgtattctggtatcagcaactcccaggaatcggcccccaaatcctcatccagagaatancagcgcctcgaggggtcctgaccgtatcctctgctcaagtcnggcacctcacgcctccngacccatcacggtggcctccggtccgngactgagctgactatactgcgtacatcgacgggacncaaacgngtagggatcgaanaacgttcaggaggtcgggtttggggtcgttcggggacggtacggaaccaaacgttcgaacccggttcctaggtccacggtacccgaacggg

SEQ ID NO: 310835 - DNA, 586 bp, Homo sapiens
  misc_feature: GZ8MTXP02GW15W.21.22.B11.1.454.CMB.2.raw
  modified_base (236)..(236): a, c, t, g, unknown or other
  misc_feature (236)..(236): n is a, c, g, or t
  modified_base (306)..(306): a, c, t, g, unknown or other
  misc_feature (306)..(306): n is a, c, g, or t
  modified_base (324)..(324): a, c, t, g, unknown or other
  misc_feature (324)..(324): n is a, c, g, or t
  modified_base (333)..(333): a, c, t, g, unknown or other
  misc_feature (333)..(333): n is a, c, g, or t
  modified_base (431)..(431): a, c, t, g, unknown or other
  misc_feature (431)..(431): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctgggacccccggcagagggtcaccatctcttgttctggagcaactccaacntcggaatattatgtattctggtatcagcaactccaggaatcggaccccaaatcctcatccagagaataancagcgcctcgagggtccngacgattcnctgctcagtctgcaccgtcacgtccctcctagaccatcaggtcgggctcccgggtaccgaggacgtggaacggtcttagaacttagttacctggttcncgacttcgaaccggggtacacgaacgagtacgggatacggaactaaacgttcgtaggtaggtcggggtttcggggtaggttccgggggacggaacggggtaacccaaaacgttcggaacccgttccggtaacggtccaacggacccgtaaccggg

SEQ ID NO: 310836 - DNA, 629 bp, Homo sapiens
  misc_feature: GZ8MTXP02HWU9M.21.22.B11.1.454.CMB.2.raw
  modified_base (259)..(259): a, c, t, g, unknown or other
  misc_feature (259)..(259): n is a, c, g, or t
  modified_base (301)..(301): a, c, t, g, unknown or other
  misc_feature (301)..(301): n is a, c, g, or t
  modified_base (338)..(338): a, c, t, g, unknown or other
  misc_feature (338)..(338): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctcgggacccccgggcaggagggtcaccatctcttgttctggagcaactcaacatcggaagtaattatgtattcngtatcagcaactcccgagaactcggacccccaaatccctcanccaagacgaaataatcagcggccctgacggggtcccngaccgtattccgtctcggctcccgaagttcgtcggcctaccctcacgtccctccctagacccatcgaggtcgggccgtcccgggtaccgaggtacgtggaaggtcctagtaaccttaagtttccgtggttcgactaacggtaccggacggggaacacgaaaacgtagtaggggactagggaaacctaaagttcgagggtacgggtcgggtttgggggtacgttccgggggacgggaacggaacctaaacggtcggaacccgttcgtaggtacccgaggacccctaacgggg

SEQ ID NO: 310837 - DNA, 660 bp, Homo sapiens
  misc_feature: GZ8MTXP02JLEQN.21.22.B11.1.454.CMB.2.raw
  modified_base (200)..(200): a, c, t, g, unknown or other
  misc_feature (200)..(200): n is a, c, g, or t
  modified_base (296)..(296): a, c, t, g, unknown or other
  misc_feature (296)..(296): n is a, c, g, or t
  modified_base (310)..(310): a, c, t, g, unknown or other
  misc_feature (310)..(310): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagcccaccctcagcgtctcgggacccccggnagagggtcaccatctcttgttctggaggcaactccaacatcggaagttaattatgtattctggtatcagcaactcccagatcggacccccaatccncatccagagaatancagccgcctcgacggggtccctggaccgacttcctctcggcctaccgaagttctcggccacctcacgccctccctgaccatcgaggttcgggacctcccgggtccgaggtactcggaacggtctacggtaacttaaacgttccgtggttacgacccgtagttaccccgggaaccgggggtaaccaccgaaaaccgtagggttaccgggggaattacggaaactaaacgttccggtaggggtaacggggtcccgggggtttggggtacgggttacccgggaacgggggaccggaaacccgtaaggttaccggaccccggtttacgagggtaccaaacggtcccgaaacggg

SEQ ID NO: 310838 - DNA, 768 bp, Homo sapiens
  misc_feature: GZ8MTXP02JHGG1.21.22.B11.1.454.CMB.2.raw
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagcccaccctcagcgtcgtcgggaccccgggcaggacgggtcaccatcttcttgttcgtggacggacaactccaacatacggaaagttaattatgttattcgtaggtatcagcaactcccgaaggaactccgaccccctaaactcctacactaccgaaggtaacggtaaataacgtaccgaacgggtcccggtaccccgttacggtaccggggtcccctacggtaacccgtactttccgtccgtcggtcccttaccgtaacgttccgtcgggtaccctaccgtccgaccgtccccttaccccgtacggaaccctacgttccgacggggttccggggcccgtttacccggggtccggaaaggtacgtcggggaacggtccgttagtaacgttttaaacttcgtggtacgacctacggttaccgggaaccggggaacctacgaaaacgtggtaacggggaacttacggaaactaacgttcggtacgggtagggttccgggggtttaggggttaccgggtaccggggaaccggggaaccggtaaaccctaaacggtccgggtacccgttacgggttacgacccgaaccggacccgtaaccgg

SEQ ID NO: 310839 - DNA, 725 bp, Homo sapiens
  misc_feature: GZ8MTXP02HNNDK.21.22.B11.1.454.CMB.2.raw
  modified_base (199)..(199): a, c, t, g, unknown or other
  misc_feature (199)..(199): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctcgggacccccggnagagggtcaccatctcttgttctggaggcaactcccaacatcggaagtaattatgtattctggtatcagcaactccgaggaactcggacccccaaactcctacactccaagaagaataatcagccggccctcggacggggtcccctacggaccgtactttccgtacgtcggaccttacaacggttctcggggaccctaaccttcgaccgtccccttccccgtacggaaccccagttccgaacgggtttcggggcccttcccggggtaccgagggtacgttcgggaacgggtccttagtaaccttacgtttaccgttggttacgtaccgtaagtcccgggaaccggggacgaacgaaaccgtaagggttgggggaaacttcgggaaaacctaaagttccggttagggacggggtttccggggtttagggggtccggtttaccgggggacggggaaccgggtaaacccgtaaaaccggtcgggtaaccccggtaccggttacggacccgaccggtacccccggaaggg

SEQ ID NO: 310840 - DNA, 555 bp, Homo sapiens
  misc_feature: GZ8MTXP02GP70X.21.22.B11.1.454.CMB.2.raw
  modified_base (199)..(199): a, c, t, g, unknown or other
  misc_feature (199)..(199): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctgggacccccgggnagagggtcaccatctcttgttctggaggcaactccaacatcggaagtaattatgtattctggtatcagcaactcccaggaatcggacccccaaatccctcatcccaagaggaataatcagccggccctcgacggggtcccctgaccgacttctctggctccaagttctgccactcacgcctcctgaccatcagtcggctccggtcgagatgacgctagacttattactgtgcatccgacgggacacacagtgggatacgaacaatcgtaggacggtcggttggggtcgttacggggacgggtacgggaaaccctaaacgtcggaaccgttccgaggtaccacggaccctaaacggg

SEQ ID NO: 310841 - DNA, 610 bp, Homo sapiens
  misc_feature: GZ8MTXP02GV4RG.21.22.B11.1.454.CMB.2.raw
  modified_base (292)..(292): a, c, t, g, unknown or other
  misc_feature (292)..(292): n is a, c, g, or t
  modified_base (305)..(305): a, c, t, g, unknown or other
  misc_feature (305)..(305): n is a, c, g, or t
  modified_base (375)..(375): a, c, t, g, unknown or other
  misc_feature (375)..(375): n is a, c, g, or t
  modified_base (457)..(457): a, c, t, g, unknown or other
  misc_feature (457)..(457): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtcgtcgggacccccgggcaggagggtcaccatctcttgttctggagcaactccaacatcggaataattatgtattctgtatcagcaactccaggatcgaccccaatccnatcagagaataancagccgcctcgacggggtccctgaccgtacttcctcgtggcctcaagttctcggcacctcacgccctccngaccatcgaggtcgggacctccggtaccgagcgtggaggctagaacttattacgtgtgctagtaccgacgggacacaaacgnggtacgggatacggaacaaacgttcgtaaggaggttccgggggtttggggtacggtttaccgggggaacgggttaaccgggaaaaccccgtaaaacggttccgggaacccgtttacccggtaggttacccaaccgggtaccccgtaaaccggg

SEQ ID NO: 310842 - DNA, 666 bp, Homo sapiens
  misc_feature: GZ8MTXP02G8JUJ.21.22.B11.1.454.CMB.2.raw
  modified_base (297)..(297): a, c, t, g, unknown or other
  misc_feature (297)..(297): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagcccaccctcagcgtcgtcggggacccccggcaggagggtcaccatctcttgttctggagcaactccaacatcggaataattatgtattctggtatcagcaactccgaggatcgacccccaaatccncactcagagaatatcagccgcctacgacggggtccctagaccgacttcctcgtcggcctaccgaagttccgtggccctaccgtccacgtcccctaccctcgaaccctatccgtacgggttccgggcccgttacccggggtacccggaaggggtcttacggggacggtaccgttacggaactttaacgtttaccgtggtacgccaacgttcccggaacgggggaccaacgtaacgaggttacggggaattacggaaacagtttacgcgggtaacggtcggggttttacggggtggttccgggggaacggtacggggaaaacccaaacggttccgaacccggttcgaacggtccgaaccggtacccgacgg

SEQ ID NO: 310843 - DNA, 595 bp, Homo sapiens
  misc_feature: GZ8MTXP02GXS83.21.22.B11.1.454.CMB.2.raw
  modified_base (200)..(200): a, c, t, g, unknown or other
  misc_feature (200)..(200): n is a, c, g, or t
  modified_base (294)..(294): a, c, t, g, unknown or other
  misc_feature (294)..(294): n is a, c, g, or t
  modified_base (330)..(330): a, c, t, g, unknown or other
  misc_feature (330)..(330): n is a, c, g, or t
  modified_base (405)..(405): a, c, t, g, unknown or other
  misc_feature (405)..(405): n is a, c, g, or t
  modified_base (430)..(430): a, c, t, g, unknown or other
  misc_feature (430)..(430): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtcgtcgggacccccggnagagggtcaccatctcttgttctggagcaactccaacagtacggaagtaattatgtattctggtatcagcaactccagatcgaccccaatcctnatccagagaatatcagccggcctcgacggggtcccngaccgtacttctctggcctacagtctcggcacctcacgtcctccctgacccatcgaggtcgctcgatccgaggtntggagtctagtacttattactggtnactacgtcgacgggacacgaagagtggggataggaacctaagtccggttaggggtacgggttcgggggtttacggggtcgggtaccggggaaccggggtaaacgggtaaacccgtaaacggttaccggtacccggttacggtaacggtacccgaccggtaacccg

SEQ ID NO: 310844 - DNA, 576 bp, Homo sapiens
  misc_feature: GZ8MTXP02H5WGD.21.22.B11.1.454.CMB.2.raw
  modified_base (199)..(199): a, c, t, g, unknown or other
  misc_feature (199)..(199): n is a, c, g, or t
  modified_base (236)..(236): a, c, t, g, unknown or other
  misc_feature (236)..(236): n is a, c, g, or t
  modified_base (345)..(345): a, c, t, g, unknown or other
  misc_feature (345)..(345): n is a, c, g, or t
  modified_base (376)..(376): a, c, t, g, unknown or other
  misc_feature (376)..(376): n is a, c, g, or t
  modified_base (407)..(407): a, c, t, g, unknown or other
  misc_feature (407)..(407): n is a, c, g, or t
  modified_base (478)..(478): a, c, t, g, unknown or other
  misc_feature (478)..(478): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctcgggacccccggnagaggttcaccatctcttgttctggagcaactccaanatcggaataattatgtattctggtatcagcaactcccaggactcggacccccaaatccctcactccagagaataatcagccgcctcgacgggtccctgaccgtacttcncgtgctcaagtctgccacctcacgccctccngacccatcgaggtcggcctccggtcgaggtntgacggctgactagttactgtgtactacgtacgaccgggacacgaacgtgtagggatagaactaacgtcgnggtaggtcggggtttggggtcggttcggggacgggtaacgggaaccctaaacggtccggaacccgttacggacggtaccgaccggtacccgaaccggg

SEQ ID NO: 310845 - DNA, 561 bp, Homo sapiens
  misc_feature: GZ8MTXP02GKWWU.21.22.B11.1.454.CMB.2.raw
  modified_base (198)..(198): a, c, t, g, unknown or other
  misc_feature (198)..(198): n is a, c, g, or t
  modified_base (472)..(472): a, c, t, g, unknown or other
  misc_feature (472)..(472): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctgggacccccggnagagggtcaccatctcttgttctggagcaactccaacatcggaatatatgtattctggtatcagcaactcccaggaatcggacccccaaatcctcactccagaggaataatcagtccggccctcgacggggtcccctagaccgattcctctggcctaccaagttcctgggaccacctcacgtccctccctgacccatcaggtcggcctcccgggtccgagggctggacgggctacggacttagttacctgtcgacatccgacgggaccgcaacngtacgggatcgaacaatcgtaggagtcgggttggggtcgttacggggcgggagggaccaaggcgtagacccgtcgtacggtcacgaccg

SEQ ID NO: 310846 - DNA, 548 bp, Homo sapiens
  misc_feature: GZ8MTXP02I407D.21.22.B11.1.454.CMB.2.raw
  modified_base (295)..(295): a, c, t, g, unknown or other
  misc_feature (295)..(295): n is a, c, g, or t
  modified_base (389)..(389): a, c, t, g, unknown or other
  misc_feature (389)..(389): n is a, c, g, or t
  modified_base (404)..(404): a, c, t, g, unknown or other
  misc_feature (404)..(404): n is a, c, g, or t
tcagtcgtcgctcgcacgaccggtgctcgatttagacgacagctcagggtggggtcaaaaacccggggagggggtctgatttgcatggatggactctccccctctcagagtacgaagagagggagagatctgggggaagctcagcttcagctgtggtagagaagacaggactcaggacaatctccagcatggccggcttccctctcctcctcaccctcctcactcactgcgcagggtcctgggcccagtctgtgctgactcacgcccaccctcagcgtcgtcggggacccccggnaggacggtcaccatctcttgtctggagcaactccaacatcggaataattatgtattctagtatcagcactcccaggaactcgacccccaatccncatccagagaataancagccgcctcgacgggtccctgacctattctcgtgcctacaagtcctggccacctcacgtccctccgtacgacctagtccgcggtcggggccttcccgggaccgaggactggacggtcctaggtaccttacgttacgtgttacg

SEQ ID NO: 310847 - DNA, 723 bp, Homo sapiens
  misc_feature: GZ8MTXP02GD1V1.21.22.B11.1.454.CMB.2.raw
  modified_base (201)..(201): a, c, t, g, unknown or other
  misc_feature (201)..(201): n is a, c, g, or t
  modified_base (301)..(301): a, c, t, g, unknown or other
  misc_feature (301)..(301): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctcggggacccccgggnaggagggtcaccatctcttgttctggaggcaactccaacatacggaagtaattatgtattctggtatcagcaactcccaagaactcggaccccaaatccncactccaagagaataatcgacgcggccctcgacggggtccctaggaccgtatttcctcgtcggcctaccgtaagttccgtcgggccctacccgttaccaccggtcccccttaccccgtacggaaacccctaagttcccgtaacgggttcgggggtaccccgttccccgggggttacccgggaaaggggtacgttacgggaacgggttctacgggtaaactttaaacgtttaccgtgtacggtacaacgttaccgggaaccggggtaaccacgaaaacgtggttacggggaattaggaaactaaacgtcgttagggaacggttcgggggtttagggtcggtttaccgggggaacgggtaacgggaaaaccgtaaacgtcggtaacccggttaccggtaaggtaccgaacggtacccggaacgg

SEQ ID NO: 310848 - DNA, 702 bp, Homo sapiens
  misc_feature: GZ8MTXP02GNL2M.21.22.B11.1.454.CMB.2.raw
  modified_base (199)..(199): a, c, t, g, unknown or other
  misc_feature (199)..(199): n is a, c, g, or t
  modified_base (236)..(236): a, c, t, g, unknown or other
  misc_feature (236)..(236): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctgggaccccccggnagagggtcaccatctcttgtctggagcaactccaacntcggaataattatgtattctggtatcagcaactcccaggaatcggacccccaaatccacactccaagaggaataatcacgcggccctcgacggggtccctggaccgtattctcgtcggcttacccgaaagttcgtcgggcctaacccctcgaccgtcccccttaccccgtacgaaccctacgttccgaaggggttccggggaccctttccccgggggtaaccggacgggaacgttcggggaacggggaccttacggaaacctttagtttaaccgtggttccggactacgtaccggaaccgggggaaccctacggaaacctaagggtaggggaattacgggaaaaccgtaattccgtacgggagggttccggggtttaggggtacggttccggggaacggggaacggttaaacccgaaaacgttcggaacccgttcggtaaacggtccaacgggcccccgtaaaggg

SEQ ID NO: 310849 - DNA, 547 bp, Homo sapiens
  misc_feature: GZ8MTXP02HY3KH.21.22.B11.1.454.CMB.2.raw
  modified_base (202)..(202): a, c, t, g, unknown or other
  misc_feature (202)..(202): n is a, c, g, or t
  modified_base (240)..(240): a, c, t, g, unknown or other
  misc_feature (240)..(240): n is a, c, g, or t
  modified_base (336)..(336): a, c, t, g, unknown or other
  misc_feature (336)..(336): n is a, c, g, or t
  modified_base (345)..(345): a, c, t, g, unknown or other
  misc_feature (345)..(345): n is a, c, g, or t
  modified_base (421)..(421): a, c, t, g, unknown or other
  misc_feature (421)..(421): n is a, c, g, or t
  modified_base (425)..(426): a, c, t, g, unknown or other
  misc_feature (425)..(426): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtcgtcgggaccccccgggnaggagggtcaccatctcttgttctggagcaactccaanatcggaataattatgtattctggtatcagcaactccaggaatcggacccccaaatccctacatccaagagaataatcagccggcctgacgggtccngacgattcntgctcagtctggcactcacgccctcctgaccatccaggtcggcctccggcgaggactggaggcctgaactattacnggtnnatacgaccgggaccaaagagtgggaatgaacaaatcgtggacggttcgggttgggtggttccgggacggggacgaaaccgaaacgtcggacccgtacgtacggcacggaccccaaggcccg

SEQ ID NO: 310850 - DNA, 601 bp, Homo sapiens
  misc_feature: GZ8MTXP02GP2GC.21.22.B11.1.454.CMB.2.raw
  modified_base (502)..(502): a, c, t, g, unknown or other
  misc_feature (502)..(502): n is a, c, g, or t
  modified_base (508)..(508): a, c, t, g, unknown or other
  misc_feature (508)..(508): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctgggacccccggcagagggtcaccatctcttgttctggagcaactccaacatcggaagtaattatgtattctggtatcagcaactcccaaggaatcggacccccaaactcctacactcccaagaaggaaattaactcgaagcccggaccctcgaacgggggtcccctaggaacccgtatttccgtacgtcgggcctaccgaaagttctcgggcctaacccttcgacgtcccctcccgtagaccctatccgaggtcggggcctcccggtaccgtaggcttggacggctagacttattactgtcgcatacgacgggacnaaacgngtggatgacaatcgtaggaggtcgggttgggtcgttcgggacggtaacgggaaccaaacgtcgaccgtacgtaggtccacggtacccgaacgg

SEQ ID NO: 310851 - DNA, 826 bp, Homo sapiens
  misc_feature: GZ8MTXP02HLYEJ.21.22.B11.1.454.CMB.2.raw
  modified_base (202)..(202): a, c, t, g, unknown or other
  misc_feature (202)..(202): n is a, c, g, or t
  modified_base (241)..(241): a, c, t, g, unknown or other
  misc_feature (241)..(241): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagcccaccctcagcgtcgtcggggacccccggnaggagggtccaccatctcttgttctggagcaactccaanatcggaataattatgtattctgtatcagcaactcccaggaactcggaccccctaaactcctacactaccaagaaggtaaataacgtccacgggacccggtcccctacggtaaccgggggttcccctacgggtaaccccgtactttcccgtaccgttcgggtacccttacccgtaaacgttccgtccggggtacccctaaaccccttccgtacccggtaccccccctttacccccgacgtaaaccccctacgtttacccggaaccggggtttccgggggacccccgtttaccccgggggttaccccggggaaaggggttacgttccgggggaaacggtccgttacggtaaacttttacgttttaaacccgttgggtcgtaccgtaacgttacccgggaaccgggggaccctaacgaaaacgtagggttacgggaattacggaaactaacgttcggtagggacggggtttaccggggtttggggtacgggttaccggggaacggggaaccggggtaaaccctaaaacgggttccgggtaaaccccgttcccggttaaagggtcccgaccggtaaaccccggtaccgg

SEQ ID NO: 310852 - DNA, 650 bp, Homo sapiens
  misc_feature: GZ8MTXP02JX4NE.21.22.B11.1.454.CMB.2.raw
  modified_base (235)..(235): a, c, t, g, unknown or other
  misc_feature (235)..(235): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtcgtcgggacccccggcagagggtcaccatctcttgtctggagcaactcaanatcgaatattatgtattctgtatcagcactcccagactcgacccccaatcctcatccagagaatatcagcgcctcgacgggtcctgacctactctctggcctacaacgtctcggcctaccgtccgacgtcccctcccgtacgaccctatccgaggttccgggccgttcccgggtacccggaggacttcgggacggtctcggtaactttacgttaccgtggtacgtaccgtagttacccgggaacggggaaccgaccgaaaacgttggtaacgggggtaataccggtaaactaaacgttccgtaaggggtacgggtttcggggtttcgggggtacggttccgggggaccggggtaacgggaaacctaacggtccgtaaccccggtcggtaccggtacacccggacccgtaaccggg

SEQ ID NO: 310853 - DNA, 616 bp, Homo sapiens
  misc_feature: GZ8MTXP02HYT4S.21.22.B11.1.454.CMB.2.raw
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtcgtcgggacccccgggcaggagggtcaccatctcttgttctggagcaactcaacatcggaataattatgtattctggtatcagcaactcccaggaactcggaccccccaaatccctcatccagaagaataatcagccgccctgacggggtccctggaccgtattctcgtggcctaccgaagtctcggccacctcacgtcccctccctagacccatcgaggttcgggcctcccgggtccgaggactggacggcctagtaactagttactggtcgacagtccggacgggacacaaacgtgtaggggtaatacggaaacaagttcgtagggacggtcggggtttgggggtacggttccggggacgggtaacggggaaccctaaaacgtccggaaacccggttcccgtaagggtcccaacggtaccccgaacgggg

SEQ ID NO: 310854 - DNA, 720 bp, Homo sapiens
  misc_feature: GZ8MTXP02FZYUW.21.22.B11.1.454.CMB.2.raw
  modified_base (198)..(198): a, c, t, g, unknown or other
  misc_feature (198)..(198): n is a, c, g, or t
  modified_base (296)..(296): a, c, t, g, unknown or other
  misc_feature (296)..(296): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctgggacccccggnagagggtcaccatctcttgttctggaggcaactccaacatcggaagtaattatgtattctggtatcagcaactcccaggactcggacccccaactccncatccagagaataatcagccgccctcgacggggtccctagaccgtattcctcgtcggctaccgaagtctcggccacctcaccgtccctcccgtacgaccctattcgaggtcggggccttcccggggtaccgaaggacgttacggaacgggtcctagtaacctttaagttaaccgtgtacgacctaacgttaccgggaaaccgggggaccaaccgaaaacgtagggttagggggaacttaggaaaacgttaaacgttccggtaggggtaaacgggttccgggggttttagggggttacgggtttacccggggggaacccgggggaacgggggtaaaaccccctaaaaacgggtttcccggggtaaacccccggttacccggttaaacggggtaacccgaaccgggtaccccccggtaaaacgggg

SEQ ID NO: 310855 - DNA, 582 bp, Homo sapiens
  misc_feature: GZ8MTXP02HLZ4H.21.22.B11.1.454.CMB.2.raw
  modified_base (199)..(199): a, c, t, g, unknown or other
  misc_feature (199)..(199): n is a, c, g, or t
  modified_base (236)..(236): a, c, t, g, unknown or other
  misc_feature (236)..(236): n is a, c, g, or t
  modified_base (347)..(347): a, c, t, g, unknown or other
  misc_feature (347)..(347): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctgggacccccgggnagagggtcaccatctcttgttctggagcaactccaanatcggaagtattatgtatctggtatcagcaactcccaggaatcggacccccaaactcctcactccagaggaataatcagccggccctgacggggtccctgaccgacttccnctggcctcaagtctcggcacctcacgccctcccgtgacccatccgagtcggggcctccgggtaccgaggatcggacggtctaggacttagttactggtcgtacacgtccgaacggggaccacgaaacaggtggggaatcggaaaataacgtctggacggtcgggttggggtacgttcgggcgggtaacggaaccgtaaacgtggacccgttacgtaaggtcaagaccccgaaggg

SEQ ID NO: 310856 - DNA, 597 bp, Homo sapiens
  misc_feature: GZ8MTXP02IQUIV.21.22.B11.1.454.CMB.2.raw
  modified_base (199)..(199): a, c, t, g, unknown or other
  misc_feature (199)..(199): n is a, c, g, or t
  modified_base (451)..(451): a, c, t, g, unknown or other
  misc_feature (451)..(451): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctcgggacccccggnagagggtcaccatctcttgttctggagcaactccaacatcggaagtaattatgtattctggtatcagcaactcccaaggaactcggaccccccaaatccctacactccaagaacggaataactcagccggccctacgacggggtccctgaccgtattctcgtggcctcaagttctcggccacctcacgccctcctgaacccatcaggtcgggcctccggtccgaggtatggacggctagaacttagttacgngtcgctatccggaacgggacacgaacgagtgggaatacggactaaagttcgagggtaggtcgggtttggggtcggttaccggggacgggaacgggaaacctaaacgttcggaacccgttcgtaaagggccaacggtaccccgaagg

SEQ ID NO: 310857 - DNA, 601 bp, Homo sapiens
  misc_feature: GZ8MTXP02J1MYR.21.22.B11.1.454.CMB.2.raw
  modified_base (432)..(432): a, c, t, g, unknown or other
  misc_feature (432)..(432): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctcgggacccccggcagagggtcaccatctcttgttctggaggcaactccaacatcggaagtaattatgtattctggtatcagcaactcccaggaactcggacccccaaactccctcactccagaaggaataatcagccggccctcgacggggtccctggacctattcctcgtggcctcaacgttctcgggctacccgtcacgtccctccctagacccatcgaggtcgggtcctccgggtccgaggtntcggacggtctagtacttagtttactgtcgactataccggacggggacaccgaaagagtgggatagaactaagttcgaggaggtcgggttacggggttcggtccggggacgggtacgggaaaccctaaggttcccggaccgtacggtaggacccacggaccctaacggg

SEQ ID NO: 310858 - DNA, 653 bp, Homo sapiens
  misc_feature: GZ8MTXP02IOYF4.21.22.B11.1.454.CMB.2.raw
  modified_base (197)..(197): a, c, t, g, unknown or other
  misc_feature (197)..(197): n is a, c, g, or t
  modified_base (234)..(234): a, c, t, g, unknown or other
  misc_feature (234)..(234): n is a, c, g, or t
  modified_base (303)..(303): a, c, t, g, unknown or other
  misc_feature (303)..(303): n is a, c, g, or t
  modified_base (528)..(528): a, c, t, g, unknown or other
  misc_feature (528)..(528): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctgggaccccggnagaggtcaccatctcttgttctggaggcaactccaanatacggaagtaattatgtattctggtatcagcaactccagatcgaccccaactctcactcagagataancagcgcctcgacgggtccctgaccgattcctctcggtcctacctaaagttctcgggaccaccctccgaccgtccccttacccctacgaccctatccgacgggttcggggaccctcccgggttaccggaggacttaggacggtcctagacttatttaccgtgcgtctacgtcggaacccggggacactaaacgaggttaggggattaacggaactaactttacggngggtaacggggtccgggggttttaggggtccgggtttaaccggggcccggggaaagggaaacccccgtaaaagttccggggtaacccgttaccgtaaggggtcccaaccggaaccccgtacgggg

SEQ ID NO: 310859 - DNA, 741 bp, Homo sapiens
  misc_feature: GZ8MTXP02F7IXX.21.22.B11.1.454.CMB.2.raw
  modified_base (197)..(197): a, c, t, g, unknown or other
  misc_feature (197)..(197): n is a, c, g, or t
  modified_base (298)..(298): a, c, t, g, unknown or other
  misc_feature (298)..(298): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctgggaccccggnagagggtcaccatctcttgttctggaggcaactccaacatcggaagtaattatgtattctggtatcagcaaactcccaggaactcggacccccaaatcctnactccagaggaaataatcagccggccctacgacggggtccctggacccgtattcctctgggcttcccaagttctgggccaccctcacgtccctcccgtcgacccattcgaacggttcgggccgttccccgggttaccgagggtacttaggaacgggtccttagggaaaccctttaaagtttaacccgtggttaacggcctaaacgtttacccggaaacccgggggtaccgaaccctaaaaccggaggtttaaacgggggatttacgggaaaacctaaaaggttcccgttaggggaaacggttccgggggtttttaggggggttcggttttaacccgggggaccgggggtaaacggggtaaaccccgaaaaaacggtttcccgggaaaccccggtttacccgttaaggggttacccgaaacggggtaccccctaaaaacggggg

SEQ ID NO: 310860 - DNA, 657 bp, Homo sapiens
  misc_feature: GZ8MTXP02FOFOX.21.22.B11.1.454.CMB.2.raw
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctcgggacccccggcagagggtcaccatctcttgttctggagcaactccaacatcggaataattatgtattctggtatcagcaactcccaggaactcggacccccaaactcctcactccagaaggaataatcacgccggccctacgacggggtcccctaggaccgtacttcctctcggccttaccgaagttcctgggccaacccttcgaccgtcccctcccgtacgaccctatccgaaggttcgggcccttcccgggtaccgaggacgtaggacgggtctaggaacctttaagttacgtggtcgactacgtccggaacggggacacgaaacgagttagggactaggaactaaagttcgtaggacgggttcggggtttggggttacggttaccgggacggggaacgggtaaaccctaaaacggttccggaacccggttacccgtaagggtcccgaacggtaccccgtaaacggg

SEQ ID NO: 310861 - DNA, 626 bp, Homo sapiens
  misc_feature: GZ8MTXP02HGXE7.21.22.B11.1.454.CMB.2.raw
  modified_base (261)..(261): a, c, t, g, unknown or other
  misc_feature (261)..(261): n is a, c, g, or t
  modified_base (321)..(321): a, c, t, g, unknown or other
  misc_feature (321)..(321): n is a, c, g, or t
  modified_base (370)..(370): a, c, t, g, unknown or other
  misc_feature (370)..(370): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtcgtcggggacccccggcaggagggtcaccatctcttgttctggaggcaactccaacatcggaataattatgtattcngtatcagcaactccgaaggaatccggacccccaaatcctacactccaagaaggaataacncagccgccctacgacggggtccctgacgtacttctctcggctacagtcncggccacctcacgtccctcctgacccatcacggtcggccgttcccggccgtaggactcggacgggcttacggtaacttaagtttacgtcggtcgaccaagttacccggaacggggtaccaaccgaaacgtaggtcggggactaggaaactaagtcggtaggtacgggttggggtgggttacggttaccgggcggggtaaacggaaccgtaaaacgttcggaacccgttacgtaggtacccaacggtcccgaaacgg

SEQ ID NO: 310862 - DNA, 536 bp, Homo sapiens
  misc_feature: GZ8MTXP02FJ2UR.21.22.B11.1.454.CMB.2.raw
  modified_base (196)..(196): a, c, t, g, unknown or other
  misc_feature (196)..(196): n is a, c, g, or t
  modified_base (429)..(429): a, c, t, g, unknown or other
  misc_feature (429)..(429): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccacctcagcgtctggacccccggnagagggtcaccatctcttgttctggaggcaactccaacatcggaagtaattatgtattctggtatcagcaaactcccaggaatcggcccccaaactcctcatccagaggaataatcagccggccctcgacggggtccctggaccgacttctctggcctccaagttctggccacctcagcctcctgaccatcagtcggctccggtccgaggactggacggctagactattaccngtcgctatcgacgggacgcaacagtgggatgacaatcgtagagtcggttgggtcgttcgggacggagggaacccaaagtcgaaccgtcctaggtacacgccccaagg

SEQ ID NO: 310863 - DNA, 528 bp, Homo sapiens
  misc_feature: GZ8MTXP02IBGR9.21.22.B11.1.454.CMB.2.raw
  modified_base (198)..(198): a, c, t, g, unknown or other
  misc_feature (198)..(198): n is a, c, g, or t
  modified_base (234)..(234): a, c, t, g, unknown or other
  misc_feature (234)..(234): n is a, c, g, or t
  modified_base (376)..(376): a, c, t, g, unknown or other
  misc_feature (376)..(376): n is a, c, g, or t
  modified_base (401)..(401): a, c, t, g, unknown or other
  misc_feature (401)..(401): n is a, c, g, or t
  modified_base (419)..(419): a, c, t, g, unknown or other
  misc_feature (419)..(419): n is a, c, g, or t
  modified_base (435)..(435): a, c, t, g, unknown or other
  misc_feature (435)..(435): n is a, c, g, or t
  modified_base (440)..(440): a, c, t, g, unknown or other
  misc_feature (440)..(440): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctgggacccccggnagagggtcaccatctcttgtctggagcaactccaanatcggaagtattatgtattctggtatcagcaactcccaaggatcggcccccaaatcctcatccagagaataatcacgcggccctcgacggggtccctgaccgattcctctggcctccaagtctggccacctcacgccctccngacccatcagtggctccggcgaggntgaggctagactattacngtgcatcgacgggacncaacngtgggatcgacaatcgtgaggcggggtttggcgttcgggacggagggtaaccaaagtcgaaccgtccgaaggtccaaggccccaaagg

SEQ ID NO: 310864 - DNA, 611 bp, Homo sapiens
  misc_feature: GZ8MTXP02J0G4D.21.22.B11.1.454.CMB.2.raw
  modified_base (332)..(332): a, c, t, g, unknown or other
  misc_feature (332)..(332): n is a, c, g, or t
  modified_base (424)..(424): a, c, t, g, unknown or other
  misc_feature (424)..(424): n is a, c, g, or t
  modified_base (453)..(453): a, c, t, g, unknown or other
  misc_feature (453)..(453): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctgggacccccggcagagggtcaccatctcttgttctggaggcaactccaacatcggaagtattatgtattctggtatcagcaactcccaggaatcggcccccaaactcctcatccagaggaatatcagccggcctgacggggtcccngaccgatctctggctccaagtctggcacctcagccctcctgacccatcagtcgggctccgggtccgaggactggacgtctagactattacgngtgactatcgaaccggggacaccaaacgngttacggggacttaggaacctaaagtttccgaggtacggtccgggggtttggggttacggttaccgggggacgggtaaccgggggtaaacccctaaaccggttacggaaccccggtttacccgttaagggtacccaacggggacccccgtaaccgggg

SEQ ID NO: 310865 - DNA, 611 bp, Homo sapiens
  misc_feature: GZ8MTXP02F25TM.21.22.B11.1.454.CMB.2.raw
  modified_base (199)..(199): a, c, t, g, unknown or other
  misc_feature (199)..(199): n is a, c, g, or t
  modified_base (299)..(299): a, c, t, g, unknown or other
  misc_feature (299)..(299): n is a, c, g, or t
  modified_base (347)..(347): a, c, t, g, unknown or other
  misc_feature (347)..(347): n is a, c, g, or t
  modified_base (384)..(384): a, c, t, g, unknown or other
  misc_feature (384)..(384): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctcgggacccccggnagagggtcaccatctcttgttctggaggcaactccaacatacggaagtaattatgttattctggtatcagcaactcccaggaatcggacccccaatcctnatccagaggaataatcagcgccctcgacggggtcctagaccgacttcncgtggctacagtctgcacctcacgtccctcctgaccntcaggtcggcctccggtcgagactggagcagacttatacgtgtcgctagtacgaacggggtaccacgtaaacgagtggggactacggaaactaagttccggtaggtacgggttccggggtttgggggttacgggtttacggggaccggggaacgggggtaaaccctaaaacgggttccggaaaccccggttcgtaaacgggtccaaaccgggtacccgaaaccgggg

SEQ ID NO: 310866 - DNA, 585 bp, Homo sapiens
  misc_feature: GZ8MTXP02GQ6NR.21.22.B11.1.454.CMB.2.raw
  modified_base (451)..(451): a, c, t, g, unknown or other
  misc_feature (451)..(451): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctcgggacccccggcagagggtcaccatctcttgttctggaggcaactccaacatcggaagttaattatgtattctggtatcagcaactccaggaatcggaccccaaactcctcatccagaggaataatcagcggccctcgacggggtccctgaccgacttctctcggctccaagttctggccacctcacgccctccctgacccatcgagtcgggcctccgggtcgaggactggacggctgactattacgtgtgcatcgacgggacncaacgagtacgggatcggaactaagtcgtaggacgggtcgggtttggggtacggtttaccggggacggggtaacgggaaaccctaaaacggtcggtaacccggtaccgtaggtaccgacggaccccgtaacggg

SEQ ID NO: 310867 - DNA, 592 bp, Homo sapiens
  misc_feature: GZ8MTXP02GZE0F.21.22.B11.1.454.CMB.2.raw
  modified_base (200)..(200): a, c, t, g, unknown or other
  misc_feature (200)..(200): n is a, c, g, or t
  modified_base (222)..(222): a, c, t, g, unknown or other
  misc_feature (222)..(222): n is a, c, g, or t
  modified_base (237)..(237): a, c, t, g, unknown or other
  misc_feature (237)..(237): n is a, c, g, or t
  modified_base (298)..(298): a, c, t, g, unknown or other
  misc_feature (298)..(298): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtcgtcgggacccccggnagagggtcacatctcttgttcnggagcaactccaacntacggaatattatgtattcgtgtatcagcaactcccaggaactccggacccccaaatcccnactccagagataatcagcgcctcgacggggtcctgacctctctctcggctccaagtctggcctacctcgacgtccctacctcgacctactcgaggttccggccgtccggccgaggctggagctacgacttaacgttcgttgcgcacgtaccgggaacggtacacaacgagtgggatacgaaacgtatacggtggacgggttcggggttaggggtcggttacgggggacgggtaacggaaacgtaacccggtcggtaacccggttacgtacggtaccgaacggacccgtaaccgg

SEQ ID NO: 310868 - DNA, 648 bp, Homo sapiens
  misc_feature: GZ8MTXP02FU390.21.22.B11.1.454.CMB.2.raw
  modified_base (313)..(313): a, c, t, g, unknown or other
  misc_feature (313)..(313): n is a, c, g, or t
  modified_base (332)..(332): a, c, t, g, unknown or other
  misc_feature (332)..(332): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctgggaccccccggcagagggtcaccatctcttgttctggagcaactccaacatcggaaagttaattatgtattctggtatcagcaactcccaaggaatcggaccccaaactcctcatccagagaatancagcgcctcgacgggtccngaccgtattcctctcggcctaccaagtctggccacctcgacgtcccctccgtcgacccatccgagtcgggccgtccgggtccgaggactggacggtcttacgacgttaacttacgtcggttacgacacgttaccgggaaaccggggaaaccgttaaaccgaaaaaaggttcgggggaaattacggaaactaaagttccggtaggtaggtccgggggttttagggtcgggttaccgggcggggtaaaacgggaacccgaaaacgttcgggaaccccgttacggtacggtaccgaaccggaccccgtaacgggccccg

SEQ ID NO: 310869 - DNA, 601 bp, Homo sapiens
  misc_feature: GZ8MTXP02JXHIL.21.22.B11.1.454.CMB.2.raw
  modified_base (199)..(199): a, c, t, g, unknown or other
  misc_feature (199)..(199): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctcgggacccccggnagagggtcaccatctcttgttctggaggcaactcaacatcggaataattatgtattctggtatcagcaactcccaggaactcggacccccaaatcctcatccaagaggaaataatcagccggccctcgacggggtcccctgaccgtattcctcgtcggcctccgaagtctcgggccacctcacgccctccctagacccatcgagtcgggcctccgggtccgaggactggacgtctcgacttaagttctgtcgacacgtccggaacggggacaccgaaacgagtggggattcggaacaagttcgtaggagggtccggggtttggggtcggttccggggacgggtaacgggaacccgtaaagtccggtacccggtacgttaacggcctaacggcccgaaacggg

SEQ ID NO: 310870 - DNA, 546 bp, Homo sapiens
  misc_feature: GZ8MTXP02JVTJW.21.22.B11.1.454.CMB.2.raw
  modified_base (198)..(198): a, c, t, g, unknown or other
  misc_feature (198)..(198): n is a, c, g, or t
  modified_base (330)..(330): a, c, t, g, unknown or other
  misc_feature (330)..(330): n is a, c, g, or t
  modified_base (474)..(474): a, c, t, g, unknown or other
  misc_feature (474)..(474): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctgggacccccggnagagggtcaccatctcttgttctggagcaactccaacatcggaataattatgtattctggtatcagcaactccaggaatcggacccccaaatcctcatccagagaataatcagccggcctcgaggggtcccngaccgacttctctggctcaagtctggccacctcacgccctccctgacccatcaggtggcctcggtccgagactgagctgactatactgtgcatcgaacgggacacaacgatgggaatgaaacaagttcaggaggcggttggggngtttacggggcggaaggggaacccaaaagtcggtaaacccgtcccgttaagggtcaaacgccccgaaacggg

SEQ ID NO: 310871 - DNA, 756 bp, Homo sapiens
  misc_feature: GZ8MTXP02GUWTZ.21.22.B11.1.454.CMB.2.raw
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagcccaccctcagcgtctcgggaccccccgggcagagggtcaccatctcttgttctggagcaactccaacatcggaataattatgtattctggtatcagcaactcccaggaactcggacccccaaatcctcactccaagaacggaataactcaagccggccctcgacggggtccctacggaccgtacttcctactcggtcctacccgaagttcctggggcctaaccgtccgaacgtcccccttaccccgtacgaaccctaacgtcctaagggtcggggcccgttcccggggttacccgggaaagggtacttcggggacgggtaccttacgtaaaccgtttaagttttaacccgtggttacgaccgtaaacgttacccggaaaccgggggaaccaccgaaaaccgtaggttaccgggggaattacggaaactaaaacgttccgttaggaacgggtttaccgggggttgggggttcggggtttaccgggggaccggggtaacgggggtaaaaccccgtaaaacggttaccggaaccccgggtttacccgaaacggggtttacccgaaccggacccccgtaaaaccgggg

SEQ ID NO: 310872 - DNA, 717 bp, Homo sapiens
  misc_feature: GZ8MTXP02IR03H.21.22.B11.1.454.CMB.2.raw
  modified_base (302)..(302): a, c, t, g, unknown or other
  misc_feature (302)..(302): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtcgtcggggacccccgggcagagggtcaccatctcttgttctggaggcaactccaacagtacggaagttaattatgttattctggtatcagcaactccaggatcggaccccaactcctnactccagagaataatcagccgcctcgacggggtccctagaccgtatttccgtcgtcggcctaccgaaacgttccgtcggggacctaacccccttccgaccgtcccccttcccgtacgaaccctacttcgacgggttcggggcccttcccggggttacccggaaggtacgttgggaaccgggtccgttagtaaccgtttaaagtttaccgttcggtacgtaccgtaacgttaccgggaacccgggggtaaccgacaaaaccggtaggttagggacgttaacgaaacctacgttacgtcggggtaaggttccgggggttttagggggtcggtttacgggggacgggtaaccggggaaaacctaaccgttacggggacccgttaccgtaagggtaccccaacggaccccgtaaacggg

SEQ ID NO: 310873 - DNA, 619 bp, Homo sapiens
  misc_feature: GZ8MTXP02I5D02.21.22.B11.1.454.CMB.2.raw
  modified_base (200)..(200): a, c, t, g, unknown or other
  misc_feature (200)..(200): n is a, c, g, or t
  modified_base (332)..(332): a, c, t, g, unknown or other
  misc_feature (332)..(332): n is a, c, g, or t
  modified_base (355)..(355): a, c, t, g, unknown or other
  misc_feature (355)..(355): n is a, c, g, or t
  modified_base (373)..(373): a, c, t, g, unknown or other
  misc_feature (373)..(373): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctcggggacccccggnagagggtcaccatctcttgttctggagcaactccaacatcggaagtattatgtattctggtatcagcaactcccaggaatcggacccccaaatcctcatccagagaatatcagcggcctcgacggggtcccngaccgattctctgctaccagtcnggccacctcacgcctccnacccatcgaggtgggcctcccgggtcgaggactggacgtctagtacttagttacgtgtcgactacgtccggaaccggggacacaaacgtggtacggggattacggaaactaacgttcggtaggaacgggttccgggggtttagggggtcggtttaccgggggaaccgggaacggggtaaaccccgtaaaaggttcgggtaaccccgttaccggtaaggggtacccaacggacccccgtaaacgggg

SEQ ID NO: 310874 - DNA, 640 bp, Homo sapiens
  misc_feature: GZ8MTXP02GZJIX.21.22.B11.1.454.CMB.2.raw
  modified_base (201)..(201): a, c, t, g, unknown or other
  misc_feature (201)..(201): n is a, c, g, or t
  modified_base (397)..(397): a, c, t, g, unknown or other
  misc_feature (397)..(397): n is a, c, g, or t
  modified_base (463)..(463): a, c, t, g, unknown or other
  misc_feature (463)..(463): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtcgtcgggacccccgggnaggagggtcaccatctcttgttctggaggcaactccaaacatacggaaagttaattatgtattctggtatcagcaactcccaaggaactcggacccccaaatcctacactccagaaggaaataatcacgccggccctcgacggggtccctgaccgacttctcgtcgcctacaagtctgccactcacgccctccctnaccctatccgaggtcggcctcccgggtccggaaggctgggacggtctacggtaacttagtttacgnggttcgcgtaacgtaccggaaccggggaaccaccgaaacgtaggtaggggacttaggaaacctaaagtccgttagggacggttccggggttaggggttcggttaccggggacgggaacgggaaacccaaaacggttcggaaccccgttacgtaggtacccacggacccgtaaacggg

SEQ ID NO: 310875 - DNA, 587 bp, Homo sapiens
  misc_feature: GZ8MTXP02F2P5V.21.22.B11.1.454.CMB.2.raw
  modified_base (294)..(294): a, c, t, g, unknown or other
  misc_feature (294)..(294): n is a, c, g, or t
  modified_base (345)..(345): a, c, t, g, unknown or other
  misc_feature (345)..(345): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctgggacccccggcagagggtcaccatctcttgttctggaggcaactccaacatcggaagtaattatgtattctggtatcagcaactcccagatcggaccccaaactccncatccagaggaataatcagccggccctacgacggggtcctggaccgattcnctggcctccaagtctggccacctcacgccctcccgtagaccatcacggtcgggactcccgggtccgaggacgtggagctagacttagttactgtagcagtcgacggaccgacaacagtagggatagaacgaatcgtaggaggtacggggttgggtcggtttacggggacggtaacggggaaacccgtaaaacggttcggaacccggttaccgtaacgggtacgaccggtacccggaaaccgg

SEQ ID NO: 310876 - DNA, 622 bp, Homo sapiens
  misc_feature: GZ8MTXP02GF1LL.21.22.B11.1.454.CMB.2.raw
  modified_base (198)..(198): a, c, t, g, unknown or other
  misc_feature (198)..(198): n is a, c, g, or t
  modified_base (316)..(316): a, c, t, g, unknown or other
  misc_feature (316)..(316): n is a, c, g, or t
  modified_base (466)..(466): a, c, t, g, unknown or other
  misc_feature (466)..(466): n is a, c, g, or t
  modified_base (472)..(472): a, c, t, g, unknown or other
  misc_feature (472)..(472): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctgggacccccggnagagggtcaccatctcttgttctggaggcaactccaacatcggaaagttaattatgttattctggtatcagcaactcccaggaactcggacccccaaatcctcatccaagagaataancagcgccctgacggggtcccagaccgtattcctcgtcggcctaccaagtcctgggccaccgtcacgccctccgtgacccatcgaggtcgggcctcccgggtcgagatggaggctagacttaattactgtgctagtaccgacggggaaccngaaacnggtacgggatagaactaaagtcgtagggtacggtcgggggtttggggttcggttccgggggaacgggggtaaccgggtaaaccccgtaaaacggttcgggaaacccccgtttccggtaaacgggtccaaccgggacccccgtaaacgggg

SEQ ID NO: 310877 - DNA, 636 bp, Homo sapiens
  misc_feature: GZ8MTXP02FQHAZ.21.22.B11.1.454.CMB.2.raw
  modified_base (198)..(198): a, c, t, g, unknown or other
  misc_feature (198)..(198): n is a, c, g, or t
  modified_base (236)..(236): a, c, t, g, unknown or other
  misc_feature (236)..(236): n is a, c, g, or t
  modified_base (501)..(501): a, c, t, g, unknown or other
  misc_feature (501)..(501): n is a, c, g, or t
  modified_base (511)..(511): a, c, t, g, unknown or other
  misc_feature (511)..(511): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctgggacccccggnagagggtcaccatctcttgttctggaggcaactccaanatcggaagttaattatgtattctggtatcagcaactcccaggaatcggacccccaaatcctcatccagagaatatcagcggccctcgacggggtcctgaccgacttctctggcctaccaaggttctcggcctaccctcacgcccttcctgaccctatcccgaaggttcgggaccttcccgggtaccggaagggattcgggaacgggtcctaggaaccttaagtttacccgtggttacgacctaacgtcccggaaacgggggaccnccgaaaacgngttacggggatacggaactaaagtcgtaggaaggtcggggtttagggtacggttccggggacgggtaacgggaacccaaacggttcggaacccgttcgtaagggtaccacggacccggtaaacgg

SEQ ID NO: 310878 - DNA, 617 bp, Homo sapiens
  misc_feature: GZ8MTXP02GSLV2.21.22.B11.1.454.CMB.2.raw
  modified_base (346)..(346): a, c, t, g, unknown or other
  misc_feature (346)..(346): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccatcctcagcgtctgggaccccccggcagagggtcaccatctcttgttctggaggcaactccaacatcggaagtaattatgtattctggtatcagcaactcccaggaatcggcccccaaactcctcatccagaggaataatcagccgccctgaggggtccctgaccccgattcnctggctccgaatctggccacctcacgcctccctgacccatcagtgggcctcccgggaccgagggactggaagggctggaaccttattaccgtgtgactagtccgaaaccgggggacaccgaaacgtagtcgggggaatggaaaaccaagtttcccgtgggaaacggtcgggggtttaggggttcggtttaccgggggacgggtaaacgggggaacccctaaaacgttcggaaccccggttccgtaaacggggtcccgaacggaacccccgg

SEQ ID NO: 310879 - DNA, 521 bp, Homo sapiens
  misc_feature: GZ8MTXP02IOCFH.21.22.B11.1.454.CMB.2.raw
  modified_base (198)..(198): a, c, t, g, unknown or other
  misc_feature (198)..(198): n is a, c, g, or t
  modified_base (235)..(235): a, c, t, g, unknown or other
  misc_feature (235)..(235): n is a, c, g, or t
  modified_base (373)..(373): a, c, t, g, unknown or other
  misc_feature (373)..(373): n is a, c, g, or t
  modified_base (413)..(413): a, c, t, g, unknown or other
  misc_feature (413)..(413): n is a, c, g, or t
  modified_base (426)..(426): a, c, t, g, unknown or other
  misc_feature (426)..(426): n is a, c, g, or t
  modified_base (430)..(430): a, c, t, g, unknown or other
  misc_feature (430)..(430): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctgggacccccggnagagggtcaccatctcttgttctggagcaactccaanatcggaataattatgtattctgtatcagcaactcccaagatcggacccccaaatcctcatccaagagaataatcagccgcctcgacggggtccctgaccgtattctctggctccaagtctggcactcacgccctcctnaccatcgagtggctcggtcgagatgagctgatattactgngcatcgacggcanaacngtagggatagacactgagaggtcgggttgggtcggttcgggacggtacggaacctaaagtccgaccgttcgtaggtcacggaccgtaacgg

SEQ ID NO: 310880 - DNA, 563 bp, Homo sapiens
  misc_feature: GZ8MTXP02FG1LL.21.22.B11.1.454.CMB.2.raw
  modified_base (186)..(186): a, c, t, g, unknown or other
  misc_feature (186)..(186): n is a, c, g, or t
  modified_base (412)..(412): a, c, t, g, unknown or other
  misc_feature (412)..(412): n is a, c, g, or t
  modified_base (433)..(433): a, c, t, g, unknown or other
  misc_feature (433)..(433): n is a, c, g, or t
  modified_base (436)..(436): a, c, t, g, unknown or other
  misc_feature (436)..(436): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtcncgggacccccggcagagggtcaccatctcttgttctggagcaactccaacatcggaataattatgtattctggtatcagcaactcccaggaatcggacccccaaactcctcactccagagaatatcagccgcctcgacgggtcctgaccgacttctctggctcgaacgtctcggccaacctcacgccctccctcgacccatcaggtcggcctcccgggtccgaggntggaggtctagacttattacngtncagtcgaacgggcacgaacagtgggatcgaacaacgtcgtaggaggttcggggttagggttcggttccgggacggggacgggaacccaaaacgtcgaacccggtcacggtcgaacggcccaaacggg

SEQ ID NO: 310881 - DNA, 533 bp, Homo sapiens
  misc_feature: GZ8MTXP02JJ218.21.22.B11.1.454.CMB.2.raw
  modified_base (198)..(198): a, c, t, g, unknown or other
  misc_feature (198)..(198): n is a, c, g, or t
  modified_base (234)..(234): a, c, t, g, unknown or other
  misc_feature (234)..(234): n is a, c, g, or t
  modified_base (369)..(369): a, c, t, g, unknown or other
  misc_feature (369)..(369): n is a, c, g, or t
  modified_base (418)..(418): a, c, t, g, unknown or other
  misc_feature (418)..(418): n is a, c, g, or t
  modified_base (431)..(431): a, c, t, g, unknown or other
  misc_feature (431)..(431): n is a, c, g, or t
  modified_base (438)..(438): a, c, t, g, unknown or other
  misc_feature (438)..(438): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctgggacccccggnagagggtcaccatctcttgtctggagcaactccaantcggaatattatgtattctggtatcagcaactcccaggaatcggacccccaaatcctcatccagagaataatcagccggcctcgacggggtccctgaccgattctctgcctcaagtctggcacctcagccctccngaccatcagtcggctccggtcgagactgacggctgacttattactgtcncatcgacgggacncaaacgngtaggggatacggaactaatcgtaggaggtcgggtttgggtcgttccggggcgggtcggaaccaaggcgtacggaccgtctaggccacggacccg

SEQ ID NO: 310882 - DNA, 618 bp, Homo sapiens
  misc_feature: GZ8MTXP02IPPDU.21.22.B11.1.454.CMB.2.raw
  modified_base (198)..(198): a, c, t, g, unknown or other
  misc_feature (198)..(198): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctgggacccccggnagagggtcaccatctcttgttctggagcaactccaacatcggaaagtaattatgtattctggtatcagcaactccagaactcggaccccaatcctcatccaagagaataatcagccgcctcgacggggtccctgaccgtattctcgtcgcctacgaagttctcggcctaaccctcacgtcccctcccgtagacccagttccaaggtcggggcctcccggggtaccggaggtaacgtcggaacgggtccttaggaaccttaaagtttccgtaggtcgtctaacgtaccggaacggggaccacaaacgtagtggggacttacggaactaaagttcgtaggacggtcgggtttgggtacgttcgggggacggtaacgggaccaaaacgtcggaccgttacgtaggtccaacggtcccgaacgg

SEQ ID NO: 310883 - DNA, 662 bp, Homo sapiens
  misc_feature: GZ8MTXP02J5YGP.21.22.B11.1.454.CMB.2.raw
  modified_base (199)..(199): a, c, t, g, unknown or other
  misc_feature (199)..(199): n is a, c, g, or t
  modified_base (244)..(244): a, c, t, g, unknown or other
  misc_feature (244)..(244): n is a, c, g, or t
  modified_base (283)..(283): a, c, t, g, unknown or other
  misc_feature (283)..(283): n is a, c, g, or t
  modified_base (329)..(329): a, c, t, g, unknown or other
  misc_feature (329)..(329): n is a, c, g, or t
  modified_base (360)..(360): a, c, t, g, unknown or other
  misc_feature (360)..(360): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcaggtcctgggcccagtctgtgctgactcacgccaccctcagcgtctcgggaccccgggnagaggtcaccatctcttgtctggagcactcaacatcggataattntgtatctgtatcagcactccagaatcgaccccaatcctnatccagagaataactcagccgacctcgacggggttccctgaccgtnttccgtcgtcggtacctccgaacgtttccgnggcccctaacccgttcccaccgtccctacccgtaccgtaccgtacgtacgtacggtcgggtcccggtacccgggtaccggtacgggtacgtacggtacggtacgttacgtacgttacttacgttcgtacgtacgtacgtaccggtaccggacgaccgaacgtaacggtacggtagtacgtaacgtaacgtacgtacggtacgggttacggggttcgggttacgggttaccgggtaccggggtaaccgggtaaccggtaaccgtaccgtaccgtaccgtaccgtaccgtaccgacccgtaccg

SEQ ID NO: 310884 - DNA, 636 bp, Homo sapiens
  misc_feature: GZ8MTXP02IF9GY.21.22.B11.1.454.CMB.2.raw
  modified_base (234)..(234): a, c, t, g, unknown or other
  misc_feature (234)..(234): n is a, c, g, or t
  modified_base (316)..(316): a, c, t, g, unknown or other
  misc_feature (316)..(316): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctgggacccccgggcagagggtcaccatctcttgttctggagcactcaanatcggaataattatgtattctggtatcagcaactcccaggaatcggaccccccaaatcctcatccagagataatcagcgccngacggggtccctgaccgattcctctcggctcaagtcctggccacctcacgcccctcctagaccctagtcaggttcgggcccttcccggggtcccgagggtacttcgggaacggtccttacggaacttaacgttttaaccgtggtcgtaccaacgttcccggaaccgggggaccacgaaacaggttacggggattacggaaactaaattccgtaggacggtcggggtttggggcgtttaccggggacggggttacggaaacccgtaaaacgtccggtaaacccggttccgtaaagggtccccgaggacccccgtaacgggg

SEQ ID NO: 310885 - DNA, 548 bp, Homo sapiens
  misc_feature: GZ8MTXP02IY3GQ.21.22.B11.1.454.CMB.2.raw
  modified_base (199)..(199): a, c, t, g, unknown or other
  misc_feature (199)..(199): n is a, c, g, or t
  modified_base (295)..(295): a, c, t, g, unknown or other
  misc_feature (295)..(295): n is a, c, g, or t
  modified_base (310)..(310): a, c, t, g, unknown or other
  misc_feature (310)..(310): n is a, c, g, or t
  modified_base (452)..(452): a, c, t, g, unknown or other
  misc_feature (452)..(452): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctcgggacccccggnagagggtcaccatctcttgttctggagcaactccaacatcggaagtaattatgtattctggtatcagcaactcccaggatcggacccccaaatccncatccagagaataancagcgccctcgacggggtccctgaccgtacttctcgtggcctccgaagttctggccacctcacgccctcctgacccatcgagtcggctccggtcgagctggagctagacttaatctgtcgcaatcgaacgggacacaaacgngtagggatagacaagttctaggaaggtcggggttagggtcgttccgggaacggacggaaaccaaacgttcgaaccgtcgtagccacggaccaacgg

SEQ ID NO: 310886 - DNA, 779 bp, Homo sapiens
  misc_feature: GZ8MTXP02GU2IO.21.22.B11.1.454.CMB.2.raw
  modified_base (237)..(237): a, c, t, g, unknown or other
  misc_feature (237)..(237): n is a, c, g, or t
  modified_base (261)..(261): a, c, t, g, unknown or other
  misc_feature (261)..(261): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctcgggacccccggcagagggtcaccatctcttgttctggagcaactccaacngtacggaagtaattatgtattcgnggtatcagcaactcccaggaactccggacccccaaactcctacactccaagaagaataactcagccggacctcggacggggttcccctagaccgtattcctcgtcggtacctaccgaacgttctcgggtccctaaccctcgaccgtcccccttcccgtaccgtaaccctaacgttccgtaacgggttccggggcccgttacccggggtcccggtaaaggtcgttacgggaacgggtccgttaggtaaccctttaaagtttaacccgtggttaccggacctaaacggttcccgggaaaacccgggggtaacctaaaccgaaaaccgtaggttacgggggaaatttacggggaaaaccttaagtaccggtaggggtaaacgggttcccgggggtttaagggggtcgggtttaccgggggaaaccgggggttaaccgggaaaccccgtaaaaacggttcccggggtaaaacccggttccggtaacggttacccggaaccggttaaccccggtaaaccgggg

SEQ ID NO: 310887 - DNA, 576 bp, Homo sapiens
  misc_feature: GZ8MTXP02J0R94.21.22.B11.1.454.CMB.2.raw
  modified_base (312)..(312): a, c, t, g, unknown or other
  misc_feature (312)..(312): n is a, c, g, or t
  modified_base (330)..(330): a, c, t, g, unknown or other
  misc_feature (330)..(330): n is a, c, g, or t
  modified_base (336)..(336): a, c, t, g, unknown or other
  misc_feature (336)..(336): n is a, c, g, or t
  modified_base (398)..(398): a, c, t, g, unknown or other
  misc_feature (398)..(398): n is a, c, g, or t
  modified_base (437)..(437): a, c, t, g, unknown or other
  misc_feature (437)..(437): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctgggacccccgggcagagggtcaccatctcttgttctggaggcaactccaacatcggaagtaattatgtattctggtatcagcaactcccaggaactcggacccccaaatcctcatccagagaatancagcgcctgacgggtccngaccgntctctgctcaagtctggcacctcagccctcctgacccatcgagtcgggcctcccggtcgagntgaggtctagacttattacgtgtgactatcgacgggacncaaacgtgtagggatcgaacaatcgtaggtacggcggggtttaggggtcgttacggggacgggtaacggggtaaacccaaaacggttccggggaaacccgttccggtaagggttacccgaaccggaccccgtaaccggg

SEQ ID NO: 310888 - DNA, 791 bp, Homo sapiens
  misc_feature: GZ8MTXP02GVYQA.21.22.B11.1.454.CMB.2.raw
  modified_base (202)..(202): a, c, t, g, unknown or other
  misc_feature (202)..(202): n is a, c, g, or t
  modified_base (241)..(241): a, c, t, g, unknown or other
  misc_feature (241)..(241): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctcggggaccccccgggnagagggtccaccatctcttgttctggagcaactccaacntcggaatattatgtattctggtatcagcaactcccaaggaactcggaccccccaaaatccctacactcccaaggaaggaaataatccgaaggcccggtccctacggaacggggttccccctaggacccgtactttccgtccgtcgggaccttacccgaaaggttccgtcggggaccctaaccccgttccgaaccgtcccccttacccccgtacgaaccccctaattcccgaacggggttcgggggtccccttaccccgggggtacccggaaagggtacgttcggggaaccgggttacctacgggtaaacccttaatttaaccgttgggttacggtaccaacgttacccgggaaccgggggaaccctaccgaaaacgtacggttagggggaacttacggaaacctaaaagttccggtaggggtaaagggttccgggggttttgggggtaacggttccgggggaaccggggtaacgggggaacccctaaaggtcccgttaacgggtaacccccggttaccgttaaacggggtccaaaaccgggtacccccgg

SEQ ID NO: 310889 - DNA, 508 bp, Homo sapiens
  misc_feature: GZ8MTXP02GEQA4.21.22.B11.1.454.CMB.2.raw
  modified_base (199)..(199): a, c, t, g, unknown or other
  misc_feature (199)..(199): n is a, c, g, or t
  modified_base (238)..(238): a, c, t, g, unknown or other
  misc_feature (238)..(238): n is a, c, g, or t
  modified_base (292)..(292): a, c, t, g, unknown or other
  misc_feature (292)..(292): n is a, c, g, or t
  modified_base (335)..(335): a, c, t, g, unknown or other
  misc_feature (335)..(335): n is a, c, g, or t
  modified_base (361)..(361): a, c, t, g, unknown or other
  misc_feature (361)..(361): n is a, c, g, or t
  modified_base (385)..(386): a, c, t, g, unknown or other
  misc_feature (385)..(386): n is a, c, g, or t
  modified_base (400)..(400): a, c, t, g, unknown or other
  misc_feature (400)..(400): n is a, c, g, or t
  modified_base (417)..(417): a, c, t, g, unknown or other
  misc_feature (417)..(417): n is a, c, g, or t
  modified_base (421)..(421): a, c, t, g, unknown or other
  misc_feature (421)..(421): n is a, c, g, or t
  modified_base (435)..(435): a, c, t, g, unknown or other
  misc_feature (435)..(435): n is a, c, g, or t
  modified_base (441)..(441): a, c, t, g, unknown or other
  misc_feature (441)..(441): n is a, c, g, or t
  modified_base (450)..(450): a, c, t, g, unknown or other
  misc_feature (450)..(450): n is a, c, g, or t
  modified_base (496)..(496): a, c, t, g, unknown or other
  misc_feature (496)..(496): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctcgggacccccggnagagggtcaccatctcttgttctggaggcaactccaacntcggaattaattatgtattctggtatcagcaactccagaatcgaccccaatccncatcagagaatatcagcgcctcgacgggtcctgacacttctcngctacaagtctgcactcacgcctccnaccatcagtcggctccggtcgagnngagctgactatacngtcgcagtcgacggacncaanagtggatgacatcnggacgnggttagggngtccggacggtacggaaactaaacgcggtaccgtaccgtaggtacncggacctaacgg

SEQ ID NO: 310890 - DNA, 535 bp, Homo sapiens
  misc_feature: GZ8MTXP02I2IWZ.21.22.B11.1.454.CMB.2.raw
  modified_base (235)..(235): a, c, t, g, unknown or other
  misc_feature (235)..(235): n is a, c, g, or t
  modified_base (291)..(291): a, c, t, g, unknown or other
  misc_feature (291)..(291): n is a, c, g, or t
  modified_base (328)..(328): a, c, t, g, unknown or other
  misc_feature (328)..(328): n is a, c, g, or t
  modified_base (399)..(399): a, c, t, g, unknown or other
  misc_feature (399)..(399): n is a, c, g, or t
  modified_base (438)..(438): a, c, t, g, unknown or other
  misc_feature (438)..(438): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctgggacccccggcagagggtcaccatctcttgtctggagcaactccaacntcggaagtaattatgtattctggtatcagcaactcccagatcggacccccaatccncatccagacgaataatcagcgcctcgacggggtcccngaccgatctctggctccaagtctcggcacctcacgccctccctgacccatcagtcggcctccggtccgagntgaggctagacttattacgtgtcgctatacgacgggacncaaacgtgtagggatgaacaatcgtagaggtcgggtagggttcgtcggacggaggaaccaaacggtcgacccgtccgtaggtccacggaccaacggg

SEQ ID NO: 310891 - DNA, 602 bp, Homo sapiens
  misc_feature: GZ8MTXP02FYR3G.21.22.B11.1.454.CMB.2.raw
  modified_base (198)..(198): a, c, t, g, unknown or other
  misc_feature (198)..(198): n is a, c, g, or t
  modified_base (498)..(498): a, c, t, g, unknown or other
  misc_feature (498)..(498): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctgggacccccggnagagggtcaccatctcttgttctggagcaactccaacatcggaagtaattatgtattctggtatcagcaactcccgaaggactcggacccccaaactcctcactccaagaggaataatcagccggccctcgacggggtccctagaccgtacttcctcgtcggcctaccaacgttctcggcacctcacgccctccctgaccatcgaggtcgggcctccggtccgaggactggacggctagacttattactgtcgctagtcgaacggggacacgaacgtagtacgggatagaacaagttcgnggtacggtcgggggtttaggggtcgtttccgggggacgggtacgggtaaaaccgaaacggtcggaaccggttacccgtaaggtaccgacggacccgtaaccggg

SEQ ID NO: 310892 - DNA, 571 bp, Homo sapiens
  misc_feature: GZ8MTXP02IWEF0.21.22.B11.1.454.CMB.2.raw
  modified_base (386)..(386): a, c, t, g, unknown or other
  misc_feature (386)..(386): n is a, c, g, or t
  modified_base (393)..(393): a, c, t, g, unknown or other
  misc_feature (393)..(393): n is a, c, g, or t
  modified_base (462)..(462): a, c, t, g, unknown or other
  misc_feature (462)..(462): n is a, c, g, or t
  modified_base (476)..(476): a, c, t, g, unknown or other
  misc_feature (476)..(476): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctcgggacccccggcagagggtcaccatctcttgttctggagcaactccaacatcggaagtaattatgtattctggtatcagcaactcccaggaatcggacccccaaactcctacactccaagaaggaaataaatcaagccggccctcgacggggtcccctggaccgtattcctctggcctaccaacgtctggcaacctcanccctccngaccatcagtgggcctccggtcgaggatggaggctgaacttattactgtcacatcgaaacggcacaaanagtaggatagaaanaaatacgtagaggtacgggtggggttacgggttcgggtacgggaacgggaaaccgaaaacgtaacgtaccgtaccgtacgtacgacgaccgaacg

SEQ ID NO: 310893 - DNA, 614 bp, Homo sapiens
  misc_feature: GZ8MTXP02GEMFY.21.22.B11.1.454.CMB.2.raw
  modified_base (200)..(200): a, c, t, g, unknown or other
  misc_feature (200)..(200): n is a, c, g, or t
  modified_base (260)..(260): a, c, t, g, unknown or other
  misc_feature (260)..(260): n is a, c, g, or t
  modified_base (292)..(292): a, c, t, g, unknown or other
  misc_feature (292)..(292): n is a, c, g, or t
  modified_base (306)..(306): a, c, t, g, unknown or other
  misc_feature (306)..(306): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtcgtcgggacccccggnaggagggtcaccatctcttgttctggagcactcaacatcgaatatatgtattctggtatnagcaactccgagaactcggacccccaatcctnactccagagaatancagccgcctcgacgggtccagaccgtacttctcgtcggcctaccgaagtctcggccacctcaccgtccctcctgaccctagtcgaggtcggaccgtccgggtacgaggtacgtggaacggtctacgaactttacgtacgtggtacgtctacgtaccggaacgggaccgacgaaacgtggtacgggatacgaacgtaacgttcggtaggtagggttccgggggtttgggtcggttcggggaaccgggtacggggtaaacctaaaccggtcggtaacccgtaccggtacggtacgaccggtaaccgacgg

SEQ ID NO: 310894 - DNA, 642 bp, Homo sapiens
  misc_feature: GZ8MTXP02F5LAS.21.22.B11.1.454.CMB.2.raw
  modified_base (201)..(201): a, c, t, g, unknown or other
  misc_feature (201)..(201): n is a, c, g, or t
  modified_base (355)..(355): a, c, t, g, unknown or other
  misc_feature (355)..(355): n is a, c, g, or t
tcagtcgtcgctcgcacgaccggtgctcgatttagacgacagctcaggggagcttcagctgtggtagagaagacaggactcaggacaatctccagcatggccggcttccctctccctcctcaccctcctcactcactgcgcagggtcctgggcccagtctgtgctgactcagccaccctcagcgtcgtcgggacccccggnagagggtcaccatctcttgttctggagcaactccaacatcggaagtaattatgtattctggtatcagcaactcccaaggaactccggacccccaaatccctacactccagacgaataactcagccggcctcgacggggtccctgaccgattccncgtggcctaccgaagttcgtcggcctacctcaccgtccctcctgacccatcgaggttcgggcctccgggtccgaggactggaacggtctagtaacttagttaccgtggttcgacttagtaccggaaccggggaccaacaaactggttaaggggattaacggaactaaagtccgtagggacgggtcggggtttgggggtacggttaccgggggaccggggaaacggaaaccctaaaacggttccggaacccggttacgttacggtaccgaccgtacccgtaaacgggg

SEQ ID NO: 310895 - DNA, 579 bp, Homo sapiens
  misc_feature: GZ8MTXP02GS6ZG.21.22.B11.1.454.CMB.2.raw
  modified_base (179)..(179): a, c, t, g, unknown or other
  misc_feature (179)..(179): n is a, c, g, or t
  modified_base (200)..(200): a, c, t, g, unknown or other
  misc_feature (200)..(200): n is a, c, g, or t
  modified_base (278)..(278): a, c, t, g, unknown or other
  misc_feature (278)..(278): n is a, c, g, or t
  modified_base (292)..(292): a, c, t, g, unknown or other
  misc_feature (292)..(292): n is a, c, g, or t
  modified_base (303)..(303): a, c, t, g, unknown or other
  misc_feature (303)..(303): n is a, c, g, or t
  modified_base (399)..(399): a, c, t, g, unknown or other
  misc_feature (399)..(399): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctnagcgtcgtcgggacccccggnagaggtcaccatctcttgtctggagcaactccaacatacggaataattatgtattctggtatcagcaactccgagacncgacccccaatccnatcagagatancagcgcctcgacgggtcccagaccgtcttctcgtgacctcgagtcgtcgccacctcgacgtccctcctagaccatcgagtcggcgtccggtcgagngtggagctagactatctgtcgactatacggacggacacgaacgtagtacgggtatagaactagtcgtaggtagggtcgggtttaggggtacggttacggggaccggtaacggggtaaaccaaccggttccgggtaacccggttacggttaaccggaccggaaccggtacccggtaaccgg

SEQ ID NO: 310896 - DNA, 590 bp, Homo sapiens
  misc_feature: GZ8MTXP02I64PT.21.22.B11.1.454.CMB.2.raw
  modified_base (198)..(198): a, c, t, g, unknown or other
  misc_feature (198)..(198): n is a, c, g, or t
  modified_base (296)..(296): a, c, t, g, unknown or other
  misc_feature (296)..(296): n is a, c, g, or t
  modified_base (459)..(459): a, c, t, g, unknown or other
  misc_feature (459)..(459): n is a, c, g, or t
  modified_base (466)..(466): a, c, t, g, unknown or other
  misc_feature (466)..(466): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctgggacccccggnagagggtcaccatctcttgttctggaggcaactccaacatcggaagtaattatgtattctggtatcagcaactcccaggaatcggacccccaaatccncactccagagaataatcagcgccctcgacggggtcccctagaccgtattcctcgtcggcctcaacgttctgggaccacctcacgtccctccctgacccatcgagtcgggcctccggccgaggcgtggggctgactattacgtgtgactagtcgacggggtacncaaacgngtagggaactgaactaagtcgtaggacggtcgggggttcgggtcggttacggggacgggtaacgggaaccctaaacgtcggtacccggttacgtacggtaccgacggtaccccgaagggtcccg

SEQ ID NO: 310897 - DNA, 643 bp, Homo sapiens
  misc_feature: GZ8MTXP02GMOOH.21.22.B11.1.454.CMB.2.raw
  modified_base (199)..(199): a, c, t, g, unknown or other
  misc_feature (199)..(199): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctcgggacccccggnaggagggtcaccatctcttgttctggaggcaactccaacatcggaagtaattatgtattctggtatcagcaactcccaggaatcggaccccaaactcctcactccagagaataactcagcggccctcgacggggtccctgaccgattctctggcctaccgagtctcggccacctcgacgccctccctagacccatccgacggtcgggtcccgtacccgggtccgagggtacgtggaacgggtcctacggtaaacttacgtttaacgtggtacgtacctacgttaccgggaaccggggaccgacaaacgaggttacgggggaatacggaaactaaacgttccgtagggaacgggttcgggggtttggggtacgttccgggggacgggttaacgggaaccctaaacgtcggaaccgttccggaggtaccgacggtacccgaaccgg

SEQ ID NO: 310898 - DNA, 707 bp, Homo sapiens
  misc_feature: GZ8MTXP02HQ503.21.22.B11.1.454.CMB.2.raw
  modified_base (199)..(199): a, c, t, g, unknown or other
  misc_feature (199)..(199): n is a, c, g, or t
  modified_base (235)..(235): a, c, t, g, unknown or other
  misc_feature (235)..(235): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctggggacccccggnagagggtcaccatctcttgtctggagcaactccaanatcggaagtaattatgtattctggtatcagcaactcccaggaatcggacccccaaatcctcactccaagaggaataactcagccggccctacgacggggtcccctgaccgtacttcctctcggcctcgaaacgttctcgggcctaacccgtcacgtccccttacccgtcgacccactccgaagggttcggggccctcccggggttccgaagggtacgttggaacgggtccttaggaactttacgtttaccgtaggtcgtaccgagttcccggaaacggggaccgaccgaaaaccgtaggttgggggaaacttacgggaaaacctaaacgtttcccggtaaggggtaacggggtttccgggggtttacggggtttcgggtttacccgggggaacggggttaaccggggaacccgtaaaacggttcggtaaaccccggttccggtaaaggtcccgtaacggacccgtaaccggg

SEQ ID NO: 310899 - DNA, 642 bp, Homo sapiens
  misc_feature: GZ8MTXP02JX3AY.21.22.B11.1.454.CMB.2.raw
  modified_base (312)..(312): a, c, t, g, unknown or other
  misc_feature (312)..(312): n is a, c, g, or t
  modified_base (334)..(334): a, c, t, g, unknown or other
  misc_feature (334)..(334): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctcgggacccccggcagagggtcaccatctcttgttctggagcaactccaacatcggaataattatgtattctggtatcagcaactcccaggaactcggacccccaaatcctcactccagagaataancagccgcctcgacggggtcccngaccgacttctcgtcggcctcgaagtctggccacctcacgtccctccctagacccatcgaggtcggggaccttcccgggtaccgaggtatcgggacgggtcctaggtaaccttagtttaccgtggtacgactacgtccggaaaccggggacaccgaaacgcggtaggggaattacggaaactaaacgttccgtaggggacggttccgggggtttaggggtcggttaccgggggacggggaacggggtaaccctaaaacggttcggtaaccccgttacggtacggtaccgaacggtacccccgtaaggg

SEQ ID NO: 310900 - DNA, 780 bp, Homo sapiens
  misc_feature: GZ8MTXP02JMBFC.21.22.B11.1.454.CMB.2.raw
  modified_base (199)..(199): a, c, t, g, unknown or other
  misc_feature (199)..(199): n is a, c, g, or t
  modified_base (237)..(237): a, c, t, g, unknown or other
  misc_feature (237)..(237): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctcgggacccccggnagagggtcaccatctcttgttctggagcaactccaacntcggaagtaattatgtattctggtatcagcaactcccgaaggaatcggacccccaaatcctcactccaagacggaataatcacggccggacctcgacggggtcccctaggaccgtacttccgtctcggtccttaccgaagttccgtcgggaccctaacccgtccgtaacccgggtcccccttaccccgttaccggaacccctacgttacccgtaaacgggttcccggggcccggttcccccgggtttacccggggaagggttaacgttcggggaaacggggtcccttaaggaaacctttacgtttaaccgtggtttaccggactaacgttccgggaaaccgggggacgacccaaaacggtaggtacggggacttaacggaaactaaaacgttcggtagggtaacggggttccggggtttaagggggttccgtttaccggggggaaccgggttaaaccgggtaaaaccccgaaaaccgggttcggttaaacccccgggtacggttacccggtaaccggaaccggtaacccccggtaaaccgggg

SEQ ID NO: 310901 - DNA, 574 bp, Homo sapiens
  misc_feature: GZ8MTXP02I8OUB.21.22.B11.1.454.CMB.2.raw
  modified_base (198)..(198): a, c, t, g, unknown or other
  misc_feature (198)..(198): n is a, c, g, or t
  modified_base (235)..(235): a, c, t, g, unknown or other
  misc_feature (235)..(235): n is a, c, g, or t
  modified_base (336)..(336): a, c, t, g, unknown or other
  misc_feature (336)..(336): n is a, c, g, or t
  modified_base (343)..(343): a, c, t, g, unknown or other
  misc_feature (343)..(343): n is a, c, g, or t
  modified_base (376)..(376): a, c, t, g, unknown or other
  misc_feature (376)..(376): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctgggacccccggnagagggtcaccatctcttgtctggaggcaactccaanatcggaataattatgtattctggtatcagcaactcccaaggaactcggacccccaaatcctcactccagaaggaataatcagccggccctcgacgggtccngaccgtntctctgctcaagtctggcacctcacgccctccngaccatcgagtcgggcctccggtcgaggtctggacgctagacttattacgtgtgactatacggaacgggcacgtaacgaggtgggactacgaactaagtccgttgggacgggtcggggtttggggtcgttacggggacgggaacggaaacctaaacggtcgaaccggttcccgtaaggtcccgacggaccccgaaggg

SEQ ID NO: 310902 - DNA, 657 bp, Homo sapiens
  misc_feature: GZ8MTXP02IE1QC.21.22.B11.1.454.CMB.2.raw
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtcgtcgggacccccgggcaggagggtcaccatctcttgttctggagcaactccaacatcggaaatattatgtattctgtatcagcaactcccaggaactcggacccccaaactcctacatccagaagaataatcagccgcctcgacggggtccctagaccgtacttcctcgtcggcctcctaagttctcggcccactcgaccgtcccctcccgtacaccctatcgcgggttcgggccgttacccgggcgaaggacgtcggaacgggcttacgaacttacgtttaaccgttggcgtacgtacgtaccgggaaccggggacccaagaaacgtaggttcggggaattacgaaactaacgttcggtaagggagggttcggggtttcggggttacgtccgggggacggggttaaaccggaaaccgtaaacggtccggtaacccggtaccggttaaggacccggaacgtaccccgaacgg

SEQ ID NO: 310903 - DNA, 783 bp, Homo sapiens
  misc_feature: GZ8MTXP02HP9C0.21.22.B11.1.454.CMB.2.raw
  modified_base (202)..(202): a, c, t, g, unknown or other
  misc_feature (202)..(202): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagcccaccctcagcgtcgtcggggacccccggnaggagggtccaccattctctttgttcgtgggaggaccaaactccaaactagtacggaaagttaattatgttattcgtaggtactcagaccaaacctcccgaaggaactccggaccccctaaactccctacactaccaaggaaaggaaataagtccaacggcccgtcccgtaccggtaccggggtcccgtccgaaccggtaccttcctccgtcgtaccctcgtaacgttctcgggtaccaccctacgccgtccccttacccgactaccaacgtccgtacggtcggggtccgtcccgggtcccgggaggtaagtcggtaacgggtcctagtaactttaactttacgttaggttcggacctacggttaacggaccgggtaacggaccaacgtaaggttagggaacttaggaactaaacggtcgtaggggtaacgggttccgggggtttagggggttacgggttcccgggggaaacgggggtaaccccgggggtaaaacggtaaaacccggttcccgggtaacccggtttaacccgggtaacgggtttacccggaaaccggttaacccccgggtaaacccggggg

SEQ ID NO: 310904 - DNA, 549 bp, Homo sapiens
  misc_feature: GZ8MTXP02GBNDZ.21.22.B11.1.454.CMB.2.raw
  modified_base (481)..(481): a, c, t, g, unknown or other
  misc_feature (481)..(481): n is a, c, g, or t
  modified_base (512)..(512): a, c, t, g, unknown or other
  misc_feature (512)..(512): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagcctgcctccgtgtctggtctcccgggcagtcggtcaccatctcttgcgctggatccagcgatgatattggtacgttttaaccttgtctcctggtatcaacaacacaggaacaaacgaccccaaaactcttaatttctggctacaatcacgccgaccctcactatcgtttcccagtctatctctgctagtccaaagtctacggacaaacgacggtccctttactgaactaatcctactacaactccgagctagaaagacgagtacttaatttatactcgtacctctacattacgctaggtcgactaacttntttttcgttgggttttggccggtcggtaccngtactcgactcgtactcacgtcacgtaccaggtcccg

SEQ ID NO: 310905 - DNA, 615 bp, Homo sapiens
  misc_feature: GZ8MTXP02FRNML.21.22.B11.1.454.CMB.2.raw
  modified_base (201)..(201): a, c, t, g, unknown or other
  misc_feature (201)..(201): n is a, c, g, or t
  modified_base (298)..(298): a, c, t, g, unknown or other
  misc_feature (298)..(298): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtcgtcggggacccccggnagagggtcaccatctcttgttctggagcaactccaacatacggaagtaattatgtattctgtatcagcaactccaggaactccggaccccaactccncactccagagaatatcagccggcctcgacgggtcctcgaccgtacttctcgtcgcctacgaacgtctcggccacctcaccgtccctacctacgacctacgtcgtacggtcgggaccgtcccgggtaccggaggacgtcggaacgggtctagtacgttagttaccgtgtacgctacgtacgggacggacgacaacgagtacgggatacgaactaacgtcgtaggagggttcgggttggggttcggttaccggggacgggaacggtaaaccgaaaccgttcgtaaccggtccgtacggtaccgaacggcccgtaaacgg

SEQ ID NO: 310906 - DNA, 611 bp, Homo sapiens
  misc_feature: GZ8MTXP02GKDKC.21.22.B11.1.454.CMB.2.raw
  modified_base (199)..(199): a, c, t, g, unknown or other
  misc_feature (199)..(199): n is a, c, g, or t
  modified_base (384)..(384): a, c, t, g, unknown or other
  misc_feature (384)..(384): n is a, c, g, or t
  modified_base (435)..(435): a, c, t, g, unknown or other
  misc_feature (435)..(435): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctgggacccccgggnagagggtcaccatctcttgttctggaggcaactccaacatcggaagtaattatgtattctggtatcagcaactccaggatcgaccccaactcctcatccagagaataatcagccgcctcgacggggtcctgaccgacttctcgtgcctacgaagttctggccacctcacgccctccctgacccanccgaggtcgggcctcccgggtcgaggactggaggcctagaccttagttacngtcgacagtccgaacggggaccacgaaactggtacggggataggaaacctaagttccgtaggagggtccggggtttgggggtcggttaccggggaacgggtaacggggaaaccctaaaacggtcggtaaaccccggttacccggtaaggtaccgaaccgggacccctaaaccgggg

SEQ ID NO: 310907 - DNA, 589 bp, Homo sapiens
  misc_feature: GZ8MTXP02GGZB3.21.22.B11.1.454.CMB.2.raw
  modified_base (199)..(199): a, c, t, g, unknown or other
  misc_feature (199)..(199): n is a, c, g, or t
  modified_base (502)..(502): a, c, t, g, unknown or other
  misc_feature (502)..(502): n is a, c, g, or t
  modified_base (524)..(524): a, c, t, g, unknown or other
  misc_feature (524)..(524): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctcgggacccccggnagagggtcaccatctcttgttctggagcaactccaacatcggaaagtaattatgtattcgtggtatcagacaactccaaggaactccggacccccaaactccctacactacccaaggaaggtaaataacgtcaacggccggtccccgtacgaccggggtccctcggaccgtacttcctcgtcgcctaccgagtctcggcacctcacgtccctcctcgaccctagtctaggtcgggtacctcccgggtccgaggctggacggtctagtacttattacgtgtcgcacgtcggacggacacgaacngtacggatagactaatcgtagnggtcgggttgggcgttacgggcggacggaaccaacgtcgaccgtacgaggccgacgtaccgacgg

SEQ ID NO: 310908 - DNA, 596 bp, Homo sapiens
  misc_feature: GZ8MTXP02HDXJI.21.22.B11.1.454.CMB.2.raw
  modified_base (201)..(201): a, c, t, g, unknown or other
  misc_feature (201)..(201): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagcccaccctcagcgtcgtcgggacccccggnagagggtcaccatctcttgttctggagcaactccaacatacggaagtattatgttattctggtatcacgacaacctcccgaaggactccggacccccaaactcctacactccaagaaggaataatcacgccggccctcggacgggtccctcgaccgtacttctcgtcggcctaccgaacgtctcggaccaccgtcaccgtccctacccgtacgacctactcgtacggtcggccgtccgggtccgaggacgtggacggctgacttagtctgtcacgtagtaccggacggaccaccaaggagtagggatacgacaagtcgtaggtaggtcggggttggtcggtacggggacgaacggtaaccgaacgtcgaccgttacggagtaccacgaccgacgg

SEQ ID NO: 310909 - DNA, 724 bp, Homo sapiens
  misc_feature: GZ8MTXP02I2QLZ.21.22.B11.1.454.CMB.2.raw
  modified_base (199)..(199): a, c, t, g, unknown or other
  misc_feature (199)..(199): n is a, c, g, or t
  modified_base (235)..(235): a, c, t, g, unknown or other
  misc_feature (235)..(235): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctgggacccccgggnaggaggtcacatctcttgtcgtggagcaactccaanagtacggaaattaattatgttattcgtagtatcagacaacctaccgaaggaactcccggaaccccctaaactccctacaactaccgaaaggaacgtaaaataactacgaacggcccggtaccccgtacggtaaccggggtcccctacggtacccgtactttaccgtcgtcgtacccttaccgtaacgttccgtcgggaccctaaccctacgacccgtccccttacccgtacgtaaccctaacgtcgtacggtccggggtaccgtacccggggtacggaggtacgtacggacggtacttacgtaacctttaaacgtttacgtcgtacgacctacggtaccgggaaacgggaacctacgaaacgtggtagggactaacgaaactaagttcgtagggacgggttcggggtttaggggtacggtaccggggaacgggtaaacggaaacctaaacgtcggtaaccggtacgtagggtacaccggaacccgaagg

SEQ ID NO: 310910 - DNA, 583 bp, Homo sapiens
  misc_feature: GZ8MTXP02FHSGH.21.22.B11.1.454.CMB.2.raw
  modified_base (218)..(218): a, c, t, g, unknown or other
  misc_feature (218)..(218): n is a, c, g, or t
  modified_base (369)..(369): a, c, t, g, unknown or other
  misc_feature (369)..(369): n is a, c, g, or t
  modified_base (379)..(379): a, c, t, g, unknown or other
  misc_feature (379)..(379): n is a, c, g, or t
  modified_base (534)..(534): a, c, t, g, unknown or other
  misc_feature (534)..(534): n is a, c, g, or t
tcagtcgtcgctcgcacgaccggtgctcgatttagacgacagctcagggagcttcagctgtggtagagaagacaggactcaggacaatctccagcatggccggcttccctctcctcctcaccctcctcactcactgcgcagggtcctgggcccagtctgtgctgactcagccaccctcagcgtctggaccccggcagagggtcaccatctcttgttcnggaggcaactccaacatcggaataattatgtattctggtatcagcaaactcccaggaactcggacccccaaatcctacatcccagaggaaataatcagcggccctcgaggggtccctgaccgattctctggcctccaagtctggccacctnacgccttccngaccatcagtgggctccggtcgagatgacggctgacctattactgtgaccagtaccgaacggggccacgaaacagtggggaaatgaaccaaaatcgtagaggtccgggtttgggggtcgtttccggggacgggaacggggacccctaaaaacggnggtaacccccgttaccgtaaggggtccaaaacggcccccgtaaaacggg

SEQ ID NO: 310911 - DNA, 573 bp, Homo sapiens
  misc_feature: GZ8MTXP02FZTS2.21.22.B11.1.454.CMB.2.raw
  modified_base (199)..(199): a, c, t, g, unknown or other
  misc_feature (199)..(199): n is a, c, g, or t
  modified_base (294)..(294): a, c, t, g, unknown or other
  misc_feature (294)..(294): n is a, c, g, or t
  modified_base (308)..(308): a, c, t, g, unknown or other
  misc_feature (308)..(308): n is a, c, g, or t
  modified_base (480)..(480): a, c, t, g, unknown or other
  misc_feature (480)..(480): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctcgggacccccggnagagggtcaccatctcttgttctggagcaactccaacatacggaaagttaattatgtattctggtatcagcaactccaggatcgaccccaatccncatccagagaatancagccgcctcgacggggtccctgaccgtacttctcgtcggtacctaccaagttcgtggccacctcgaccgtccctaccctgacctactcgacggtcgggccctccgggtcgacggactcggaacggtctacgtacttattacgtgtcgacacgtcgaacgggaccacaacgngtagggatacgaacagtcgaggagtcgggtttggacggttacgggacggtacggaaaccaagtcggaccgtacgagtaccgacgacccgaagg

SEQ ID NO: 310912 - DNA, 649 bp, Homo sapiens
  misc_feature: GZ8MTXP02JIOH7.21.22.B11.1.454.CMB.2.raw
  modified_base (198)..(198): a, c, t, g, unknown or other
  misc_feature (198)..(198): n is a, c, g, or t
  modified_base (291)..(291): a, c, t, g, unknown or other
  misc_feature (291)..(291): n is a, c, g, or t
  modified_base (326)..(326): a, c, t, g, unknown or other
  misc_feature (326)..(326): n is a, c, g, or t
  modified_base (335)..(335): a, c, t, g, unknown or other
  misc_feature (335)..(335): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctgggacccccggnagagggtcaccatctcttgttctggagcaactccaacatcggaagtattatgtattctggtatcagcaactcccaggatcggaccccaatccncatccagagaataatcacgccgcctcgacggtccncgactctcncgcgctacacgtcgtcgcctacctcgaccgtccctcctacgacctacgtcgacgggtccggccgtacccggtacggagtacgtagggaccgtacgtacggtacctttaaagttccggtgggttaccacgtaccgtaccggggaaacccgggtacaaccgaaaccgttaggggaggtaaacttacgggaaaacctaggttaaccggtgggtaccgggggttgggggtttacggggtcggttaccgggggaacgggttaccggaaactaaacggtccgtaacccggttacgaggtcccgaaccggtacgtaaccgg

SEQ ID NO: 310913 - DNA, 615 bp, Homo sapiens
  misc_feature: GZ8MTXP02JALFA.21.22.B11.1.454.CMB.2.raw
  modified_base (199)..(199): a, c, t, g, unknown or other
  misc_feature (199)..(199): n is a, c, g, or t
  modified_base (221)..(221): a, c, t, g, unknown or other
  misc_feature (221)..(221): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctcgggacccccggnagagggtcaccatctcttttcnggagcaactccaacatcggaagtaattatgtattctggtatcagcactcccagatcggaccccaaactcctcactccagaggaatatcagccggccctcgacgggtccctagaccgtattcctcgtcgcctacagtctggcctacctcacgtccctcctacgacctatacgaggtcggggtcctcccggggttaccgaggtatcgggaacggtctaggaaccttattacgtgtcgactacgtaccgaacggggacaccgaaagtaggtgggaatcggaaataacgtcgtaggacggtcgggggtttagggtcgttacgggggccgggtaaacgggaacctaaaacggtcggacccgtacgttacgggacaaccgggaccccgaagggtcccccg

SEQ ID NO: 310914 - DNA, 604 bp, Homo sapiens
  misc_feature: GZ8MTXP02HQCQG.21.22.B11.1.454.CMB.2.raw
  modified_base (201)..(201): a, c, t, g, unknown or other
  misc_feature (201)..(201): n is a, c, g, or t
  modified_base (236)..(236): a, c, t, g, unknown or other
  misc_feature (236)..(236): n is a, c, g, or t
  modified_base (399)..(399): a, c, t, g, unknown or other
  misc_feature (399)..(399): n is a, c, g, or t
  modified_base (449)..(449): a, c, t, g, unknown or other
  misc_feature (449)..(449): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagcccaccctcagcgtcgtcgggacccccggnagaggtcaccatctcttgtctggagcaactccaanatcggaagttaattatgtattcgtggtatcagcaacgtcccaaggactccggacccccaaatcctacactccagagaatatcagccgcctcgacgggtcccagacctacttctcgtcgaccttactaacgttctcggacctaccctacaccgtcccctcccgngacccagttccgacggttcggaccgtcccgggtccgaggtctggacggtnttacgaacttagttacctgtacgcatacggaccgggactacgaacgtagtcgggaattgaaacaattcgtagggtaggtccggggttgggtacgttccggggaacgtagggaaccctaaacggtcgaaccgttcgaggtaccacggaccgtacgg

SEQ ID NO: 310915 - DNA, 628 bp, Homo sapiens
  misc_feature: GZ8MTXP02HASHS.21.22.B11.1.454.CMB.2.raw
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctcggggacccccggcagagggtcaccatctcttgttctggaggcaactccaacagtacggaagtaattatgtattcgtggtatcagcaactcccaaggaactcgacccccaatcctcactccagaagaataatcacggccgcctcgaacggggtcccctaggacctacttcctcgtacggcctaccgaacgtcgtggaccaccctcaccgtcccctcccgtacgacccattcgacggtcgggtccctcccgggtccgaaggtacgtggacgggtactagtaaccttatttaccgtgttacgacacgtaccgggaacggaccgacgaaacgtagtacggggtatacgaaactatcgtagggtacggtcggggtttgggtacggtcgggaacgggtacgaaaccgtaacgtcggacccgttacgtaggcccaacggcctaacggg

SEQ ID NO: 310916 - DNA, 632 bp, Homo sapiens
  misc_feature: GZ8MTXP02HL4QA.21.22.B11.1.454.CMB.2.raw
  modified_base (335)..(335): a, c, t, g, unknown or other
  misc_feature (335)..(335): n is a, c, g, or t
  modified_base (356)..(356): a, c, t, g, unknown or other
  misc_feature (356)..(356): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagcccaccctcagcgtcgtcggggacccccgggcaggacgggtcaccatctcttgttctggagcaactccaacatacggaagttaattatgtattctggtatcagacaacctcccaaggaactccggaccccctaaactccctacactaccaagaaggtaaataancagccgcctcgacggggtccngtaccattcctcgtcgtacctcgaagtctggccactccacgtccctccacgaccagtcgaggtcggcccgtccgggaccgaggtactcggacgtctacgtacttattaccgtgtcgtacgacgtacgggaccggaaccgacgtaaacgaggtacgggatacgactaagtcgtaggacgggttcgggtttaggggtcggttaccggggacgggtacgggtaaaacccaaagttccggtaaccgttaccggtacggtaccgaaccggtacccgaacgg

SEQ ID NO: 310917 - DNA, 589 bp, Homo sapiens
  misc_feature: GZ8MTXP02JSD7G.21.22.B11.1.454.CMB.2.raw
  modified_base (311)..(311): a, c, t, g, unknown or other
  misc_feature (311)..(311): n is a, c, g, or t
  modified_base (418)..(418): a, c, t, g, unknown or other
  misc_feature (418)..(418): n is a, c, g, or t
  modified_base (459)..(459): a, c, t, g, unknown or other
  misc_feature (459)..(459): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctgggacccccggcagagggtcaccatctcttgttctggagcaactccaacatcggaataattatgtattctggtatcagcaactcccaggaactcggacccccaaatcctcactccagagaataancagccgcctcgacggggtccctggaccgacttcgtctggcctaccgaagttctcggccacctcacgtccctcctgacccatccaggtcgggcctccgggtccgaggntggagctgtactattctgtcgcagtcgacgggacacgaacngtagggatacgaacaacgtcgtaggtaacgggtcggggtttggggtacggttccgggggaccgggtaacgggtaacccgaaacggtcggtaacccggtaccgtaaggtcccgaacggtccccgaaacggg

SEQ ID NO: 310918 - DNA, 617 bp, Homo sapiens
  misc_feature: GZ8MTXP02HF0JU.21.22.B11.1.454.CMB.2.raw
  modified_base (198)..(198): a, c, t, g, unknown or other
  misc_feature (198)..(198): n is a, c, g, or t
  modified_base (330)..(330): a, c, t, g, unknown or other
  misc_feature (330)..(330): n is a, c, g, or t
  modified_base (341)..(341): a, c, t, g, unknown or other
  misc_feature (341)..(341): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctgggacccccggnagagggtcaccatctcttgttctggagcaactccaacatcggaagtaattatgtattctggtatcagcaactccagatcggacccccaaatcctcactccagaggaataatcagccgcctcgaggggtcccngaccgacttcnctcgctcaagtctcggcctacctcacgcctccctgaccatcgaggtcggccgtccggtccggagtagtcgtaacgggctacggacttacttaacgtgtcggactactccgggaaccggccacgaacgagttaggggactcggaaacctagttccgaagggtcgggtaccggggtttgggggttccggttacgggggaccggtaacggggtaaacccgtaaacggttccggaacccgttaccggtaacggtacccgtaaccggaccccgtaaccggg

SEQ ID NO: 310919 - DNA, 644 bp, Homo sapiens
  misc_feature: GZ8MTXP02G2XDR.21.22.B11.1.454.CMB.2.raw
  modified_base (197)..(197): a, c, t, g, unknown or other
  misc_feature (197)..(197): n is a, c, g, or t
  modified_base (342)..(342): a, c, t, g, unknown or other
  misc_feature (342)..(342): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccacctcagcgtctgggacccccggnagagggtcaccatctcttgttctggagcaactccaacatcggaagtaattatgtattctggtatcagcaactccaggatcggaccccaaatcctacactccagagaataactcacgcgcctcgacggggtccctgaccgattccncgtacgccttacccgtaagttccgtcggacctaccgtcaccgtccctcccgtagacccctagtccgaggttcgggaccttcccggggaccgaaggtcgtggaacgtcttaggacttacttacgtgtacgacacgtccgaacggggtaccacgaaactggtacgggattacggaaaccttaacgtgttacggagggtccgggggtttaggggtacgtttccgggggaacggggttaacggtaaacccgaaaccggttcggaacccggttaccggtaacggtccgaaacgtccccggaaacggg

SEQ ID NO: 310920 - DNA, 598 bp, Homo sapiens
  misc_feature: GZ8MTXP02HSK0Z.21.22.B11.1.454.CMB.2.raw
  modified_base (467)..(467): a, c, t, g, unknown or other
  misc_feature (467)..(467): n is a, c, g, or t
  modified_base (497)..(497): a, c, t, g, unknown or other
  misc_feature (497)..(497): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtcgtgggaccccccgggcaggagggtcaccatctcttgtcgtggaggcaactccaacatcggaagtaattatgtattctggtatcagcaactcccgaggtaaactccggacccccaaactcctacactaccagaaggaatatcagccggccctcgacgggtccctgaccgtcttcctcgtcggctacgaacgtctcggactaccctcacgtccctccctagaccctatcaggtcgggtacctcccgggtaccgagagtcggacggctacgaacttactttacgnggtcgtacagtaccggacggacgaccaagngtacgggactgaactaagtcgtaggaggtccggggttggtacggtccgggacggtaaggaccctaaaaggtcgaccgtcgtaggccgtacgacccgtacgg

SEQ ID NO: 310921 - DNA, 598 bp, Homo sapiens
  misc_feature: GZ8MTXP02G4A8Q.21.22.B11.1.454.CMB.2.raw
  modified_base (198)..(198): a, c, t, g, unknown or other
  misc_feature (198)..(198): n is a, c, g, or t
  modified_base (236)..(236): a, c, t, g, unknown or other
  misc_feature (236)..(236): n is a, c, g, or t
  modified_base (375)..(375): a, c, t, g, unknown or other
  misc_feature (375)..(375): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctgggacccccggnagagggtcaccatctcttgttctggagcaactccaacntcggaagtaattatgtatctggtatcagcaactcccaggaatcggacccccaaatcctcatccagaggaataatcagccgacctcgaggggtcccctgaccgtattctctgctccaagtctggccactcacgccctccngacccatcgacggtcgccgttcccggacgagcgtggacgtctacgtacttaaacttcgtaggtcgtacgtacgtaccgggaaaccggggacctacgaaacgtaggtgggtaacaggaaactaatcgtaggaggtcggggtttggggtacgttcggggaacgggaacggaaaaccgtaacgtcgggtaaccccgtacggttaggacccgacggacccgaacggg

SEQ ID NO: 310922 - DNA, 795 bp, Homo sapiens
  misc_feature: GZ8MTXP02IDPOV.21.22.B11.1.454.CMB.2.raw
tcagtcgtcgctcgcacgaccggtgctcgatttagacgacagctcaggggagcttcagctgtggtagagaagacaggactcaggacaatctccagcatggccggcttccctctcctcctccaccctcctcactcactgcgcagggtcctgggcccagtctgtgctgactcagccaccctcagcgtcgtcgggacccccgggcagacgggtcaccatctcttgttctggaggcaactccaacatcggaaagtaattatgtattctggtatcagcaacctccgaggaactccggaccccctaaactccctacactcccaagaaggtaactaatcgaacggccggtacccctcggaccggggtcccctaggtacccgtacgttcctccgtcggcctaccgtaacgttcctggggacccctacctcccgaccgtccccctccccgtacgtacccctaacgttccggaacggttccgggggtcccgttacccccgggggtacccggaagggtacggttacggggaaccgggtccgttaaacgggtaacctttaaacggtttaaaccgttcggtacggtaccgtaacgttacccgggaaccggggaccgaaaccgtaaacgtagggttacggggaagttacggaaaacgtaacgtttaccggtagggtacggggttccggggttttagggggttccgggttaccgggggaaccggggtaaccggggtaaaacccgtaaaaccggttccggaaaccccggttccgggtaacggttacccgaaccggtacccgtaacccgggg

SEQ ID NO: 310923 - DNA, 578 bp, Homo sapiens
  misc_feature: GZ8MTXP02IRATE.21.22.B11.1.454.CMB.2.raw
  modified_base (199)..(199): a, c, t, g, unknown or other
  misc_feature (199)..(199): n is a, c, g, or t
  modified_base (237)..(237): a, c, t, g, unknown or other
  misc_feature (237)..(237): n is a, c, g, or t
  modified_base (329)..(329): a, c, t, g, unknown or other
  misc_feature (329)..(329): n is a, c, g, or t
  modified_base (341)..(341): a, c, t, g, unknown or other
  misc_feature (341)..(341): n is a, c, g, or t
  modified_base (352)..(352): a, c, t, g, unknown or other
  misc_feature (352)..(352): n is a, c, g, or t
  modified_base (466)..(466): a, c, t, g, unknown or other
  misc_feature (466)..(466): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctcgggacccccggnaggagggtcaccatctcttgttctggagcaactccaanatcggaataattatgtattctggtatcagcaactccaaggatcggacccccaatcctcatccagacgaataatcagcggcctgacgggtccngaccgtattccntgctcaagtcnggcacctcacgtccctccagacccatcgaggttcgggccctccgggtaccgaggtactcggacggctgaacttagttaccgtgtaggccaagccggaaccgggcacgtaaacgnggtgggaactcggaaactaacgttcgtaagggcggttcgggtttagggtaacgttccgggggacggtaacgggaacccaagttcggaaccgttcgaggcaccggtacaacgg

SEQ ID NO: 310924 - DNA, 523 bp, Homo sapiens
  misc_feature: GZ8MTXP02HFNOG.21.22.B11.1.454.CMB.2.raw
  modified_base (291)..(291): a, c, t, g, unknown or other
  misc_feature (291)..(291): n is a, c, g, or t
  modified_base (342)..(342): a, c, t, g, unknown or other
  misc_feature (342)..(342): n is a, c, g, or t
  modified_base (417)..(417): a, c, t, g, unknown or other
  misc_feature (417)..(417): n is a, c, g, or t
  modified_base (428)..(428): a, c, t, g, unknown or other
  misc_feature (428)..(428): n is a, c, g, or t
tcagtcgtcgctcgcacgaccggtgctcgatttagacgacagctcagggtggggtcaaaaacccggggagggggtctgatttgcatggatggactctccccctctcagagtacgaagagagggagagatctgggggaagctcagcttcagctgtggtagagaagacaggactcaggacaatctccagcatggccgcttccctctcctcctcaccctcctcactcactgcgcagggtcctgggcccagtctgtgctgactcagccaccctcagcgtctcgggaccccccggnagacggtcaccatctcttgtctggaggcaactccaacatcggaagtaattntcgtatctgtatcagcactccagactcgacccccaatcctcatccagagatatcagtcgccctcgacgggtcccngaccgattccncgttgcctccgaagtcctcggccacctcaccgccctccctcgaccagtcacggtcggcgtccggtccgagactgacggctgaccttatactgtcg

SEQ ID NO: 310925 - DNA, 518 bp, Homo sapiens
  misc_feature: GZ8MTXP02FG4RF.21.22.B11.1.454.CMB.2.raw
  modified_base (311)..(311): a, c, t, g, unknown or other
  misc_feature (311)..(311): n is a, c, g, or t
  modified_base (321)..(321): a, c, t, g, unknown or other
  misc_feature (321)..(321): n is a, c, g, or t
  modified_base (340)..(340): a, c, t, g, unknown or other
  misc_feature (340)..(340): n is a, c, g, or t
  modified_base (434)..(434): a, c, t, g, unknown or other
  misc_feature (434)..(434): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctgggacccccggcagagggtcaccatctcttgttctggaggcaactccaaacatcggaagtaattatgtattctggtatcagcaaactcccaggaatggcccccaaatcctcatccagagaataancagcgccctnaggggtcctgaccgattcnctggctccaagtctggcacctcagccctccctgaccatcagtgggcctccggtccgaggatgaggctagactattactgtgcatcgaggggacncaacagtggggatgacaaatctggagcggttgggtgttcggggcggaggggaccaaaagtgaccgtcgaggtcagcccgaaagg

SEQ ID NO: 310926 - DNA, 730 bp, Homo sapiens
  misc_feature: GZ8MTXP02HE94H.21.22.B11.1.454.CMB.2.raw
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctcgggaccccggcagagggtcaccatctcttgtctggagcaactccaacatacggaataattatagtattctggtatcagacaactcccaggaactcggacccccaaactcctacactaccagaacggaataaactcgaacggccggtccctacgacggggtcccctaggacccgtacttccgtccgtcggacctacccgaaacgttcgtccgggtaccacccttaccgaaccgtccccctttcccgacggaaacccctacgttccgtaaggggtccggggtcccgttcccggggtacccggaaagggtacgttcgggacgggtaccccttaggtacctttaaacgtttacccgttaggtcggtaacctacgttaccgggaaccgggggtaaccaccgaaacgtacggttacggggaattacgaaagtaacgttaggtcggtaagggtccgggtttggggtacggttccggggaacggaacgggaaccctaaacgtccgggtacccgttaccgtaacggggtccaaaaccgtcccgtaaaccggg

SEQ ID NO: 310927 - DNA, 574 bp, Homo sapiens
  misc_feature: GZ8MTXP02JNA1F.21.22.B11.1.454.CMB.2.raw
  modified_base (179)..(179): a, c, t, g, unknown or other
  misc_feature (179)..(179): n is a, c, g, or t
  modified_base (202)..(202): a, c, t, g, unknown or other
  misc_feature (202)..(202): n is a, c, g, or t
  modified_base (234)..(234): a, c, t, g, unknown or other
  misc_feature (234)..(234): n is a, c, g, or t
  modified_base (302)..(302): a, c, t, g, unknown or other
  misc_feature (302)..(302): n is a, c, g, or t
  modified_base (457)..(457): a, c, t, g, unknown or other
  misc_feature (457)..(457): n is a, c, g, or t
  modified_base (504)..(504): a, c, t, g, unknown or other
  misc_feature (504)..(504): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctnagcgtcgtcgggacccccggagnggtcaccatctcttgtctggagcaactcaacngtacggaattaattatgtattcgtgtatcagaccaactcccgaaggaactccggacccccaaactccncactccaagagaataactcaggccgccctggaccggggtccctaggaccgtacttcgtcgtcggacctcaagtctggcccacgtcaccgcccttccagacccagtccaggttcggaccttccgggacgagacgtggacgctacgacttatcgtgnactatcggaacggcgacataggtggaacttgaaacacgttggtacgnggtcgggttagggtccgtggaccggtacggaaccaaggtcgtaaccgtcgtaacggcaccggacgtacgg

SEQ ID NO: 310928 - DNA, 613 bp, Homo sapiens
  misc_feature: GZ8MTXP02FURIU.21.22.B11.1.454.CMB.2.raw
  modified_base (201)..(201): a, c, t, g, unknown or other
  misc_feature (201)..(201): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtcgtcgggacccccgggnaggagggtcaccatctcttgttctggagcaactccaacatcggaagtaattatgtattctggtatcagcaactcccaaggaactcggacccccaaactcctcactccaagagaataatcagccgcctgacggggtcctgaccgattctctggcctacagtctcggccacctcgaccgtccctccgtacgaccctatccgaggtcgggcctccgggtcgaggatggacgtcgtacgacttaagttaccgtgtacgcgtacgtaccggaacggggtaccacgaaacgtggtacggggtatacggaaactaagttcgtagggacggttcgggggtttgggtcggttaccgggacggggaacgtaaccgaaaacgtcggaacccgttcgtaacggtcgaaccggcccgtaaacggg

SEQ ID NO: 310929 - DNA, 553 bp, Homo sapiens
  misc_feature: GZ8MTXP02FQ294.21.22.B11.1.454.CMB.2.raw
  modified_base (198)..(198): a, c, t, g, unknown or other
  misc_feature (198)..(198): n is a, c, g, or t
  modified_base (253)..(253): a, c, t, g, unknown or other
  misc_feature (253)..(253): n is a, c, g, or t
  modified_base (439)..(439): a, c, t, g, unknown or other
  misc_feature (439)..(439): n is a, c, g, or t
  modified_base (458)..(458): a, c, t, g, unknown or other
  misc_feature (458)..(458): n is a, c, g, or t
  modified_base (463)..(463): a, c, t, g, unknown or other
  misc_feature (463)..(463): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctgggacccccggnagagggtcaccatctcttgttctggagcaactccaacatcggaatatatgtattntgtatcagcaactcccagaatcgaccccaaactcctcatccagagaataatcagccgcctcgacggggtccctagaccgacttcctcgtggcctaccaagttctcggccaccctcacgtccctcccgtgacccatcgaggttcgggccttcccgggtccgaggatcggaggctagacttattacgngtgctagtccgacgggacncaacngtggatagactaatcgtgaggtcgggttaggtcgttcgggacggacgggaaccaaagtcgaacccgtcgtacggtcaacggcccgaaagg

SEQ ID NO: 310930 - DNA, 563 bp, Homo sapiens
  misc_feature: GZ8MTXP02IRFVC.21.22.B11.1.454.CMB.2.raw
  modified_base (302)..(302): a, c, t, g, unknown or other
  misc_feature (302)..(302): n is a, c, g, or t
  modified_base (479)..(479): a, c, t, g, unknown or other
  misc_feature (479)..(479): n is a, c, g, or t
  modified_base (492)..(492): a, c, t, g, unknown or other
  misc_feature (492)..(492): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtcgtcgggacccccgggcagacgggtcaccatctcttgttctggaggcaactccaacatacggaagttaattatgtattctggtatcagcaactccgaggaactcggaccccaactccncactccagagaataatcacgcgccctcgacgggtccctagaccgacttcctctcggcctacgaacgtctcgggccacctcacgccctccgtcgaccatcacggtgggccgtccggtccgaagctaggcgcgtagtacttagttacctgtcgctactcgacggacgcaagagtacggntagacatcgtagnggtcgggttaggtcgtacgggacggacggtaccgaacgtcggaccgtacgtacgtcgacggaccgtaacgg

SEQ ID NO: 310931 - DNA, 762 bp, Homo sapiens
  misc_feature: GZ8MTXP02FMVR3.21.22.B11.1.454.CMB.2.raw
  modified_base (180)..(180): a, c, t, g, unknown or other
  misc_feature (180)..(180): n is a, c, g, or t
  modified_base (199)..(199): a, c, t, g, unknown or other
  misc_feature (199)..(199): n is a, c, g, or t
  modified_base (236)..(236): a, c, t, g, unknown or other
  misc_feature (236)..(236): n is a, c, g, or t
tcagtcgtcgctcgcacgaccggtgctcgatttagacgacagctcaggggagcttcagctgtggtagagaagacaggactcaggacaatctccagcatggccggcttccctctccctcctcaccctcctcactcactgcgcagggtcctgggcccagtctgtgctgactcagccaccctnagcgtctcgggaccccggnaggaggtcaccatctcttgttctggagcaactccaanatacggaatatatgtattctggtatcagcaactcccaggaactcggacccccaaactcctacactaccagaaggaataactcaagccgtcccgtcgacggggtccctcggaccgtacttccgtctcggccttaccaaggttcctcgggccacccttcaccgtcccctcccgtacgaccctactccgaacggttcggggcctcccggggttacccgagggtactggtaacgggtccttaggactttaaacgtttccgtacgggttacgaccgttaaacgtacccgggaaacgggggaacctaaccgaaaaccggttaacggtagggggttaaaccttaagggaaaaccctaaaacggtttcccgttaaaagggggtacgggggttcccggggttttaaggggggttccgggtttaaccggggggaaaccgggggtaaccgggaaaaccccgtaaaaaggttcccggtaaaacccccggtttacggttaaccggggtaccgtaaacccggaccccggtaaaaccgggg

SEQ ID NO: 310932 - DNA, 631 bp, Homo sapiens
  misc_feature: GZ8MTXP02GKEC3.21.22.B11.1.454.CMB.2.raw
  modified_base (294)..(294): a, c, t, g, unknown or other
  misc_feature (294)..(294): n is a, c, g, or t
  modified_base (297)..(297): a, c, t, g, unknown or other
  misc_feature (297)..(297): n is a, c, g, or t
  modified_base (307)..(307): a, c, t, g, unknown or other
  misc_feature (307)..(307): n is a, c, g, or t
  modified_base (327)..(327): a, c, t, g, unknown or other
  misc_feature (327)..(327): n is a, c, g, or t
  modified_base (339)..(339): a, c, t, g, unknown or other
  misc_feature (339)..(339): n is a, c, g, or t
  modified_base (383)..(383): a, c, t, g, unknown or other
  misc_feature (383)..(383): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctcgggacccccggcaggagggtcaccatctcttgttctggagcaactccaacatcggaagttaattatgttattctggtatcagcaactccaggatcgaccccaatccnacncagagataancagcgcctcgacggggtccngaccgtacttcncgtgcctacaagtcgtgccaccgtcaccgccctccctgaccctncgaggtcggcctcccggacgaggctgacggtctacgtaacttagttacgtgtacgctaagtccggaacggggaaccacgaaacgtaggtacggggaattacgaaacgtaaacgtcggttacgggaagggtttccgggggtttaggggttacgggtttacccgggggaacgggtaacggggtaaaaccctaaaacggttccggtaaacccggttccggttaacggtaccgaaccggtaccccgaacggg

SEQ ID NO: 310933 - DNA, 598 bp, Homo sapiens
  misc_feature: GZ8MTXP02GCCZ0.21.22.B11.1.454.CMB.2.raw
  modified_base (200)..(200): a, c, t, g, unknown or other
  misc_feature (200)..(200): n is a, c, g, or t
  modified_base (259)..(259): a, c, t, g, unknown or other
  misc_feature (259)..(259): n is a, c, g, or t
  modified_base (267)..(267): a, c, t, g, unknown or other
  misc_feature (267)..(267): n is a, c, g, or t
  modified_base (293)..(293): a, c, t, g, unknown or other
  misc_feature (293)..(293): n is a, c, g, or t
  modified_base (306)..(306): a, c, t, g, unknown or other
  misc_feature (306)..(306): n is a, c, g, or t
  modified_base (331)..(331): a, c, t, g, unknown or other
  misc_feature (331)..(331): n is a, c, g, or t
  modified_base (376)..(376): a, c, t, g, unknown or other
  misc_feature (376)..(376): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagcccaccctcagcgtctcgggacccccggnagagggtcaccatctcttgttctggagcaactccaacatcggaagttaatatgtattcnggtatcancaactccaggatcgaccccaactccncatcagagaatancagcgcctcgacgggtcctgaccgnttcctcgtgctacaacgtctcggcacctccacgtccctcccgtanaccctatccgaggtaccgggtcctccggggtaccgaggacgtaggacgggtcacgtaacttattacgtgtcgactacgtacggacgggaaccgacaaacgtggtacgggatacggaaacaacttcgtaggaggttcgggggttggggtcggttcggggaacgggaacggaaaccccgtaaaagttccggaccggttaccgcggtacaccggaccctaacggg

SEQ ID NO: 310934 - DNA, 668 bp, Homo sapiens
  misc_feature: GZ8MTXP02G3BPR.21.22.B11.1.454.CMB.2.raw
  modified_base (201)..(201): a, c, t, g, unknown or other
  misc_feature (201)..(201): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtcgtcgggacccccgggnagagggtcaccatctcttgttctggagcaactccaacatacggaaagttaattatgtattctggtatcagcaactcccaaggaactcggacccccaaatcctacactccaagaagaataactcagccggtcctacgaacggggtccctagaccgtattctcgtcggcctaccgaagttctcggcctacctcgacgccctacctcgaacccatcgaggtcggaccgtcccgggtacgaggactcggacggtctaggtactttaacttaccgttggacgtacctagtccgggaaaccggggacaccaaaacgtggtacggggtaatacggaaactaacgttcggtagggtaacgggtttccggggtttagggggtcggtttccgggggaaacggggtaaccgggtaaaccctaaaacggttcggtaacccggttaaccgtaggtaccgtaaaccggccgtaaaccgggg

SEQ ID NO: 310935 - DNA, 816 bp, Homo sapiens
  misc_feature: GZ8MTXP02HZI6W.21.22.B11.1.454.CMB.2.raw
  modified_base (178)..(178): a, c, t, g, unknown or other
  misc_feature (178)..(178): n is a, c, g, or t
  modified_base (196)..(196): a, c, t, g, unknown or other
  misc_feature (196)..(196): n is a, c, g, or t
tcagtcgtcgctcgcacgaccggtgctcgatttagacgacagctcaggggagcttcagctgtggtagagaagacaggactcaggacaatctccagcatggccggcttccctctcctcctcacctcctcactcactgcgcagggtcctgggcccagtctgtgctgactcagccaccctnagcgtctggacccccggnaggacggtcactatctcttgttctggagacaactcaactagtacggaattaattatgtattcgtagtatcagacaacctaccgaggtaactccgaaccccctaaatccctacactaccgaagaagaaataactcgacggccggtacccgtacggtaccggggtcccaggaccgtacgttcctcgtcggtacctaccgtaaggttcgtcggaccctaacccgtaccgaccgtccccttacccccgtacgaaaccccgtacgtacccgtacgggttacccggggtccccgttaccccgggggtaacccggtaacggggtaacgttacgggaaccgggtacccgtttaacgttaaaccttaacgtttaaccggttcgggtacggtaaccctaacggtacccgggtaaaccggggaaaccgtaaaccgaaaaccgtaaggggtaacgggtaaacttaacgggaaaaccgttaaacgttccgtaaggggttacggggttacggggtttacgggggttacggggttacccggggaaacggggtaaaccggggtaaacccctaaaacgggtccggtaaaccccggttaccggtaaacggtacccggtaaccggaaccccgtaacggg

SEQ ID NO: 310936 - DNA, 664 bp, Homo sapiens
  misc_feature: GZ8MTXP02G6Y0J.21.22.B11.1.454.CMB.2.raw
  modified_base (202)..(202): a, c, t, g, unknown or other
  misc_feature (202)..(202): n is a, c, g, or t
  modified_base (240)..(240): a, c, t, g, unknown or other
  misc_feature (240)..(240): n is a, c, g, or t
  modified_base (313)..(313): a, c, t, g, unknown or other
  misc_feature (313)..(313): n is a, c, g, or t
  modified_base (333)..(333): a, c, t, g, unknown or other
  misc_feature (333)..(333): n is a, c, g, or t
  modified_base (343)..(343): a, c, t, g, unknown or other
  misc_feature (343)..(343): n is a, c, g, or t
  modified_base (382)..(382): a, c, t, g, unknown or other
  misc_feature (382)..(382): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagcccaccctcagcgtcgtcgggacccccgggnagagggtcaccatctcttgttctggaggcaactccaanatcggaagtaattatgtattctggtatcagcaactccaggaactcgaccccaactccacatccagagaatacncagccgcctcgacgggtccngacgacttcncgtagcctacgtagtctggcctacctcacgtcccttccncgaccacgtcgacggttccggccgtcccgggtaccgaggacgttacggacggtcgtaacgtacctttaaggttaccgttaggtcggttaccaacggttacggaaaccgggggacctaaccgaaacgtaggtacgggggtaattacggaaactaaacttggtaacgggacggggttccggggttttaagggggttccgggttacggggaccggggaaaccgggttaaccaaaccggtaccggtaaccgttccggtaacggttccgaaccggacccggtaaccg

SEQ ID NO: 310937 - DNA, 716 bp, Homo sapiens
  misc_feature: GZ8MTXP02HYCMK.21.22.B11.1.454.CMB.2.raw
  modified_base (200)..(200): a, c, t, g, unknown or other
  misc_feature (200)..(200): n is a, c, g, or t
  modified_base (265)..(265): a, c, t, g, unknown or other
  misc_feature (265)..(265): n is a, c, g, or t
  modified_base (306)..(306): a, c, t, g, unknown or other
  misc_feature (306)..(306): n is a, c, g, or t
  modified_base (430)..(430): a, c, t, g, unknown or other
  misc_feature (430)..(430): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagcccacctcagcgtcgtcgggacccccggnagagggtcaccactctcttgttcgtaggaggcactaccaacagtacggaagtaattatgtattcngtatcagcaactccgagaactccgaccccaaactcctacanaccgtaagaaggaataactcgacgccgtacccgtcgtacgggtcccctagtaccgtatttcctcgtcggacctacgtaacgttcgtcgggacctaccctcgaccgtccctccgacgtaaccctntacggtacggtcggggtccctacccgggtaagagggtacaggtacgggcccttagaaacttaacgttttcgagaccggttacaaccggttacggaaaccccgggggtaataaccgtaaacgtagggttacgggtaactaaacgtaacgttaacggttcgggtacgggttagggggttccgggggtttaggggtaccggtaccgggggaaaccggggtaaaccgtaaaacccgtaacggttccggtaaacccgtacgggtaacgtacccgaccggtaaaccccggcg

SEQ ID NO: 310938 - DNA, 791 bp, Homo sapiens
  misc_feature: GZ8MTXP02JOZP2.21.22.B11.1.454.CMB.2.raw
  modified_base (180)..(180): a, c, t, g, unknown or other
  misc_feature (180)..(180): n is a, c, g, or t
  modified_base (237)..(237): a, c, t, g, unknown or other
  misc_feature (237)..(237): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggccctagtctgtgctgactcagccaccctnagcgtcgtcgggacccccggaggagggtcaccatctcttgtctggagcaactccaangtacggaagttattatgtattctagtatcagacactaccgaggactccggacccccaaagtccctacactaccgaggaaggtaaataactcgacgacccggcccgtacgaccggggtccctaggtaccgtacttccgcgttcggcctaccgtagttcgtcgggtccaacccgtccgaccgtcccccttacccgtcgaaaccctacgtaccggaacggttcccgggggtacccccttacccggggttaacccgggtaaggtaccgggttacggaaccggggttaccgttacgtaaaccgtttaaaccgttttaccggttagggtacccggttacgaaacccgttaccgggggtaaacccggggaaccaaccgtaaaccggtagggttaacggggtaatacccgtaaaacgtaaggttccggtaaagggggtacggttccgggggtttaaggggttccgggttaccggggaacggggttaaacccgggaaaccgttaaaacgggtccggtaaacccgggtacctacggggttaccgacccggtaaccggtacccgg

SEQ ID NO: 310939 - DNA, 609 bp, Homo sapiens
  misc_feature: GZ8MTXP02IM1GA.21.22.B11.1.454.CMB.2.raw
  modified_base (202)..(202): a, c, t, g, unknown or other
  misc_feature (202)..(202): n is a, c, g, or t
  modified_base (239)..(239): a, c, t, g, unknown or other
  misc_feature (239)..(239): n is a, c, g, or t
  modified_base (302)..(302): a, c, t, g, unknown or other
  misc_feature (302)..(302): n is a, c, g, or t
  modified_base (393)..(393): a, c, t, g, unknown or other
  misc_feature (393)..(393): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagcccaccctcagcgtcgtcgggacccccgggnagagggtcaccatctcttgttctggagcaactccaanatcggaagtaattatgtattctgtatcagcaacctcccaaggaactccggacccccaactccncactccaagaagaataatcacgccgccctgacggggtcctgacgtattcctgtcgctacgaagttccgtggccaccctcaccgcccctccngacccagttcaggtcggaccttcccgggtacggaggtacgtcggaacgtctagtaacctttagttaccgttggtcgacctagtaccggaaccggggacacaacgtaggtagggactagaaactaagttcgtaggtaggtcgggggtttaggggtcggttacggggacgggaagtaaccgaaacgtcgaccggttacgaggtccgacgaccgaacgg

SEQ ID NO: 310940 - DNA, 676 bp, Homo sapiens
  misc_feature: GZ8MTXP02H6PLC.21.22.B11.1.454.CMB.2.raw
tcagtcgtcgctcgcacgaccggtgctcgatttagacgacagctcaggggagcttcagctgtggtagagaagacagaactcaggacaatctccagcatggccggcttccctctcctcctcaccctcctcactcactgcgcagggtcctgggcccagtctgtgctgactcagccacccctcagcgtcgtcgggaccccccgggcaggacgggtcaccatctcttgttctggagcaactccaacatcggaaagtaattatgtattctgtatcagcaactcccagaatccggacccccaaactcctacactccaagaagaataatcagccggtccctacggacggggtccccagtaccgtacttcctcgtcggcctacgaacgttcctcggctaaccctcgaccgtccccgtccctacgaacctacgtcgtacggttcgggcccgttacccggggcccgaaagggtccgttaggggaccggtacgttacgtaacctttaagtttacgttcgttaggaccttacgtaccgggaaaccgggaccgtaaccaaacgtaggagggtacctaggaaactaacgttcgtggtacggttcgggttggtttacggtacgggaccgggtacggaaaccctaaacggtccggtaaccgtacggtacgtacccgacgtaacccgaaccgg

SEQ ID NO: 310941 - DNA, 784 bp, Homo sapiens
  misc_feature: GZ8MTXP02FYYMP.21.22.B11.1.454.CMB.2.raw
  modified_base (201)..(201): a, c, t, g, unknown or other
  misc_feature (201)..(201): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagcccaccctcagcgtcgtcgggacccccggnagagggtcaccatctcttgttctggagcaactccaacagtacggaaagttaattatagttattcgtggtatcagcaactcccgaaggactccggacccccaaactccctacactaccgaaggaaggtaaataactaccgaacggcccggtaccctacggtaccggggtcccctacggaacccggttactttccgtccgtacggtacccttaccgtaaacgttccgtcgggaccctacccgttacgaacccgtcccccttacccgtacgaaccctaacgtccggtaacgggttccgggggtacccgttaccccgggggtacccggtaaagggtacggttacgggtaaacgggttacccgttaaacggtaaccttttaaacgttaccggttcggttacgaaccgtacgtaccgggaaacgggtacccgaactaaaacgacggttagggaactaggtaaacctaagttccggtagggtacgggtttcggggttggggttaccggttacggggacgggaaccgggtaaacccaaacggttccggtaaccccggttacgtacgggtaccaccgggaacccgtaacggg

SEQ ID NO: 310942 - DNA, 616 bp, Homo sapiens
  misc_feature: GZ8MTXP02IFMYD.21.22.B11.1.454.CMB.2.raw
  modified_base (199)..(199): a, c, t, g, unknown or other
  misc_feature (199)..(199): n is a, c, g, or t
  modified_base (236)..(236): a, c, t, g, unknown or other
  misc_feature (236)..(236): n is a, c, g, or t
  modified_base (337)..(337): a, c, t, g, unknown or other
  misc_feature (337)..(337): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctgggacccccgggnagagggtcaccatctcttgttctggagcaactccaantcggaagtaattatgtattctggtatcagcaaactcccaggaatcggacccccaaatcctcatcccagaggaataatcagccggcctcgacggggtccccngaccgattcctctcggctcaagtcctgggccactccgacgtccctcctcgaccctatcaaggttcgggacccttccggtcccgaggactggacggcttagacttaagttacgtgtacgactactccgaacgggaccgacgaaaactagttcggggaattacggaaactaaaacgttcgtagggacgttccggggttttaggggtacggtttcggggaccggtaacggaaccgaaaacgttcggacccgtacgttaaggtcccaaggaacccccacgggg

SEQ ID NO: 310943 - DNA, 530 bp, Homo sapiens
  misc_feature: GZ8MTXP02FIHHU.21.22.B11.1.454.CMB.2.raw
  modified_base (198)..(198): a, c, t, g, unknown or other
  misc_feature (198)..(198): n is a, c, g, or t
  modified_base (324)..(324): a, c, t, g, unknown or other
  misc_feature (324)..(324): n is a, c, g, or t
  modified_base (439)..(439): a, c, t, g, unknown or other
  misc_feature (439)..(439): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctgggacccccggnagagggtcaccatctcttgttctggaggcaactccaacatcggaagtaattatgtattctggtatcagcaactcccaggaatggaccccccaaatccctcatccagaggaataatcagcggccctnacggggtccctgaccgattctctggctccaagtctgccacctcacgcctcctgacccatcagtgggcctccggtccgagatgaggtcagactattactgtgcatcgacggggacncaaacagtgggaatgaacaatccgtggagtcgggttgggtcgttcggggcggagggtaccaaagtcgaccgtctaaggcacgtcccaaagg

SEQ ID NO: 310944 - DNA, 640 bp, Homo sapiens
  misc_feature: GZ8MTXP02IJSZS.21.22.B11.1.454.CMB.2.raw
  modified_base (236)..(236): a, c, t, g, unknown or other
  misc_feature (236)..(236): n is a, c, g, or t
  modified_base (544)..(544): a, c, t, g, unknown or other
  misc_feature (544)..(544): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtcgtcgggacccccggcagagggtcaccatctcttgttctggagcactccaanatcgaagtattatgtattcgtgtatacagacaactcccgaaggaactccggaccccccaactcctcactccaagaaggaataatcacgccgccctacgacggggtcccagaccgtagttcctcgtcgtcctaccgtaagtcgtcggaccaccctcgaccgcccccttaccgtcgaacctgtcgtacggtccgggtaccgttcccgggtaccggaggtactgggaacggtctagacttattacgtgtcgactacgtacggaaccggggctaacaacgtgtacggtataacgaactacgttggtaacggngggttcgggggtttagggtcgggttaccggggacggggtaaacgaaccgtaaacgtcggtacccgtacgtacggtacgaccggtaacccgtaccgg

SEQ ID NO: 310945 - DNA, 556 bp, Homo sapiens
  misc_feature: GZ8MTXP02HUN62.21.22.B11.1.454.CMB.2.raw
  modified_base (196)..(196): a, c, t, g, unknown or other
  misc_feature (196)..(196): n is a, c, g, or t
  modified_base (243)..(243): a, c, t, g, unknown or other
  misc_feature (243)..(243): n is a, c, g, or t
  modified_base (381)..(381): a, c, t, g, unknown or other
  misc_feature (381)..(381): n is a, c, g, or t
  modified_base (446)..(446): a, c, t, g, unknown or other
  misc_feature (446)..(446): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccacctcagcgtctgggaccccggnagagggtcacatctcttgtctggagcaactcaacatcgaagtattangtatctgtatcagcaactccagaatcggaccccaaatcctcactccaagaacggaaataactcagtaccggcctacgacggggtcccctaggaccgtacttctctggctcaagtctcggcacctcacgccctccgtanacccatcaggtcggccgtccggtacgagatgagctagactattactgtgacagtcgaacgggacnaaacgtgtgggatagaactaatctaggcggtacggttggggttagtccgggaggtaacggaaacctaaacgtcgacccggtttacaacgggtaccacggtaccccaaggg

SEQ ID NO: 310946 - DNA, 671 bp, Homo sapiens
  misc_feature: GZ8MTXP02HB6CC.21.22.B11.1.454.CMB.2.raw
  modified_base (299)..(299): a, c, t, g, unknown or other
  misc_feature (299)..(299): n is a, c, g, or t
  modified_base (335)..(335): a, c, t, g, unknown or other
  misc_feature (335)..(335): n is a, c, g, or t
  modified_base (384)..(384): a, c, t, g, unknown or other
  misc_feature (384)..(384): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtcgtcgggacccccggcagagggtcaccatctcttgttctggagcaactccaacatcggaagtaattatgtattctggtatcagcaacctccaaggaatccggacccccaaatccncatccagagaataatcagcgccctcgacggggtccngacactctcgtgcctcgagtctcggccacctcacgtccctcctcgaccntcgaggttcggcccgttacccgggtccgaggacgtagggacggtcctaggtaaccttaacgtttacgtcgttcgaccgtaacttccgggaaaccgggggaaccacgtaaaaccgtaggtacgggggaacttacggaaaccttaaacggttccgtaagggtacgggttcgggggttttagggggttacgtttacccgggggaccgggggtaaacgggtaaaccccgtaaacgggttccgtaaacccggttcccgtaaggtacccggaaccggaccccggtaaaccggg

SEQ ID NO: 310947 - DNA, 613 bp, Homo sapiens
  misc_feature: GZ8MTXP02IPMQL.21.22.B11.1.454.CMB.2.raw
  modified_base (199)..(199): a, c, t, g, unknown or other
  misc_feature (199)..(199): n is a, c, g, or t
  modified_base (236)..(236): a, c, t, g, unknown or other
  misc_feature (236)..(236): n is a, c, g, or t
  modified_base (292)..(292): a, c, t, g, unknown or other
  misc_feature (292)..(292): n is a, c, g, or t
  modified_base (305)..(305): a, c, t, g, unknown or other
  misc_feature (305)..(305): n is a, c, g, or t
  modified_base (313)..(313): a, c, t, g, unknown or other
  misc_feature (313)..(313): n is a, c, g, or t
  modified_base (322)..(322): a, c, t, g, unknown or other
  misc_feature (322)..(322): n is a, c, g, or t
  modified_base (331)..(331): a, c, t, g, unknown or other
  misc_feature (331)..(331): n is a, c, g, or t
  modified_base (358)..(358): a, c, t, g, unknown or other
  misc_feature (358)..(358): n is a, c, g, or t
  modified_base (407)..(407): a, c, t, g, unknown or other
  misc_feature (407)..(407): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctcgggacccccggnagagggtcaccatctcttgttctggagcaactccaanatcggaagtattatgtattctggtatcagcaactcccagaatcgaccccaatcctnatccagagaatancagcgccngacggtccngacgtatcncgcgtctacgtactcgcgactacctcnccgtccctcgacacactgacggtcgccgttcccggagagagtcgacgtntacgtaaacttcgttacgtgtcgtaactcgtacccgggaacggcaaaccgtacggaggtacggtaaacgacgtaaacgtacgttcgggtacgggttcggggttacgggttacggggttacgggtaccggggtaaacgggtaaaccgtaaaccgtaacggtacccgtaacccggttacggtacgacccggtaaccgtaccggtaccg

SEQ ID NO: 310948 - DNA, 652 bp, Homo sapiens
  misc_feature: GZ8MTXP02IIFV5.21.22.B11.1.454.CMB.2.raw
  modified_base (202)..(202): a, c, t, g, unknown or other
  misc_feature (202)..(202): n is a, c, g, or t
  modified_base (309)..(309): a, c, t, g, unknown or other
  misc_feature (309)..(309): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagcccaccctcagcgtcgtcggggacccccggnagagggtcaccatctcttgttcgtggaggcaactccaacatcggaagtaattatgtattctggtatacagacaacctccaggaatccgacccccaaactcctctacnccagagaataatcacgcgccctcgacggggtccctgacctaccttctctcgctactaacgtctcggctacctccaccgtccctcctacaccatcgacggttcggccgtccggtaccgaggactggacggctacgtacttaattaccgtggtacgactacgtacggaaccgggactacgaaacgtggtacgggtatacgaaaacttacgttcgtagggtaaacggggtccgggttttagggggtacggtttccgggggaaaccgggtaacgggaaaacccgtaaaaccgtccggggtaacccgttacccggttaaagggtcccgaaccggtacccggtaaccgg

SEQ ID NO: 310949 - DNA, 664 bp, Homo sapiens
  misc_feature: GZ8MTXP02F6PJ9.21.22.B11.1.454.CMB.2.raw
  modified_base (199)..(199): a, c, t, g, unknown or other
  misc_feature (199)..(199): n is a, c, g, or t
  modified_base (234)..(234): a, c, t, g, unknown or other
  misc_feature (234)..(234): n is a, c, g, or t
  modified_base (291)..(291): a, c, t, g, unknown or other
  misc_feature (291)..(291): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctcgggacccccggnagagggtcaccatctcttgtctggagcaactcaantacggaatattatgtattctggtatcagacaactccaggaatcggaccccaactccncactcagagaataatcagccggcctacgacggggtccctacgaccgtacttacctcgtggcctcaagtctgggccacctcacgtccctcccgtcgacctactcgtacggtcgggccgtcccgggtaccgagggatacggacggtacgttcggaaacttacgtttacgtcgtacggtcgtattacccggaacgggaccgaccgtaaacgacgggtagggtaacgtacgaaacgtaaacgttcgtacgggtacgggttccggggtttgggggtacggtttaccgggacggggtaaccgggggttaacccggaaaccgtaaccggtaccggtacccggttaccggtaacggttaacccgaccggtaaaccccgggg

SEQ ID NO: 310950 - DNA, 693 bp, Homo sapiens
  misc_feature: GZ8MTXP02JS5MK.21.22.B11.1.454.CMB.2.raw
  modified_base (179)..(179): a, c, t, g, unknown or other
  misc_feature (179)..(179): n is a, c, g, or t
  modified_base (200)..(200): a, c, t, g, unknown or other
  misc_feature (200)..(200): n is a, c, g, or t
  modified_base (235)..(235): a, c, t, g, unknown or other
  misc_feature (235)..(235): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaacctnagcgtcgtcgggacccccggnaggaggtccacatctcttgtctggagcactccaanatcggaagtaattatgtattctggtatcagactaactcccgaggaatccggacccccaaatcctacactccaaggaaggaaactaacgtccaacggccggtacccctaggaaccgggggttcccctaggaaccgtaccgtttccgtcgtcgggtacctaccgtaaggtcttccgggaccctaccggtccaccgtcccccttacccgttacggaacccctattcccggaaggttccgggacccgttacccggggtaccgacggtagtcggaacgggtccttaaggtaccttaagttaccgtgtcggtacacgtccgggaaacggggaccacgtaaaacgtgggtacggatacggaaacctagtcgtaggacgggtcgggtttaggggtcggtccgggacgggtaacggaaaccctaaggttacggacccggttacgtacggaccgaccgaccgtaacgg

SEQ ID NO: 310951 - DNA, 593 bp, Homo sapiens
  misc_feature: GZ8MTXP02FR0PE.21.22.B11.1.454.CMB.2.raw
  modified_base (199)..(199): a, c, t, g, unknown or other
  misc_feature (199)..(199): n is a, c, g, or t
  modified_base (418)..(418): a, c, t, g, unknown or other
  misc_feature (418)..(418): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctcgggacccccggnagagggtcaccatctcttgttctggagcaactccaacatcggaagttaattatgtattctggtatcagcaactcccaggaatcggacccccaatcctacactccagaggaatatcagccggccctcgacggggtccctgaccgtattcctctcgcctaccaagtctcggccacctcaccgccctccgtagacctatcgaggtcggcctccggtcgaggntggacggtctagacttattacgtgtgaccagtaccggacgggaccacaaacgtaggtacgggatagaactaagtcgtaggtacggtcggggttgggtcggttaccggggacgggtaacgggaacccaaaggtccggtaacccggttcgtacggtaccgaccggacccgtaacggg

SEQ ID NO: 310952 - DNA, 679 bp, Homo sapiens
  misc_feature: GZ8MTXP02JMW9B.21.22.B11.1.454.CMB.2.raw
  modified_base (238)..(238): a, c, t, g, unknown or other
  misc_feature (238)..(238): n is a, c, g, or t
  modified_base (294)..(294): a, c, t, g, unknown or other
  misc_feature (294)..(294): n is a, c, g, or t
  modified_base (381)..(381): a, c, t, g, unknown or other
  misc_feature (381)..(381): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagtccaccctcagcgtcgtcgggacccccggcaggagggtcaccatctcttgtctggagcaactccaanatacggaatattatgtattctgtatcagcaactccaggaactcggaccccaactcncactccaagagaataatcagccgcctcgacggggtcctgaccgtacttcctcgtggcctcgaagtctggccacctcgacgccctccncgaccactcgaggtcgggccttccgggtccgagagtcggacggtctacggtaactttagttaccgtggtcgacctagtacccgggaacggggacctaaccgaaacggtaggttacgggggaatacggtaaaacctaggtttaccggtaggggtaaccggggttcgggggtttaacgggggttacggggtttcccgggggaaccgggggttaaacgggaaaccccgtaaaaccgggttccggaaacccccggtttacggtaacggggtttaccaaaacccggggtcccctaaaccgggg

SEQ ID NO: 310953 - DNA, 570 bp, Homo sapiens
  misc_feature: GZ8MTXP02IT7A2.21.22.B11.1.454.CMB.2.raw
  modified_base (201)..(201): a, c, t, g, unknown or other
  misc_feature (201)..(201): n is a, c, g, or t
  modified_base (239)..(239): a, c, t, g, unknown or other
  misc_feature (239)..(239): n is a, c, g, or t
  modified_base (314)..(314): a, c, t, g, unknown or other
  misc_feature (314)..(314): n is a, c, g, or t
  modified_base (336)..(336): a, c, t, g, unknown or other
  misc_feature (336)..(336): n is a, c, g, or t
  modified_base (365)..(365): a, c, t, g, unknown or other
  misc_feature (365)..(365): n is a, c, g, or t
  modified_base (389)..(389): a, c, t, g, unknown or other
  misc_feature (389)..(389): n is a, c, g, or t
  modified_base (412)..(412): a, c, t, g, unknown or other
  misc_feature (412)..(412): n is a, c, g, or t
  modified_base (435)..(435): a, c, t, g, unknown or other
  misc_feature (435)..(435): n is a, c, g, or t
  modified_base (455)..(455): a, c, t, g, unknown or other
  misc_feature (455)..(455): n is a, c, g, or t
tcagtcgtcgctcgcacgaccggtgctcgatttagacgacagctcagggggagcttcagctgtggtagagaagacaggactcaggacaatctccagcatggccggcttccctctcctcctcaccctcctcactcactgcgcagggtcctgggcccagtctgtgctgactcagcccaccctcagcgtcgtgggacccccggnaggaggttcacatctcttgttctggaggcaactccaanatcggaagtaattatgtattctggtatcagcaactcccagaatcggacccccaaatcctcatccagaggaataancagcgccctcgacggggtcccncgaccgtattcctctcggctccaagttcncggcacctcacgccctcctgaccntcgagtcggctccggtccgaggntgaggctagactattactgtacnatcggaacggcgacaaacgngtaggatgaaacacgtcgtaggtacggtcggggttggggtgttaccggggccggggtaaggaacccgtaaaacgttcggaccccgttacggacggtacgaccggtaccccaaggg

SEQ ID NO: 310954 - DNA, 672 bp, Homo sapiens
  misc_feature: GZ8MTXP02G0FKN.21.22.B11.1.454.CMB.2.raw
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtcgtcgggacccccggcagagggtccaccatctcttgttctggagcaactccaacatacggaataattatgtattctggtatcagcaactcccaggaactccggacccccaaactccctacactaccaagaaggaataaactcacggccggtccctcggaacggggtcccctaggtaccgtacttcctcgtcggtcctaccgtaacgttctcgggacctacccgtcaccgtcccctcccgtcgaaccctatcgacggttcgggccgttcccgggtacggagagtacggacggtactagtacttagttaccgtgtcgacgtacgtacgaaccgggacacaacgagtacggggaactacgaacgtaacgttcggtacgggtagggttccggggtttaggggtcgggttaccggggacggggtaaaccgggaaccgtaaaccggtcggtaacccggttaccgtaagggtacccaaccggaaccccgtacggg

SEQ ID NO: 310955 - DNA, 777 bp, Homo sapiens
  misc_feature: GZ8MTXP02FRBQ2.21.22.B11.1.454.CMB.2.raw
  modified_base (200)..(200): a, c, t, g, unknown or other
  misc_feature (200)..(200): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtccgtgggcccagtctgtgctgactcagccacctcagcgtcgtcgggacccccggnagagggtcaccatctcttgttcgtggaggcaactccaacagtacggaaagttaattatgtattcgtggtatcagacaacctacccaaggaactccggaccccctaaacctcctacactacccaaggaaggaataaactcgaacgcccggaccctcggacggggtcccctaggaccgtacttcctcgtggtcctaccaagtcctcgggcctaacctcgaccgtccctccccgtacgaccctacgtcgacggtcggtcccgtccgggtaccggacggagttcggaacgggtctacgtaacgttacgtttaaacgtcgggttcaccgtacgttacccggggaaaccgggggtaacccgtaaccaaaacgtaggggttacggggaaataaccgggtaaacctaaaagtttccggtggggtaaacccgggggtttcgggggtttagggggtttcggttacccgggggaaacgggggtaacccgggttaaaaccccggaaaacggttccccggggtaaaccccgtttaacccggggttaacggggtaacccccgtaaccggtaacccccgggtaaacccgggg

SEQ ID NO: 310956 - DNA, 530 bp, Homo sapiens
  misc_feature: GZ8MTXP02GWWA3.21.22.B11.1.454.CMB.2.raw
  modified_base (198)..(198): a, c, t, g, unknown or other
  misc_feature (198)..(198): n is a, c, g, or t
  modified_base (348)..(348): a, c, t, g, unknown or other
  misc_feature (348)..(348): n is a, c, g, or t
  modified_base (363)..(363): a, c, t, g, unknown or other
  misc_feature (363)..(363): n is a, c, g, or t
  modified_base (412)..(412): a, c, t, g, unknown or other
  misc_feature (412)..(412): n is a, c, g, or t
  modified_base (431)..(431): a, c, t, g, unknown or other
  misc_feature (431)..(431): n is a, c, g, or t
  modified_base (450)..(450): a, c, t, g, unknown or other
  misc_feature (450)..(450): n is a, c, g, or t
  modified_base (464)..(464): a, c, t, g, unknown or other
  misc_feature (464)..(464): n is a, c, g, or t
  modified_base (471)..(471): a, c, t, g, unknown or other
  misc_feature (471)..(471): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctgggacccccggnagagggtcaccatctcttgttctggagcaactccaacatcggaaagttaattatgtattctggtatcagcaactcccgaaggaactcggacccccaaactcctcactccagagaatatcagcgccctcgacggggtcctgaccgattccngtcggctcaagttcnggtccacctcacgccccttccgcgaccatcaggtggcctccggtcgagntggagctagacttattacngtgcagtcgaggacacaangtggatagactaancgtaggngtcgggttaggcgtcggacggacggacaaagtcgaccgtcgtaggaccacggaccacgg

SEQ ID NO: 310957 - DNA, 730 bp, Homo sapiens
  misc_feature: GZ8MTXP02G3XGK.21.22.B11.1.454.CMB.2.raw
  modified_base (201)..(201): a, c, t, g, unknown or other
  misc_feature (201)..(201): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagcccaccctcagcgtctcggggacccccggnagagggtcaccatctcttgttctggaggcaacctccaacatacggaagtaattatgtattctggtatcagcaacctccaaggaactcggaccccccaaactcctacactaccgaagaaggaaaactaataccgacgggacccggtcccctacggtaaccgggggtcccctacggtaaccgtactttccgtcgtcgggtaccttacccaaaggttcgtccgggccctaaaccccttccgaccggtcccccttaccccttacgggaaaccccctaagtccggtaacgggggtttccgggggccccttacccgggggttacccgaaaggggtaactcggggaacgtcttacgaaacctttattaccgttgtacgacctagtacccggaaaggggacccacgaaacgtggttggggaactacgaaacctaagtttcggaggtacggggttcggggttagggggttcgtacccgggaacgggtaacggaaccaaaacgttcggaaacccgttgtaggacaccgggaccaacggg

SEQ ID NO: 310958 - DNA, 602 bp, Homo sapiens
  misc_feature: GZ8MTXP02IS3TX.21.22.B11.1.454.CMB.2.raw
  modified_base (199)..(199): a, c, t, g, unknown or other
  misc_feature (199)..(199): n is a, c, g, or t
  modified_base (290)..(290): a, c, t, g, unknown or other
  misc_feature (290)..(290): n is a, c, g, or t
  modified_base (322)..(322): a, c, t, g, unknown or other
  misc_feature (322)..(322): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctcgggacccccggnagagggtcaccatctcttgttctggagcaactccaacatcggaagtattatgtattctgtatcagcaactcccagatcggaccccaatccncatcagagaatatcagcgcctcgacgggtccngaccattctctcgctcgagtctggccacctcacgtccctcctcgacccatcaggtcggggccgttcccgggtcgaaggcgttaggacgggtctagacttagttacgtgttcgctacgtccgaaccgggcgacaacgtagtcggggattacgaactaacgttcgtaggtaaggttcggggttttaggggttcggttaccggggacgggtaacgggtaaacccgtaaaacgtccggtaacccgttaccgtaagggtacccgaaacggaaccccgtaacgggg

SEQ ID NO: 310959 - DNA, 664 bp, Homo sapiens
  misc_feature: GZ8MTXP02H8PW4.21.22.B11.1.454.CMB.2.raw
  modified_base (237)..(237): a, c, t, g, unknown or other
  misc_feature (237)..(237): n is a, c, g, or t
  modified_base (349)..(349): a, c, t, g, unknown or other
  misc_feature (349)..(349): n is a, c, g, or t
  modified_base (387)..(387): a, c, t, g, unknown or other
  misc_feature (387)..(387): n is a, c, g, or t
tcagtcgtcgctcgcacgaccggtgctcgatttagacgacagctcaggggagcttcagctgtggtagagaagacaggactcaggacaatctccagcatggccggcttccctctcctcctccaccctcctcactcactgcgcagggtcctgggcccagtctgtgctgactcagccaccctcagcgtctgggacccccggcagagggtcaccatctcttgttctggaggcaactccaanatcggaagtaattatgtattctggtatcagcaactcccaggatcggacccccaaatcctcatccaagaggaataatcagccgacctcgacggggtccctgtaccgacttccncgtggcctcaagtctcggccacctccacgccctacccngacccagtcaggtcgggcctcccgggccggaaggcgttcggacggtaccttgaacttacgtttaccgttgtacgtacgtacgtaccggaaccggggaccgacgtaaaaccaggttacgggggaacttacggaacctaaaacgttccggtaggtaaccgggttcggggtttgggggttacggtttaccgggggacggggttaaccgggaaaccgtaaaaccgttcgggtaaacccggttacggttaacgggacccgtaaccggaccccgttaacgggg

SEQ ID NO: 310960 - DNA, 629 bp, Homo sapiens
  misc_feature: GZ8MTXP02G0G2I.21.22.B11.1.454.CMB.2.raw
  modified_base (200)..(200): a, c, t, g, unknown or other
  misc_feature (200)..(200): n is a, c, g, or t
  modified_base (211)..(211): a, c, t, g, unknown or other
  misc_feature (211)..(211): n is a, c, g, or t
  modified_base (235)..(235): a, c, t, g, unknown or other
  misc_feature (235)..(235): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagcccaccctcagcgtctcgggacccccggnagaggtcaccntctcttgtctggagcaactccaanatacggaatattatgtattctgtatcagcaactccgaaggactccggacccccaaactcctacactccaagaagtaataatcgacgccgcctacggacggggtccctagacctattcctcgtcgcctacgtaagttctcggacctaccctcaccgtcccctcctacgacctatcgacggtcgggcccgtccgggacgaggacgtcggacggtctacgtaacctttaagttcgtaggtctacgtaccggtaccgggaaccgggaaccaacgttaacgaggtagggtatacggaaactaacgtcggtaggacgggtttcgggttggggtcggtacgggaacgggtacggaaacctaacgggttcgacccggttacgacgaccacggacccgtacgg

SEQ ID NO: 310961 - DNA, 581 bp, Homo sapiens
  misc_feature: GZ8MTXP02FYMII.21.22.B11.1.454.CMB.2.raw
  modified_base (199)..(199): a, c, t, g, unknown or other
  misc_feature (199)..(199): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctcgggacccccggnagagggtcaccatctcttgttctggaggcaactccaacatcggaaagtaattatgtattctggtatcagcaactcccaggaatcggacccccaaatcctcatccagagaatatcagccgccctcgacggggtccctgaccgtacttcctcgtaggcctaccaagtctcggccacctcacgccctcctgacccatcgaggtcgggacctccggtcgagactggacggctagtacttattacgtgtagctagtaccggaacggggaccacgtaacgtggtagggactaggaaactaagtccgtggacggttcggggttagggtcggttccggggacgggtacggaaacctaacgtcgtaaccgtcgtacggcaacgccctaacg

SEQ ID NO: 310962 - DNA, 681 bp, Homo sapiens
  misc_feature: GZ8MTXP02HVPM2.21.22.B11.1.454.CMB.2.raw
  modified_base (284)..(284): a, c, t, g, unknown or other
  misc_feature (284)..(284): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcaggtcctgggcccagtctgtgctgactcagccaccctcagcgtcgtcgggaccccggcagacgggtcaccatctcttgtcgtggagcactacaactagtacggtaagttaattatagttattcgtaggtactcaagcctaaccnccgaaggtaacgtcccgaaccccctaaactcccacctactcccgaaagaacggaaataacgtaccgacggcccggtccctacggaccgggttacccctagtacccgtacttccgtacgtcggtacctacgtaacgtcgtccggcctaccctccgacccgttcccaccgtaccgaaccctatacgtcggtacggtcccgtcccgggtaccgaggtacgtggacgtcgttagacgtttaattacgtgtacgtcgacgtaccgggaaccggacgaccaaagtaggagggtactaacggaactagttacgacggtggggttcggttacggggttcgacgggggaacgaccggtaactaacggtccgtaccggtaccgtaggaccacccggttacgacccgg

SEQ ID NO: 310963 - DNA, 536 bp, Homo sapiens
  misc_feature: GZ8MTXP02HE57B.21.22.B11.1.454.CMB.2.raw
  modified_base (179)..(179): a, c, t, g, unknown or other
  misc_feature (179)..(179): n is a, c, g, or t
  modified_base (200)..(200): a, c, t, g, unknown or other
  misc_feature (200)..(200): n is a, c, g, or t
  modified_base (289)..(289): a, c, t, g, unknown or other
  misc_feature (289)..(289): n is a, c, g, or t
  modified_base (302)..(302): a, c, t, g, unknown or other
  misc_feature (302)..(302): n is a, c, g, or t
  modified_base (336)..(336): a, c, t, g, unknown or other
  misc_feature (336)..(336): n is a, c, g, or t
  modified_base (368)..(368): a, c, t, g, unknown or other
  misc_feature (368)..(368): n is a, c, g, or t
  modified_base (456)..(456): a, c, t, g, unknown or other
  misc_feature (456)..(456): n is a, c, g, or t
  modified_base (473)..(473): a, c, t, g, unknown or other
  misc_feature (473)..(473): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctnagcgtcgtcgggacccccggnaggagggtcaccatctcttgttctggagcaactcaacatcggaatattatgtattctggtatcagcaactccagactcgaccccaatcnatccagagaatancagccgcctcgacggggtccagacgtactcgtcngctacgagtctggaccacctcacgtcctccgngaccctatccgaggtcggcctcccgggtacgagacgtggacggctagtacttagttacgtgtcgactagtcccgaagggctacaacgngtggaactgaacagtcnggagtcgggtggtacgtcgggacgacggacaacgtcgtaccgtccagggtcacggaccgtacg

SEQ ID NO: 310964 - DNA, 613 bp, Homo sapiens
  misc_feature: GZ8MTXP02HZ86W.21.22.B11.1.454.CMB.2.raw
  modified_base (179)..(179): a, c, t, g, unknown or other
  misc_feature (179)..(179): n is a, c, g, or t
  modified_base (200)..(200): a, c, t, g, unknown or other
  misc_feature (200)..(200): n is a, c, g, or t
  modified_base (237)..(237): a, c, t, g, unknown or other
  misc_feature (237)..(237): n is a, c, g, or t
  modified_base (258)..(258): a, c, t, g, unknown or other
  misc_feature (258)..(258): n is a, c, g, or t
  modified_base (294)..(294): a, c, t, g, unknown or other
  misc_feature (294)..(294): n is a, c, g, or t
  modified_base (308)..(308): a, c, t, g, unknown or other
  misc_feature (308)..(308): n is a, c, g, or t
  modified_base (327)..(327): a, c, t, g, unknown or other
  misc_feature (327)..(327): n is a, c, g, or t
  modified_base (435)..(435): a, c, t, g, unknown or other
  misc_feature (435)..(435): n is a, c, g, or t
tcagtcgtcgctcgcacgaccggtgctcgatttagacgacagctcaggggagcttcagctgtggtagagaagacaggactcaggacaatctccagcatggccgtcttccctctcctcctcaccctcctcactcactgcgcagggtcctgggcccagtctgtgctgactcagccaccctnagcgtcgtcggacccccgggnagagggtcaccatctcttgttctggagcaactccaanatcggaataattatgtattcnggtatcagcaactccgagaactcgacccccaatccnatcagaagaataancagccgcctgacgggtccngacgtatctcgtgcctacagtctgccactcaccgtccctccgagaccctatcgacggtcggcctaccgggaccgagacgtcggaacgtcctagtaactaactttcggngtactaccgagtaccggacggtacaaccgtaaagtacggtaggtaacacgtaaaacttacggttcggtagggtacggggttcggggttacgggtacgggtaccggggaacgggtaaaccggtaaacccgtaacggtaccggtacccggtacggtaacggtaccgaccggtaacccgag

SEQ ID NO: 310965 - DNA, 807 bp, Homo sapiens
  misc_feature: GZ8MTXP02JVUS3.21.22.B11.1.454.CMB.2.raw
  modified_base (239)..(239): a, c, t, g, unknown or other
  misc_feature (239)..(239): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcacgccaccctcacgcgtcgtcgggacccccggcagacgggtcaccatctcttgtctggagcaactccaanatacggaatattatgtatctgtatcagcaactccgagactccgacccctaactcctcactaccgagaagaaataactcgacggcccggtcctcggaccggggtccctacggacctacgttcctacgtcggacccttacgaacgttcgtcgggaccctaacccgtccgtaccgtcccccttacccccgtacggtaaacccctacgttaccgggtaaccgggttcccgggggtacccccgttacccgggggttacccgggaaagggttacgtaccgggggtaaccggttaccgtttaccgggttaaaaccctttacggttttaaccgggttaccggtttaggaccccgttaacgggaccccggggttaaaacccggggggaaaccctaaaccgtaaaccggggtaagggttacccgggtaaagttaaccggaaaacccgttaagttcccgggtaagggtacggggtttacgggggtttcggggtacggggttaccggggaaccggggttaacggaaacccgtaaacggtccggtaaccgtacggtacggaccgaccgaccggtacccggg

SEQ ID NO: 310966 - DNA, 638 bp, Homo sapiens
  misc_feature: GZ8MTXP02FVD94.21.22.B11.1.454.CMB.2.raw
  modified_base (199)..(199): a, c, t, g, unknown or other
  misc_feature (199)..(199): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctcgggacccccggnagagggtcaccatctcttgttctggaggcaactccaacatcggaaagtaattatgtattctgtatcagcaactccaggaactcggacccccaatcctcactccagagaatatcagccgcctcgacggggtcctaggaccgtacttccgtcgtcggccttaccgaacgttcgtgggaccacctcgaccgtccctacccgtacgaccctatccgaggtcgggtccctaccggggtccgaggtacgtggacggtcctaggtaacctttagtttacgtgtacgtacctaacgttcccggaaacggggacctacgaaacgtggttacgggaactaggaacctaaagttccgtagggacggttcggggttaggggtcggttacggggacgggaacggtaacctaaacgtcgacccgttacgtagggtaccacggtacccgaacgg

SEQ ID NO: 310967 - DNA, 681 bp, Homo sapiens
  misc_feature: GZ8MTXP02HEAK1.21.22.B11.1.454.CMB.2.raw
  modified_base (202)..(202): a, c, t, g, unknown or other
  misc_feature (202)..(202): n is a, c, g, or t
  modified_base (238)..(238): a, c, t, g, unknown or other
  misc_feature (238)..(238): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagcccaccctcagcgtccgtcgggacccccggnaggagggtcacatctcttgtctggagcaactccaanatacggaataattatgtattcgtggtatcagacaacctcccaaggaactccggaccccccaaaactccctacactaccgaaggaaaggaaattaaagtcgaacggcccggccctaccggaacggggtcccctacggtaccgtactttccgtccgtcggaccttaccgaaagttcgtcggccctaacctccaccgtccccttcccctacgaaccctagtccgacggggttcgggcccgtacccggggttacccgaagggtacgttacgggaacggccttgaaactttacgttaccgtgtacgacacgtaccgaaacggggcaaccaaagagtgggactacgaaacaatcgtagggtacggtcgggttggggttacgtcgggacggtaacggaaccctaaaggtccggaacccgttacgaacggtccaaaccggacccgtaacgg

SEQ ID NO: 310968 - DNA, 591 bp, Homo sapiens
  misc_feature: GZ8MTXP02F5WOF.21.22.B11.1.454.CMB.2.raw
  modified_base (198)..(198): a, c, t, g, unknown or other
  misc_feature (198)..(198): n is a, c, g, or t
  modified_base (380)..(380): a, c, t, g, unknown or other
  misc_feature (380)..(380): n is a, c, g, or t
  modified_base (385)..(385): a, c, t, g, unknown or other
  misc_feature (385)..(385): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctgggacccccggnagagggtcaccatctcttgttctggagcaactccaacatcggaatattatgtattctgtatcagcactccagatcgaccccaactcctcactccagagaataatcacgccggcctacgacggggtccctagaccgtacttcctctcggtcctccgaagttcgtggccacctcacgccctccngaccntcgagtcgggcctcgggtccgacggattcggaggtctagaccttagttaccgtgttcggactagtccgaacggggacaccgaacagtcggggaatcggaacctaaagtccgtagggtacggtacggggtttggtcggttacggggaccggtacggtaacccgaacgttacggaaccgttcccgtaaggtccgacgacccggtaacg

SEQ ID NO: 310969 - DNA, 642 bp, Homo sapiens
  misc_feature: GZ8MTXP02HMFK9.21.22.B11.1.454.CMB.2.raw
  modified_base (198)..(198): a, c, t, g, unknown or other
  misc_feature (198)..(198): n is a, c, g, or t
  modified_base (341)..(341): a, c, t, g, unknown or other
  misc_feature (341)..(341): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctcgggaccccggnagagggtcacatctcttgtctggagcaactccaacatacggaagtaattatgttattctggtatcagcaactccaggaatccgaccccaaactcctacactcagagaatatcagccgcctcgacggggtcctgaccgtcttcnctcggtcctacgaagttcctggcctaccgtcaccgtccctaccctagacccacgtcgacggttcggccgtcccgggtaccggagacgtcgacgggacttcgtacttacgttacgtggtactacgactaccgggaacgggaccaacgaaacgtagtacgggtaactacggaacagttacggacggtggggttaccggggttggggtacgggttccgggggacgggttaaccgggtaaacccgtaaccggtcgggtaaaccccgttcggttaacggaccgaacccgggtaaccgtaaccgggg

SEQ ID NO: 310970 - DNA, 618 bp, Homo sapiens
  misc_feature: GZ8MTXP02GNS9K.21.22.B11.1.454.CMB.2.raw
  modified_base (201)..(201): a, c, t, g, unknown or other
  misc_feature (201)..(201): n is a, c, g, or t
  modified_base (327)..(327): a, c, t, g, unknown or other
  misc_feature (327)..(327): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtcgtcgggacccccgggnaggagggtcaccatctcttgttctggagcaactccaacatacggaagttaattatgtattctggtatcagcaacctccgaaggaactccggacccccaaactcctacactccaaggagaaataacncacgccggccctcgacgggtccctcgaccgtacttctcgtcggcctaccgtaacgtctcgggaccacctccaccgtcccctcctacgaccctagtcgacggtcgggccgtccgggcgtacgcgtacggacgggtctaggactttacgttactggtcaccgtataccgggaccgggtacaacgaacgtagttagggatacgaactaacgttcgaggtgggttcggggttggtcggttcggggacggtacgggaacaacggtcgaccggtacgacgtacgaccgaccgtacgg

SEQ ID NO: 310971 - DNA, 612 bp, Homo sapiens
  misc_feature: GZ8MTXP02GI3LG.21.22.B11.1.454.CMB.2.raw
  modified_base (199)..(199): a, c, t, g, unknown or other
  misc_feature (199)..(199): n is a, c, g, or t
  modified_base (334)..(334): a, c, t, g, unknown or other
  misc_feature (334)..(334): n is a, c, g, or t
  modified_base (370)..(370): a, c, t, g, unknown or other
  misc_feature (370)..(370): n is a, c, g, or t
  modified_base (387)..(387): a, c, t, g, unknown or other
  misc_feature (387)..(387): n is a, c, g, or t
  modified_base (456)..(456): a, c, t, g, unknown or other
  misc_feature (456)..(456): n is a, c, g, or t
  modified_base (494)..(494): a, c, t, g, unknown or other
  misc_feature (494)..(494): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctcgggacccccggnagagggtcaccatctcttgttctggaggcaactccaacagtacggaagtaattatgtattctggtatcagcaactccaggactcggaccccaaactctcatccagagaataatcagcggccctgacggggtcccngaccgtacttcgctggcctaccaagttctcggaccnccttcacgcccttcccngacccatccgaggtcggcctccgggtaccgaggactggaacgggtcagaactttattacgtggtcgacncgtacggaccgggacacaacgagtacgggatcggaaanacgtcgtagggacgtcggggtttggggtaccggttacgggggacggaaacccgggttaacgaaaccgtacggtaaacccgtcccggttaacggactaacccgggaccgaaacccgggg

SEQ ID NO: 310972 - DNA, 610 bp, Homo sapiens
  misc_feature: GZ8MTXP02IUNJ7.21.22.B11.1.454.CMB.2.raw
  modified_base (201)..(201): a, c, t, g, unknown or other
  misc_feature (201)..(201): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtcgtcggggacccccggnagacgggtcaccatctcttgttctggagcaactccaacatcggaataattatgttattctggtatcagacaactcccgaaggaatccggacccccaaatccacatccagagaatatcagccgcctcgacggggtccctagaccgtattcctcgtcggcctaccgtaacgttcctgggccctaaccctccacgtccccctccctacgaaccctagtccgaggtcgggaccgttcccggtaccgaggtactggacgctagtacttatacgtgtcgatacgtacggaaccgggacacgaaacgtagtaggggtactacgaaactaacgttcgagggtacggtcggggttgggtcggttcggggacggtacggaacctaacgcgtacgttaccgaagtccgacgaccgtacgg

SEQ ID NO: 310973 - DNA, 526 bp, Homo sapiens
  misc_feature: GZ8MTXP02FHXHU.21.22.B11.1.454.CMB.2.raw
  modified_base (351)..(351): a, c, t, g, unknown or other
  misc_feature (351)..(351): n is a, c, g, or t
  modified_base (413)..(413): a, c, t, g, unknown or other
  misc_feature (413)..(413): n is a, c, g, or t
  modified_base (430)..(430): a, c, t, g, unknown or other
  misc_feature (430)..(430): n is a, c, g, or t
  modified_base (435)..(435): a, c, t, g, unknown or other
  misc_feature (435)..(435): n is a, c, g, or t
  modified_base (447)..(447): a, c, t, g, unknown or other
  misc_feature (447)..(447): n is a, c, g, or t
  modified_base (460)..(460): a, c, t, g, unknown or other
  misc_feature (460)..(460): n is a, c, g, or t
  modified_base (469)..(469): a, c, t, g, unknown or other
  misc_feature (469)..(469): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctgggacccccggcagagggtcaccatctcttgttctggaggcaactccaacatcggaagtaattatgtattctggtatcagcaactcccaggaatcggcccccaaactccctcatcccagacggaataatcagcggccctacacggggtccctgaccgattcctcnggcctccaagttctcggcacctcacgcctccctgaccatcaggtgggacctccggtccgagntgaggctgactattacngtacnatcgacgggacncaacagtcggganagacatcgngaggtcggtggtcggtcggacggacggacaacgtcgaccgtacgacgacacgaccag

SEQ ID NO: 310974 - DNA, 690 bp, Homo sapiens
  misc_feature: GZ8MTXP02F5DIG.21.22.B11.1.454.CMB.2.raw
  modified_base (294)..(294): a, c, t, g, unknown or other
  misc_feature (294)..(294): n is a, c, g, or t
  modified_base (317)..(317): a, c, t, g, unknown or other
  misc_feature (317)..(317): n is a, c, g, or t
  modified_base (332)..(332): a, c, t, g, unknown or other
  misc_feature (332)..(332): n is a, c, g, or t
tcagtcgtcgctcgcacgaccggtgctcgatttagacgacagctcagggtggggtcaaaaacccggggagggggtctgatttgcatggatggactctcccctctcagagtacgaagagagggagagatctgggggaagctcagcttcagctgtggtagagaagacaggactcaggacaatctccagcatggccggcttccctctcctcctcaccctctcactcactgcgcagggtcctgggcccagtctgtgctgactcacgcccaccctcagccgtctccggggacccccggnaggaggtccacatctcttgttcnggacgcaactccaanatacggaagttaattagtcgtattcgtaggtactcaacgactaccgtccgaaggtaaacgtccggaaccccctaaaactcctactaacgtacccgaaaggaacgggtaaaacttaacgtaccgaaacggccccgggtaccccgtacggtaaccgggggttacccctacggtaaaccccggttaaactttccggtcccggttacggtacccgttacccgtaaaggtttcccgacggtaccctacccgttacaccggtcccctcccgtacgaccctacgtacgacgggttcgggacccgtccggggtaaccgaggttacgcgggtacgtcgtacggacctttaacgtaccgttgtaccgg

SEQ ID NO: 310975 - DNA, 517 bp, Homo sapiens
  misc_feature: GZ8MTXP02FIU3Y.21.22.B11.1.454.CMB.2.raw
  modified_base (420)..(420): a, c, t, g, unknown or other
  misc_feature (420)..(420): n is a, c, g, or t
  modified_base (494)..(494): a, c, t, g, unknown or other
  misc_feature (494)..(494): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctgggacccccggcagagggtcaccatctcttgttctggaggcaactccaaacatcggaagtaattatgtattctggtatcagcaaactcccaggaatggcccccaaactcctcatccagaggaataatcagcggccctcaggggtccctgaccgattctctggctccaagtctggccacctcagcctcctgaccatcagtggggctccggtccgaggatgaggctgactattacngtgcatcgacgggacgcaaacatggggatgacaatctagagtcggttgggtgttcgggcggagggaccaaacgngaccgtcaggtcacgcccaaagg

SEQ ID NO: 310976 - DNA, 698 bp, Homo sapiens
  misc_feature: GZ8MTXP02JP88H.21.22.B11.1.454.CMB.2.raw
  modified_base (180)..(180): a, c, t, g, unknown or other
  misc_feature (180)..(180): n is a, c, g, or t
  modified_base (553)..(553): a, c, t, g, unknown or other
  misc_feature (553)..(553): n is a, c, g, or t
  modified_base (563)..(563): a, c, t, g, unknown or other
  misc_feature (563)..(563): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagcccaccctnagcgtcgtcgggacccccggcagacgggtcaccatctcttgttctgggagcaactccaacagtacggaaagtaattatgtattcgtggtatcagaccaacctccgaaggtaactccggacccccctaaactccctacactaccgaaggaaggaaaataactccgaacgggtcccggtacccctacggtaccggggtcccctacggacctacgtttccgtcgtcggtccctacgaacgttctcggaccctaccctcgaccgtccctacccgtcaaccctagtccgtagggtccgggccgttcccggggacccgaaggtcgtggacggtactaggtacttagtcttagggcagtaccgtacgggaaccgggtacnccgtaaaggnggtagggaatacgactagttcgtacgggtacgggttcgggttaggggttccggtacggggtaccggggaacgtaaaccgaacgggttccggtaacccggttcggtaaccggtacccgaccggtaacccggtacgg

SEQ ID NO: 310977 - DNA, 579 bp, Homo sapiens
  misc_feature: GZ8MTXP02H0KSV.21.22.B11.1.454.CMB.2.raw
  modified_base (200)..(200): a, c, t, g, unknown or other
  misc_feature (200)..(200): n is a, c, g, or t
  modified_base (368)..(368): a, c, t, g, unknown or other
  misc_feature (368)..(368): n is a, c, g, or t
  modified_base (419)..(419): a, c, t, g, unknown or other
  misc_feature (419)..(419): n is a, c, g, or t
  modified_base (444)..(444): a, c, t, g, unknown or other
  misc_feature (444)..(444): n is a, c, g, or t
tcagtcgtcgctcgcacgaccggtgctcgatttagacgacagctcaggggagcttcagctgtggtagagaagacaggactcaggacaatctccagcatggccggcttccctctcctcctccaccctcctcactcactgcgcagggtcctgggcccagtctgtgctgactcagccaccctcagcgtctcgggacccccggnagagggtcaccatctcttgttctggaggcaactccaacatcggaagtaattatgttattctggtatcagcaactcccaggaactcggacccccaactcctcactccagaagaataactcagcggcctcgaggggtcccctgaccgattcctcgtcggctccaagttcnggcacctcacgccctcctgaccatcaggtcgggacctcccgggtacgaggntggaggcctagaccttagtttacgngttcgctatccggacgggaacgaccaaataggtagggactaggaactaagtcctaggacggtcgggttgggtacggttcgggacggtaacggaccgtaaacgtcggtaccgtacgtacggtacgacgaccgacgg

SEQ ID NO: 310978 - DNA, 673 bp, Homo sapiens
  misc_feature: GZ8MTXP02GY9DN.21.22.B11.1.454.CMB.2.raw
  modified_base (544)..(544): a, c, t, g, unknown or other
  misc_feature (544)..(544): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtcgtcgggacccccggcagacgggtcaccatctcttgttctggagcaactccaacagtacggaagtaattatgtattctggtatcagcaacctcccaaggaactcggaacccccctaaactccctacactccgaagaaggaaataatcagccggcctcgacggggtccctagaccgcttctcgtcggcctaccaagtctcggcctactccacgtcccctacccgtcgacccagtccgtaaggtcgggtacccgtcccgggtaccggaaggtacgtcgggaacgggtcctacggtaaacctttagttaacgttcggtacgaccgtaacgttacccggaacggggaacccgactaaaaccggnggtaggaactacgaactaagtcggtagggtacggtcggggtttacgggttcggtaccggggaacggggtaaccggaaaccgtaacgttacggaacccgttacggacggtaccgaaccgacccgtaacgg

SEQ ID NO: 310979 - DNA, 822 bp, Homo sapiens
  misc_feature: GZ8MTXP02F5W9I.21.22.B11.1.454.CMB.2.raw
  modified_base (203)..(203): a, c, t, g, unknown or other
  misc_feature (203)..(203): n is a, c, g, or t
  modified_base (648)..(648): a, c, t, g, unknown or other
  misc_feature (648)..(648): n is a, c, g, or t
tcagtcgtcgctcgcacgaccggtgctcgatttagacgacagctcagggggagcttcagctgtggtagagaagacaggactcaggacaatctccagcatggccggcttccctctccctcctcaccctcctcactcactgcgcagggtcctgggcccagtctgtgctgactcacgccaccctcagcgtcgtcgggacccccggnaggacgggtcacctatcttcgttgttcgtgggacggacctaacctacccaaactagttaccgggaaagttaaatttagtagtttaactttcgttaggttaactacgacgtaccctaaacccttaccccgaaggaacgttaccccggaaaccccccctaaactttccctacgtaacgtacccgaaggtaaacggtaaaacttaacgtccgtaacgggccccggtaccccggttaccggtaccgggggtacccctacggtaccgttaccttccgtacgtcggtaccctacgtaacgtcgtcgacctaccctcgacccgtccccttacccgcgtaaccctagtccggtacggtccgggtcccggtacccgggtaccggaggacttacgggacggtcttacgtactttacgttacgtggtactaccgacggtaccgggacgggaaaccngtaaacggtagggtacgacgttaccggaaatacggtacggtaggggttaccggggttacgggggtttgggggttaccgggttaccgggggaaccggggtaaccggaaaccccgtaacggttacccggtaccggttaccggttaccggaccggaaccggtacccccggtaacggg

SEQ ID NO: 310980 - DNA, 737 bp, Homo sapiens
  misc_feature: GZ8MTXP02JG8UE.21.22.B11.1.454.CMB.2.raw
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagcccaccctcagcgtctcgggacccccgggcaggagggtcaccatctcttgttctggaggcaactccaacatcggaagtaattatgtattctggtatcagcaactccaaggaactcggacccccaaagtcctcactccaagaggaataatcacgcggaccctacgacggggtccctacggaccgtacttctcgtcggtcctaccgaagttccttcggggcctaacccgtccaaccgtccctaccccgtacgaccctaacgttccgaaacgggttcgggggacccttccccggggtacccgggtaaacgggcgttaccggggaaacgggttcccgttaacggtaaccgtttaaacgttttaacccggttagggttcgggacctaaaacgttccccggtaaaccggggggaaacccgtaccaaaacgtaccgggttacgggggaattacgggaaaactaacggtccgtagggtaacgggtcgggggtttacgggtcggtttacggggaacggggtacggaaccgtaaaacgtcggaacccgttacaacgggtccaacggcccaaacggg

SEQ ID NO: 310981 - DNA, 726 bp, Homo sapiens
  misc_feature: GZ8MTXP02HMVVX.21.22.B11.1.454.CMB.2.raw
  modified_base (203)..(203): a, c, t, g, unknown or other
  misc_feature (203)..(203): n is a, c, g, or t
tcagtcgtcgctcgcacgaccggtgctcgatttagacgacagctcaggggagcttcagctgtggtagagaagacaggactcaggacaatctccagcatggccggcttccctctcctcctccaccctcctcactcactgcgcagggtcctgggcccagtctgtgctgactcagccatcctcagccgtcgtcggggacccccggnaggacgggtcacatctcttgttctggagacaactccaacagtacggaattaattatagtattcgtggtatcagaccaacctacccgaaggaactcccggaaccccctaaactccctacaactaccgaaggaaacggtaaataaactccgaacggtccggcccctacgggtaccggggtcccctaggacccccgtattccgtcgtacggtcctaccgtaacgtccgtacggaccctacctaccaccgtcccccgtaccctacggaaccctagtacccgtagggccggggtcccgtacccggggacccggtaaggtacgtacgggacggtcctaacggtaaacttcgttaaccgtggtacacaaggtaccgacgggacacaagaggtaggtacgtagaaccgtaaagtcggtaggtacggggttcgggggttacgggttacgggtaccgggggaaccgggtaaacggtaacccgtaaaaccggtccggtaaaacccgtcggtacggtacccgtaacgacccccgg

SEQ ID NO: 310982 - DNA, 726 bp, Homo sapiens
  misc_feature: GZ8MTXP02IK0V4.21.22.B11.1.454.CMB.2.raw
  modified_base (200)..(200): a, c, t, g, unknown or other
  misc_feature (200)..(200): n is a, c, g, or t
  modified_base (311)..(311): a, c, t, g, unknown or other
  misc_feature (311)..(311): n is a, c, g, or t
  modified_base (324)..(324): a, c, t, g, unknown or other
  misc_feature (324)..(324): n is a, c, g, or t
  modified_base (334)..(334): a, c, t, g, unknown or other
  misc_feature (334)..(334): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtcgtcggggaccccggnaggacgggtcaccatctcttgttcgtggacggcaactccaacagtacggaaagttaattagtgtattcgtaggtatcagacacctcccaaggtactccgacccccaatccnactcagagaatancacgcgtccncgacggtcctagacctactctcgtcgctacgagttccgcgaccacctccgaccgtcccccgttcctacgaacctacgtcgtacgggttcgggcccgttcccggtacccggtaggtacggtcggtaacgggtcctaggtaacctttaacgtttaccggtacgtacgttaccgaccgttacgggacccgggtaaccgaacgtaacggtggtaagggacttaaccggaataacggtttcggtacgggttacgggttaccgggggttttacggggtaccggggtttacgggggaacccggggtaaacgggtaaaccccgtaaacggtttacccgggaaaaccccggtttcggttaaaaccggacccggttaaaccccgggaccggttaaacccggg

SEQ ID NO: 310983 - DNA, 659 bp, Homo sapiens
  misc_feature: GZ8MTXP02G3HQ6.21.22.B11.1.454.CMB.2.raw
  modified_base (201)..(201): a, c, t, g, unknown or other
  misc_feature (201)..(201): n is a, c, g, or t
  modified_base (239)..(239): a, c, t, g, unknown or other
  misc_feature (239)..(239): n is a, c, g, or t
tcagtcgtcgctcgcacgaccggtgctcgatttagacgacagctcaggggagcttcagctgtggtagagaagacaggactcaggacaatctccagcatggctggcttccctctcctcctcaccctcctcactcactgcgcagggtcctgggcccagtctgtgctgactcacgccaccctcagcgtcgtcgggacccccggnaggaggtcaccatctcttgttctggagcaactaccaanagtacggaataattatgtattctaggtatcagaccaactcccgaaggaactccggaccccctaaactcctacaactccgaaaggaagtaaactaactcgaacggtcccggtaccccgtaggtaaccggggtcccctaggtaacccccgttagtttcctcgtcggtacctacccgtaagtccgtcgacctaccgtcaccgtccctcctagacctagtcgacgggtcggcccttacccgggacgaggacgtcggagtcctaggtaaccttagttacgtgttacactacgcgaacgggctaaccagtaggtcggaactagaaactagtccggtagaccggggttgggttcggggttacgaccggggacggtaaaccggtaactaacgtaccggacccggttagaacgtccgaacggaccccgg

SEQ ID NO: 310984 - DNA, 744 bp, Homo sapiens
  misc_feature: GZ8MTXP02GCX14.21.22.B11.1.454.CMB.2.raw
  modified_base (198)..(198): a, c, t, g, unknown or other
  misc_feature (198)..(198): n is a, c, g, or t
  modified_base (256)..(256): a, c, t, g, unknown or other
  misc_feature (256)..(256): n is a, c, g, or t
  modified_base (261)..(261): a, c, t, g, unknown or other
  misc_feature (261)..(261): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctgggacccccggnaggagggtcaccatctcttgtctggagcaactccaacatcggaataattatgtattcnggtancagcaactccaaggaactcggacccccaaatcctacactccaagacggaataactcaggccggccctcggacggggtccctaggaccgtacttccgtcgtcggtacctacgtaaacgttcgtggccaccttcacgtccccttccctacgacccattcgaggttcggggcccttacccggggtacccggaaggtactttaacggggcttaggaacttaacgtttaccgttgggtacgaccgttacgtacccgggtaaccgggggtaaccaccgaaaacgtacgttgggggaaactacgggtaaacctaaacgttcggtaaaacgggttacggggttaccgggggttttgggggttacggggtttacccgggggaacgggggtaaaccgggggttaaccccaaaacggttccggggttaaaaccccggttccggttaaaacggggtccccgaaacgggtacccccggtaaacgggtttcccccgg

SEQ ID NO: 310985 - DNA, 695 bp, Homo sapiens
  misc_feature: GZ8MTXP02HBFA4.21.22.B11.1.454.CMB.2.raw
  modified_base (203)..(203): a, c, t, g, unknown or other
  misc_feature (203)..(203): n is a, c, g, or t
  modified_base (259)..(259): a, c, t, g, unknown or other
  misc_feature (259)..(259): n is a, c, g, or t
tcagtcgtcgctcgcacgaccggtgctcgatttagacgacagctcagggggagcttcagctgtggtagagaagacaggactcaggacaatctccagcatggccggcttccctctccctcctcaccctcctcactcactgcgcagggtcctgggcccagtctgtgctgactcagcccaccctcagcgtcgtcgggacccccggnaggacgggtcaccatctcttgttctggacgacaactccaacatacggaagtaattntagtacttctagtatcagccaacctccgaaggtaactccccggaccccctaaactcctcactaccgaagaacgaaatacgtcgacggcccgtacccgtacgaccggggttccctacggtaccgtactttcctaccgtcggtaccctaccgtaacgtccgtccggacctaacccgtccgaccgtcccccgtaccctccgaaacctacgtcgtacggtcccggtccggtacccgggtcgaaggtacgtggacgcttagacttaagttacgttaggacacgttacaccgggtaacggacgacctaaaggcggtaggactaggaactacgttcgaggttaggtccgggggttgggtaccggttacggggaaccgggaccgtaaacgtaaacggtcccggtaaaccgtacggtaccggtaccaccgggtaacccggtaccg

SEQ ID NO: 310986 - DNA, 553 bp, Homo sapiens
  misc_feature: GZ8MTXP02JEN2I.21.22.B11.1.454.CMB.2.raw
  modified_base (200)..(200): a, c, t, g, unknown or other
  misc_feature (200)..(200): n is a, c, g, or t
  modified_base (332)..(332): a, c, t, g, unknown or other
  misc_feature (332)..(332): n is a, c, g, or t
  modified_base (341)..(341): a, c, t, g, unknown or other
  misc_feature (341)..(341): n is a, c, g, or t
  modified_base (401)..(401): a, c, t, g, unknown or other
  misc_feature (401)..(401): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtcgtcgggacccccggnaggagggtcaccatctcttgttctggagcaactccaacatcggaaagttaattatgtattctggtatcagcaactcccaggatcggaccccaaatcctcatccagagaataatcagcgcctgaggggtcccngaccattcnctgcctcaagtctggcacctcacgccctcctgaccctatcaggtcggcctccggcgaggntggacggctagacttattacgtgtcgcagtcgaacgggacaccaagtagtggggatggaactaagtcgtaggacggtcgggttaggggtcgttacggggacggacggtaacctaacgtcggacccgtcgtaggtccaacggtacccgaacgg

SEQ ID NO: 310987 - DNA, 520 bp, Homo sapiens
  misc_feature: GZ8MTXP02JR8U4.21.22.B11.1.454.CMB.2.raw
  modified_base (199)..(199): a, c, t, g, unknown or other
  misc_feature (199)..(199): n is a, c, g, or t
  modified_base (234)..(234): a, c, t, g, unknown or other
  misc_feature (234)..(234): n is a, c, g, or t
  modified_base (243)..(243): a, c, t, g, unknown or other
  misc_feature (243)..(243): n is a, c, g, or t
  modified_base (248)..(248): a, c, t, g, unknown or other
  misc_feature (248)..(248): n is a, c, g, or t
  modified_base (254)..(254): a, c, t, g, unknown or other
  misc_feature (254)..(254): n is a, c, g, or t
  modified_base (275)..(275): a, c, t, g, unknown or other
  misc_feature (275)..(275): n is a, c, g, or t
  modified_base (287)..(287): a, c, t, g, unknown or other
  misc_feature (287)..(287): n is a, c, g, or t
  modified_base (296)..(296): a, c, t, g, unknown or other
  misc_feature (296)..(296): n is a, c, g, or t
  modified_base (307)..(307): a, c, t, g, unknown or other
  misc_feature (307)..(307): n is a, c, g, or t
  modified_base (317)..(317): a, c, t, g, unknown or other
  misc_feature (317)..(317): n is a, c, g, or t
  modified_base (331)..(331): a, c, t, g, unknown or other
  misc_feature (331)..(331): n is a, c, g, or t
  modified_base (349)..(349): a, c, t, g, unknown or other
  misc_feature (349)..(349): n is a, c, g, or t
  modified_base (375)..(376): a, c, t, g, unknown or other
  misc_feature (375)..(376): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtcgtcgggaccccggnaggacggtcaccatctcttgtctggagcactcaantcgaatatngtatngatcancactccagatcgacccaatcnatcagagaatancagccgccncgacgggtccngacgacttcnctcgctacagtcgngcacctcgacgcctccgngaccatcgaggtcgaccgtcgcgagnngagcagtactatactgtcgacacgtacgacggcgacgactaggtacggatacgataagtcgtagggtacggtcgggttaggtcggttaccgggacgggaacgtaaccgaagtacggaccgtcgtaacgtcgaccgaccgtacgg

SEQ ID NO: 310988 - DNA, 601 bp, Homo sapiens
  misc_feature: GZ8MTXP02G7W0U.21.22.B11.1.454.CMB.2.raw
  modified_base (199)..(199): a, c, t, g, unknown or other
  misc_feature (199)..(199): n is a, c, g, or t
  modified_base (331)..(331): a, c, t, g, unknown or other
  misc_feature (331)..(331): n is a, c, g, or t
  modified_base (478)..(478): a, c, t, g, unknown or other
  misc_feature (478)..(478): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctcgggacccccggnagagggtcaccatctcttgttctggagcaactccaacatcggaagtaattatgtattctggtatcagcaactcccaggaactcgacccccaatcctcatccagagaatatcagccgcctcgacggggtcccngaccgattctctcggcctcaagttctggcctactccgacgtccctccctgaccctatcgacggttcgggcctcccggtccgaggatcggacgggtctacgaacttacttaccgtgtcgactacgtaccggacggggacaccgaaagnggtacggagtacgaactaagtcgtggacgttcggggtttggggtcggttccggggacggtaacgggtaaacccgaaacgtcgggtaaccgttaccgtaagggtccaaccggaccgtaaccggg

SEQ ID NO: 310989 - DNA, 629 bp, Homo sapiens
  misc_feature: GZ8MTXP02F3N5U.21.22.B11.1.454.CMB.2.raw
  modified_base (199)..(199): a, c, t, g, unknown or other
  misc_feature (199)..(199): n is a, c, g, or t
  modified_base (237)..(237): a, c, t, g, unknown or other
  misc_feature (237)..(237): n is a, c, g, or t
  modified_base (315)..(315): a, c, t, g, unknown or other
  misc_feature (315)..(315): n is a, c, g, or t
  modified_base (332)..(332): a, c, t, g, unknown or other
  misc_feature (332)..(332): n is a, c, g, or t
  modified_base (337)..(337): a, c, t, g, unknown or other
  misc_feature (337)..(337): n is a, c, g, or t
  modified_base (341)..(341): a, c, t, g, unknown or other
  misc_feature (341)..(341): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctcgggacccccggnaggagggtcaccatctcttgttctggagcaactccaanatacggaagttaattatgtattctggtatcagcaactcccaaggatcggacccccaactccacatccaagagaaatancagcgcctgacggtccngaccnttcnctgctcatctggcacctcacgtccctccgtcgaccagtcaggtcgggtctcccggggtcgaaggtcgtggaacggtctacgacctttaagttaccgtgtacggcctaagttccggaaacccggggacaccgaaaacgtacggtagggacttacggaaaacctaacgtcgttacggggaggttccggggtttagggggtacggtttaccgggggacggggaaacggaaaccccgtaaacgtcgaaaccccggttcggtaacggtccgaaaccggggcccctaaaagggg

SEQ ID NO: 310990 - DNA, 681 bp, Homo sapiens
  misc_feature: GZ8MTXP02I4ZGQ.21.22.B11.1.454.CMB.2.raw
  modified_base (197)..(197): a, c, t, g, unknown or other
  misc_feature (197)..(197): n is a, c, g, or t
  modified_base (293)..(293): a, c, t, g, unknown or other
  misc_feature (293)..(293): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccacctcagcgtctcgggaccccggnagaggtcacatctcttgtctggagcaactccaacatcggaataattatgtattctggtatcagcaacctcccaggaactccggacccccaaatccncactccaagaagaataatcagccgcctacgacgggtccctaggacctacttctctcgctccaagttcctcggacctacctaccgaccgtcccttcccgtacgaaccccgtatccgacggttcggggtacccgttcccggggttcccgaaggtaacgtgggaacggtccgttacggaacctttaagtttaacccgtagttccgacttaacgtaccgggaccgggaaccgacgtaaaccgtaaggtcgggaattaacgggaacttaaatccggtaggtaaacgggtcggggttaacggggttggtaccgggggtaacggggacggtaaaacccgtaaaacgttccggaacccggttaccgtacggttaccgaccgggtacccaaaccggg

SEQ ID NO: 310991 - DNA, 709 bp, Homo sapiens
  misc_feature: GZ8MTXP02H1FXI.21.22.B11.1.454.CMB.2.raw
  modified_base (368)..(368): a, c, t, g, unknown or other
  misc_feature (368)..(368): n is a, c, g, or t
  modified_base (424)..(424): a, c, t, g, unknown or other
  misc_feature (424)..(424): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtcgtcgggacccccggcaggacgggtcaccatctcttgttctggaggcaactccaacatacggaaagttattatgtattctggtatcagcaaacctcccgaggaactccggacccccaaactccctacactccgaagaaggaaactaaatcaagccggcccctacgacggggtccctgaaccgtnttcctaccgtggcctacgaacgttctcgggcctacctccacgtccccctcccgtanacccgactccgtacggtcgggcccgtacccgggtacccgagggtacgttggaacggcgttacggtaaccttactttaaccgttggtacggtactacgtaccgggaaccggggaccagaaaccgtaggtacgggtatacggaactaagttccgaagggacgggttcggggtttacggggtcggttaccgggggacggggttaacccgggaaaaccgtaaaaccggttccggaaaccccggtttccggttaacgggtacccgtaaccgggacccccgtaaaccgggg

SEQ ID NO: 310992 - DNA, 702 bp, Homo sapiens
  misc_feature: GZ8MTXP02JU7ES.21.22.B11.1.454.CMB.2.raw
  modified_base (179)..(179): a, c, t, g, unknown or other
  misc_feature (179)..(179): n is a, c, g, or t
  modified_base (200)..(200): a, c, t, g, unknown or other
  misc_feature (200)..(200): n is a, c, g, or t
  modified_base (224)..(224): a, c, t, g, unknown or other
  misc_feature (224)..(224): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctnagcgtcgtcgggacccccggnaggagggtcaccatctcttgttcnggagcaactccaacatacggaagtaattatgtattctggtatcagccaacctccgaaggaactccggaaccccctaaactccctacactaccgaaggaaggaaaataactcgacgggcccggtaccctacggaccggggtcccctacggaccgtacttcctcgtcggtcctacgaacgttcgtcggcctacccgtccaccgtcccctacccgtacgaacccagttaccggaagggtccggggtcccgttacccggggacccgaggtacgtcgggaccggtctacgtaaccttagtttaccgtggtcgacaacgttccgggaaaccggggacacgtaaacgaggtagggactaacgaactaagtccggaagggtgggtccggggtttagggggtcggttaccggggacgggtaaccggaaacccaacggttcgggtaaaccccgttcggtaacggtcccgaacggtacccggtaaccgg

SEQ ID NO: 310993 - DNA, 708 bp, Homo sapiens
  misc_feature: GZ8MTXP02I42K3.21.22.B11.1.454.CMB.2.raw
  modified_base (179)..(179): a, c, t, g, unknown or other
  misc_feature (179)..(179): n is a, c, g, or t
  modified_base (245)..(245): a, c, t, g, unknown or other
  misc_feature (245)..(245): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctnagccgtcgtcggggaccccccggaggacgggtcaccatctcttgttcgtggacgcaactccaaacngtacggaaagttattatgttattctggtatcagacaacctcccgaggaactccggacccccctaaactccctacactaccaaggaaggtaaactaacgtccaacggcccggtaccctacggtaaccggggtcccctaggaccgtacttcctcgtcggaccttaccgaacggttcctcggggtaccctaacccgttccgaacccggtcccccttacccccgtacggaaacccctaattcccgggtacgggtcccgggggtacccgttacccccggggtaccgggaaaggttcggtacgggtaaccggtccgtacgtaaccctttaaagttccgtagtcgactacgtaccggaccggggaactaccaagtcggtaggatacgtaacatcgtaggacggtcgggtgggtcggtaccgggacggacggaccgaaggtcctcggaccgtcgacggtccaacggtcccg

SEQ ID NO: 310994 - DNA, 614 bp, Homo sapiens
  misc_feature: GZ8MTXP02JC0J3.21.22.B11.1.454.CMB.2.raw
  modified_base (199)..(199): a, c, t, g, unknown or other
  misc_feature (199)..(199): n is a, c, g, or t
  modified_base (215)..(215): a, c, t, g, unknown or other
  misc_feature (215)..(215): n is a, c, g, or t
  modified_base (341)..(341): a, c, t, g, unknown or other
  misc_feature (341)..(341): n is a, c, g, or t
  modified_base (395)..(395): a, c, t, g, unknown or other
  misc_feature (395)..(395): n is a, c, g, or t
tcagtcgtcgctcgcacgaccggtgctcgatttagacgacagctcagggggagcttcagctgtggtagagaagacaggactcaggacaatctccagcatggccggcttccctctcctcctcaccctcctcactcactgcgcagggtcctgggcccagtctgtgctgactcagccaccctcagcgtctcgggaccccggnagagggtcaccatctnttgtctggagcaactccaacatcggaagttaattatgtattctggtatcagcaactccgaggaatcggacccccaaactcctcatccagacgaatatcagccggcctcgcgggtccctagaccgtnttcctcgtgcctcgaagtcgtcggcctaccgtctaccgccctccctcgaacccnctcgacggtccgggccgtcccggttcccggaggcgtaggacgggtctacgtaacttacgttaccgtggtcggactactccggaaccggggacacaacgagtacgggatacggacaacgtcgtaaggtcggtcggggtttcgggtcggtttcggggaccggtacgggtaaccaaacgtcggtaacccgtaccgtaacggtccaaccggtaccgtaaccgg

SEQ ID NO: 310995 - DNA, 621 bp, Homo sapiens
  misc_feature: GZ8MTXP02HTA5P.21.22.B11.1.454.CMB.2.raw
  modified_base (198)..(198): a, c, t, g, unknown or other
  misc_feature (198)..(198): n is a, c, g, or t
  modified_base (235)..(235): a, c, t, g, unknown or other
  misc_feature (235)..(235): n is a, c, g, or t
  modified_base (278)..(278): a, c, t, g, unknown or other
  misc_feature (278)..(278): n is a, c, g, or t
  modified_base (308)..(308): a, c, t, g, unknown or other
  misc_feature (308)..(308): n is a, c, g, or t
  modified_base (329)..(329): a, c, t, g, unknown or other
  misc_feature (329)..(329): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctcgggaccccggnagagggtcaccatctcttgttctggaggcaactcaanatacgaagtaattatgtattctgtatcagcaactccaggaacncgaccccaactctcactcagaaggaataancagcgcctacgacggggtccncgacgacttctctgctcagtcgtcgcactcacgtcctcctacgaccatcgaggtcgggaccctcccgggtcgaggtatcggaacgggtctaggaaccttattaccggtgtagactacgccgggaaccgggtacaaccaagtaggtggggaactaggtaaacaaacgttggtacgggtcgggttacggggtttgggggtacgttaccgggggaccggggtaaacgaaacccgtaaaagttcccggaaaccccgggttgtaaacgggtccaacccggttacccggaacccgggg

SEQ ID NO: 310996 - DNA, 784 bp, Homo sapiens
  misc_feature: GZ8MTXP02JDLQD.21.22.B11.1.454.CMB.2.raw
  modified_base (204)..(204): a, c, t, g, unknown or other
  misc_feature (204)..(204): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagcccaccctcagccgtcgtcgggaccccccgggnaggacggtccacctacttccttcgtttacgttcgtacgggacgtacctaaacccgtacccaaacgtacgttaacgggtaaattaagttagttagttacttcgtaggtactacgacgacctaacctaccgaaggtaccgtacccgtaaccccctaactccctacgtaactaccgaaggtaacgtaaactaacgtaccgaccggtcccggtaccccgtaccggtaccggggtcccctaacggtacccgttacctttcccgtccgtacgtaccgtaccgtacgttccgtccggtaccctacccgtcccgacccgtcccccttacccgtacgaccgtacgtaccggtacggtcccgggtcccgtacccgggtaccggaggtacggtacggacgtacgttacgtacgttacgtacgttcggtacgaccgtaccggtaccgggaccgaccgacaacggtaggtacgtaagtacgtaacgtacgttacggacgggtcgggtcggggttacgggtacgggtacgggaacgggtaacggtaaccgtaacggtccggtaaccggtacgtacggtaccgacggaccgtacg

SEQ ID NO: 310997 - DNA, 577 bp, Homo sapiens
  misc_feature: GZ8MTXP02GSH8Z.21.22.B11.1.454.CMB.2.raw
  modified_base (258)..(258): a, c, t, g, unknown or other
  misc_feature (258)..(258): n is a, c, g, or t
  modified_base (292)..(292): a, c, t, g, unknown or other
  misc_feature (292)..(292): n is a, c, g, or t
  modified_base (340)..(340): a, c, t, g, unknown or other
  misc_feature (340)..(340): n is a, c, g, or t
  modified_base (468)..(468): a, c, t, g, unknown or other
  misc_feature (468)..(468): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctcgggacccccgggcaggagggtcaccatctcttgtctggagcaactcaacatcggaagtaattatgtattcngtatcagcaactccaggatcgacccccaactccncatccagaagaataactcagcggccctcgacggggtcctgacgactcnctgcctcaagtctcgacacctcacgccctcctacgacccatcgagtgggacctccggtccgagagttgacggtctagaaccttagttactagtgactacgtaccgagggaccacgaactagtgggaanacgaactatcgtaggagggttcggggttagggtcggttaccgggacgggtaaccggaaccgtaaacgtcggtaacccggtacgtacggaaccacggtaacccgtaacgg

SEQ ID NO: 310998 - DNA, 599 bp, Homo sapiens
  misc_feature: GZ8MTXP02JS8MT.21.22.B11.1.454.CMB.2.raw
  modified_base (198)..(198): a, c, t, g, unknown or other
  misc_feature (198)..(198): n is a, c, g, or t
  modified_base (235)..(235): a, c, t, g, unknown or other
  misc_feature (235)..(235): n is a, c, g, or t
  modified_base (292)..(292): a, c, t, g, unknown or other
  misc_feature (292)..(292): n is a, c, g, or t
  modified_base (306)..(306): a, c, t, g, unknown or other
  misc_feature (306)..(306): n is a, c, g, or t
  modified_base (343)..(343): a, c, t, g, unknown or other
  misc_feature (343)..(343): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctgggacccccggnagagggtcaccatctcttgttctggagcaactcaacntcggaataattatgtattctggtatcagcaactcccagaatcggacccccaaatccncatccagagaatancagcggtccctcgacggggtccctggacctacttccncgtcgctcaagtctcgccacctcacgtccctcctcgacccatccgagggtcggccttcccgggacgtagactcgggacgtcgtacgacctttaaagttcgtggtcgaccgtacgtaccgggacgggaccgacaaacgtaggttagggatacgaacctaagtccgtggacggtccggggtttgggtcggttccggggacgggaacgggtaaccaaacggtcgacccggtacgtaggaccctacggacccgtaaccgg

SEQ ID NO: 310999 - DNA, 557 bp, Homo sapiens
  misc_feature: GZ8MTXP02F3SHK.21.22.B11.1.454.CMB.2.raw
  modified_base (199)..(199): a, c, t, g, unknown or other
  misc_feature (199)..(199): n is a, c, g, or t
  modified_base (236)..(236): a, c, t, g, unknown or other
  misc_feature (236)..(236): n is a, c, g, or t
  modified_base (346)..(346): a, c, t, g, unknown or other
  misc_feature (346)..(346): n is a, c, g, or t
  modified_base (398)..(398): a, c, t, g, unknown or other
  misc_feature (398)..(398): n is a, c, g, or t
  modified_base (435)..(435): a, c, t, g, unknown or other
  misc_feature (435)..(435): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctgggacccccgggnagagggtcaccatctcttgttctggagcaactccaanatcggaagtaattatgtattctggtatcagcaactcccaaggaatcggacccccaaactcctcatccagaggaataatcagcggccctgacggggtcctgaccgtattcnctgctcaagtctggcacctcacgcctcctgaccatcagtcggctcggcgagntgagctgacttatactgtacgcactcgaacgggaccncaacgagtgggaatcggaacaagttcgtaggacggtacgggttcggggtgttccggggacgggtaacggggaacccaaaacgtcggaacccgttaccgtaggtaccacggaccccgtaaagg

SEQ ID NO: 311000 - DNA, 597 bp, Homo sapiens
  misc_feature: GZ8MTXP02FQJBX.21.22.B11.1.454.CMB.2.raw
  modified_base (234)..(234): a, c, t, g, unknown or other
  misc_feature (234)..(234): n is a, c, g, or t
  modified_base (254)..(254): a, c, t, g, unknown or other
  misc_feature (254)..(254): n is a, c, g, or t
  modified_base (290)..(290): a, c, t, g, unknown or other
  misc_feature (290)..(290): n is a, c, g, or t
  modified_base (293)..(293): a, c, t, g, unknown or other
  misc_feature (293)..(293): n is a, c, g, or t
  modified_base (337)..(337): a, c, t, g, unknown or other
  misc_feature (337)..(337): n is a, c, g, or t
  modified_base (372)..(372): a, c, t, g, unknown or other
  misc_feature (372)..(372): n is a, c, g, or t
  modified_base (378)..(378): a, c, t, g, unknown or other
  misc_feature (378)..(378): n is a, c, g, or t
  modified_base (442)..(442): a, c, t, g, unknown or other
  misc_feature (442)..(442): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctgggacccccggagagggtcaccatctcttgtctggagcaactccaacntcggaattaatatgtattcngtatcagcaactccaggactcggaccccaaactccncanccagacgaataatcagccgcctagacgggtcctgaccgacttcnctgctacaagtcgtcggccacctgacgtccctccngacctntacgacggtcgggcctaccggggtccaagggctcgggaacggtctagtaccttaagtttaccgnggtacgctaacgaccggacggactacgaacgtggtacggatagaacgtaattccgaggtacgggtcgggttggggtacgggtccgggaacgggtaaccggtaaaaccctaacggtccggtaacccgtacggtacggacccaacggcccgtaaagg

SEQ ID NO: 311001 - DNA, 661 bp, Homo sapiens
  misc_feature: GZ8MTXP02G9HNW.21.22.B11.1.454.CMB.2.raw
  modified_base (200)..(200): a, c, t, g, unknown or other
  misc_feature (200)..(200): n is a, c, g, or t
  modified_base (251)..(251): a, c, t, g, unknown or other
  misc_feature (251)..(251): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtcgtcgggacccccggnagagggtcaccatctcttgtctggagcaactccaacatcggaagtattatntattctggtatcagcaactccaggaatcggacccccaaatcctacatccagaaggaatatcacgcgccctcgaggggtccctgaccgtacttcctacgtcggcctaccgaagttcgtcgggccacccttcgaccgtcccctacccgtgaacccctatcccgaggtcgggaccgtcccgggtaccgaggactcggacggctacggtaacttacttacgtgtcgactacgtacggaacggggaccacaacgtaggttggggattacgaaacctaagttcggacggtaacggggttccggggtttggggttacgggttcggggaaccgggggtaacgggtaaaacccgttaaacggtccggttaacccggttaccggttaacggtacccgaacggtacccccggtaaaccggg

SEQ ID NO: 311002 - DNA, 793 bp, Homo sapiens
  misc_feature: GZ8MTXP02HN3N0.21.22.B11.1.454.CMB.2.raw
  modified_base (202)..(202): a, c, t, g, unknown or other
  misc_feature (202)..(202): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagcccaccctcagcgtcgtcggggacccccggnaggagggtcaccatctcttgttctggagcaactccaacagtacggaaagttaattatgtattctggtatcagcaactccgaagaactccggacccccaaactcctacactaccgaggaaggtaaactaactcgacggtcccggcccttacggacggggttcccctaggtaccgtaccttccgtacgtcggtacccttacgaacggttcgtccggggccctaaaccgttccgaccggttccccctttaccccgacggtaaaccccctaagttcccggtaagggttcccgggggtccccgttacccccgggggttaaccggggaacgggtacgtttacggggaaccggggttccttaacgtaaaccgttttaacgttacccgtttgggtaacgtacgaaacgttcccggggaaaccggggtaaccaccgtaaacgtaggtacggggaacttacggaaaccttaaggttaccggtagggtacggggttccggggtttgggggtacggttccgggggacgggtaaaccgggaacctaaaaccgggttcggaaccccggtttacggaacggccgtaaaccggacccggtaaaccgg

SEQ ID NO: 311003 - DNA, 546 bp, Homo sapiens
  misc_feature: GZ8MTXP02IDGP9.21.22.B11.1.454.CMB.2.raw
  modified_base (200)..(200): a, c, t, g, unknown or other
  misc_feature (200)..(200): n is a, c, g, or t
  modified_base (236)..(236): a, c, t, g, unknown or other
  misc_feature (236)..(236): n is a, c, g, or t
  modified_base (430)..(430): a, c, t, g, unknown or other
  misc_feature (430)..(430): n is a, c, g, or t
  modified_base (447)..(447): a, c, t, g, unknown or other
  misc_feature (447)..(447): n is a, c, g, or t
  modified_base (453)..(453): a, c, t, g, unknown or other
  misc_feature (453)..(453): n is a, c, g, or t
  modified_base (460)..(460): a, c, t, g, unknown or other
  misc_feature (460)..(460): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctcgggacccccgggnagagggtcaccatctcttgttctggagcactccaanatcggaagtaattatgttattctggtatcagcaactcccaggaatcggacccccaaatccctcactccaagaacggaataatcaggccgccctcgacggggtccctgaccgtacttctctcggctacaagtctcggcactcacgccctcctgacccatcgagtggctccggtcgaggctgagctgactattacngtgcagtcgacgggcanaaacgngtagganacgaactacgtcgtaggaggtcgggttgggtacggtcggacggtaacggaactaacgtcgaccgttcgacggacacgaccgtacgg

SEQ ID NO: 311004 - DNA, 708 bp, Homo sapiens
  misc_feature: GZ8MTXP02HRXQZ.21.22.B11.1.454.CMB.2.raw
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtcgtcgggacccccggaggacgggtcaccatctcttgtctggaggcaactccaacagtcggaaagttaattatgtattctggtatcagactaacctccgaaggactccggacccccaaactccctacactccaaggaacgaaataactcgacgccggtccctacgtacggggtcccctggaccctacttccgtcgtcggcccttaccgaacgttcgtcgggtaccctaaccgtccgtacccgtcccccttaccccgacgaacccctaacgttccggtaccggttcggggtaccccgttcccgggttaccggaaacgggttcgttacggacgggtacgttacgtaacgtttacgtttacgttcgtacgtaaccgacgttaccggaacccggggaccaacgaaaaccggtgggttacgggaatacgaaagtaacttgtaacggtggtcggggttggttacggtcgggaccggaacggtaacgaaacggtcgtaaaccgtccgtaaggtccaaccggaccgtaaccgg

SEQ ID NO: 311005 - DNA, 776 bp, Homo sapiens
  misc_feature: GZ8MTXP02HGYVA.21.22.B11.1.454.CMB.2.raw
  modified_base (180)..(180): a, c, t, g, unknown or other
  misc_feature (180)..(180): n is a, c, g, or t
  modified_base (200)..(200): a, c, t, g, unknown or other
  misc_feature (200)..(200): n is a, c, g, or t
  modified_base (312)..(312): a, c, t, g, unknown or other
  misc_feature (312)..(312): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagcccaccctnagcgtctcgggacccccggnagagggtcaccatctcttgttctggaggcaactccaacatcggaaagtaattatgtattctggtatcagcaactcccaggactcgacccccaaatcctcatccagagaatancagccgcctcgacggggtccctgaccgtattcctcgtcggcctaccgaagttcctcggcctaccctcgaccgtccccttaccctacgaaccctagtcgtacgggtcggggtacccgttcccggggtaccgaaagggtctacgggacggggttaccttacggtaaccttttaaagtttaccggttcggtacggtacccttaacgggttacccggggtaaaaccgggggtaacccaacccgtaaaacgggttaaggttcgggggtaaaacctttaacgggaaaaccttaaacgttaccggggttaggggaaacgggggtttttccgggggtttaagggggtttccgggttaccggggggaaacccggggtaacgggtaaaaccccgtaaaacgggttccggggtaaccccggtttacccggttaaaggggtacccccgaaacgggtacccccccggttaaaacggg

SEQ ID NO: 311006 - DNA, 703 bp, Homo sapiens
  misc_feature: GZ8MTXP02IK7AS.21.22.B11.1.454.CMB.2.raw
  modified_base (199)..(199): a, c, t, g, unknown or other
  misc_feature (199)..(199): n is a, c, g, or t
  modified_base (331)..(331): a, c, t, g, unknown or other
  misc_feature (331)..(331): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtcgtcgggaccccggnagacgggtcaccatctcttgttctggacgacaactccaatagtacggaaagttattatgtattctggtatcagacaactcccgaaggaactccggacccccaaatcccacactaccaaggaacgaattaacncacggtcggacccctcggacggggttcccctaggtaccgtacttacctcgtacggtcctacgtaacggttctcgggacctaccgttacgaccgtcccccttccgacgtaccctagtcgaacgggttccgggtcccgttaccgggtacccgaggtaccgtggacgtcgtacgtacttagttaccgtggtacacgtacgtaccgggaaacccggcgtaaccgtaacgagggttaccgggataacggtaactaaccgttcgtacggggacgggttcgggggtttacggtcggggttaccggggaaacgggaccggtaaaaccgtaacggttaccggaccggttaccgtaacggacgacgggtacccgtaaacggg

SEQ ID NO: 311007 - DNA, 639 bp, Homo sapiens
  misc_feature: GZ8MTXP02JTFO8.21.22.B11.1.454.CMB.2.raw
  modified_base (222)..(222): a, c, t, g, unknown or other
  misc_feature (222)..(222): n is a, c, g, or t
  modified_base (237)..(237): a, c, t, g, unknown or other
  misc_feature (237)..(237): n is a, c, g, or t
  modified_base (432)..(432): a, c, t, g, unknown or other
  misc_feature (432)..(432): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctgggaccctcgggcagagggtcaccatctcttgttcnggacgcaactccaanatacggaagtaattatgtattcgtggtatcagcaaactcccaaggaatcggacccccaaatcctcatacccagaggaactaatcaggcgccctagacggggtccctgacccccgtattcctcgtggcctaccgaagtcctggaccacctcgacgccctccctgaccctatcgacgtcggctacccggtcgaaggnttcggaggtctgtacttattaccgtgtagcgtataccggacggacgcaaacggagttaggggactacggaaactagttccgtaacgggtagggttcccgggttagggggtttcggttaccgggggccgggttaaaacgggggaaccccttaaaaacggttcgggaaacccccggttccgtttacggggtacctaacccggacccggg

SEQ ID NO: 311008 - DNA, 612 bp, Homo sapiens
  misc_feature: GZ8MTXP02IVZE4.21.22.B11.1.454.CMB.2.raw
  modified_base (199)..(199): a, c, t, g, unknown or other
  misc_feature (199)..(199): n is a, c, g, or t
  modified_base (234)..(234): a, c, t, g, unknown or other
  misc_feature (234)..(234): n is a, c, g, or t
  modified_base (290)..(290): a, c, t, g, unknown or other
  misc_feature (290)..(290): n is a, c, g, or t
  modified_base (301)..(301): a, c, t, g, unknown or other
  misc_feature (301)..(301): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagcccacctcagcgtcgtcgggaccccggnagacggtcacatctcttgtctggagcaactccaanatagaagtattatgtattctgtatcagcaactccagactcgaccccaactcacacncaagagaatancacgcggcctcgtacggtcctagaccgtacttctcgtcgacctacgaacgttccgtggccctaccctcgaccgtcccctccgtacgacctacgtcgtacggttcggggcgttacccggggtaccgaggtacgttacggaacgggtccgtacgtaacgtttatttacgtcgtacgactaccgtacggacgggacgtacaacgtacggtacggattagaacttaacgtacgtgtacgggtcggggtttaggcggttccgggaacggtacgacgtaaacgtcgtaaccgtacgtaggtaccacgacccggtacg

SEQ ID NO: 311009 - DNA, 625 bp, Homo sapiens
  misc_feature: GZ8MTXP02GM2FO.21.22.B11.1.454.CMB.2.raw
  modified_base (312)..(312): a, c, t, g, unknown or other
  misc_feature (312)..(312): n is a, c, g, or t
  modified_base (490)..(490): a, c, t, g, unknown or other
  misc_feature (490)..(490): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctcgggacccccgggcagagggtcaccatcttcttgttctggaggcaactccaacatcggaataattatgtattctggtatcagcaactccagaatcgaccccaaactcctcatccagagaataactnagcgcctcgacggggtcctgaccgattctcgtcgcctcaagtctggaccacctcacgtccctcctcgaacccatcgaggtggggcctcccgggttacgaggtctaggacggtcttaggaacttagtttacgcgtgactagtaccggaaacgggaccacgaaactagggtacgggtaanaacgaaactacgttcggtaggtacgggttcgggggtttcggggtacgggttacgggggaaccgggtaacggaaaacccgtaaacggtccggtaacccggttccggtaaacggtaccgacccggaacccggaacgg

SEQ ID NO: 311010 - DNA, 656 bp, Homo sapiens
  misc_feature: GZ8MTXP02IR39B.21.22.B11.1.454.CMB.2.raw
  modified_base (242)..(242): a, c, t, g, unknown or other
  misc_feature (242)..(242): n is a, c, g, or t
  modified_base (299)..(299): a, c, t, g, unknown or other
  misc_feature (299)..(299): n is a, c, g, or t
  modified_base (323)..(323): a, c, t, g, unknown or other
  misc_feature (323)..(323): n is a, c, g, or t
  modified_base (405)..(405): a, c, t, g, unknown or other
  misc_feature (405)..(405): n is a, c, g, or t
tcagtcgtcgctcgcacgaccggtgctcgatttagacgacagctcagggggagcttcagctgtggtagagaagacaggactcaggacaatctccagcatggccggcttccctctcctcctcaccctcctcactcactgcgcagggtcctgggcccagtctgtgctgactcagccaccctcagcgtcgtcggggacccccgggcaggacgggtcaccatctcttgttctggaggcactccaanatcggaattattatgtattctggtatcagcactccaggaatcggacccccaactccnactcagaagataatcacgcggccncgacggggtcctggaccgtacttcgtctcggcctaccgtaacgtctcgggtccacccgtccacgtcccctccctacgacccnctcgaggtcgggtcctcccgggtaccgaggacgtcggacggtcgtagaactttattacgttcgtcggtacctaagtccggaaccgggacgactaaaccggtaggtagggactaacgacgtaaacttcggtaggttcgggttcggggtttagggggtacggtttccggggggacggttaaccgggggaaaccgttaaccggtaccggtacccggttacccggtacgggtacccaccgggtacccgacccggg

SEQ ID NO: 311011 - DNA, 683 bp, Homo sapiens
  misc_feature: GZ8MTXP02F23C1.21.22.B11.1.454.CMB.2.raw
  modified_base (198)..(198): a, c, t, g, unknown or other
  misc_feature (198)..(198): n is a, c, g, or t
  modified_base (235)..(235): a, c, t, g, unknown or other
  misc_feature (235)..(235): n is a, c, g, or t
  modified_base (244)..(244): a, c, t, g, unknown or other
  misc_feature (244)..(244): n is a, c, g, or t
  modified_base (250)..(250): a, c, t, g, unknown or other
  misc_feature (250)..(250): n is a, c, g, or t
  modified_base (281)..(281): a, c, t, g, unknown or other
  misc_feature (281)..(281): n is a, c, g, or t
  modified_base (297)..(297): a, c, t, g, unknown or other
  misc_feature (297)..(297): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctgggacccccggnagagggtcaccatctcttgttctggagcaactccaantcgaatatngtatcngtatcagcaactccagatcgaccccaatccncatccagacgaataancagcgcctcgaggggtccctagaccgtattcgtctggaccttcgaagtccgtggccacctcagtcccctaccgtagaccctagtccgaaacgtcgggacctcccgggtaccgaaggtacgtacgaagggtctaaacggtacctttaaagtttacccgtagggttcccgacttaaaccgttaccgggaaaacccgggggtaccaccccggaaaacgtacggttacgggggaattaacggggaaaaccctaaaaggtttccgaaaggggtaaacggttccgggggtttaaagggggtcgtttacccggggggaaccgggaacggtaacccctaaaaggtccggtaacccggttacgttaacggaccgaacgtacccccggtaaacggg

SEQ ID NO: 311012 - DNA, 682 bp, Homo sapiens
  misc_feature: GZ8MTXP02I9OEB.21.22.B11.1.454.CMB.2.raw
  modified_base (242)..(242): a, c, t, g, unknown or other
  misc_feature (242)..(242): n is a, c, g, or t
  modified_base (436)..(436): a, c, t, g, unknown or other
  misc_feature (436)..(436): n is a, c, g, or t
tcagtcgtcgctcgcacgaccggtgctcgatttagacgacagctcaggggagcttcagctgtggtagagaagacaggactcaggacaatctccagcatggccggcttccctctccctcctcaccctcctcactcactgcgcagggtcctgggcccagtctgtgctgactcagcccaccctcacgcgtccgtcgggacccccgggcagagggtcaccatctcttgtctggagcaactccaacntcggaataattatgtattcgaggtatacagacaacctcccaaggaactccggacccccaaatcctcaactccaaggacggaaataactacgacgccggaccctcggaacggggtcccctagaccgtattttccgttggcctaccgtaagttccgtcggcctaccctacgacgtccccctccgtacgaaaccctntcgacggttccggggccttacccggggtaccgaaggggtatcggggtaggtaccgttacgtaacttaacgtttaaccgtcgttcggaacttacgtaaccggaccgggggttaaccaaccgtaaacgtaggtaggggtaaatcggaactacgttacggcggtacgggtgggttacgggtcgggtacggggacgggaaccggtactaacggcgtaccgtacggtacggacgaccggacgtacggtccg

SEQ ID NO: 311013 - DNA, 666 bp, Homo sapiens
  misc_feature: GZ8MTXP02HXD8M.21.22.B11.1.454.CMB.2.raw
  modified_base (273)..(273): a, c, t, g, unknown or other
  misc_feature (273)..(273): n is a, c, g, or t
  modified_base (284)..(284): a, c, t, g, unknown or other
  misc_feature (284)..(284): n is a, c, g, or t
  modified_base (307)..(307): a, c, t, g, unknown or other
  misc_feature (307)..(307): n is a, c, g, or t
  modified_base (322)..(322): a, c, t, g, unknown or other
  misc_feature (322)..(322): n is a, c, g, or t
  modified_base (326)..(326): a, c, t, g, unknown or other
  misc_feature (326)..(326): n is a, c, g, or t
  modified_base (479)..(479): a, c, t, g, unknown or other
  misc_feature (479)..(479): n is a, c, g, or t
tcagtcgtcgctcgcacgaccggtgctcgatttagacgacagctcagggtggggtcaaaaacccggggaggggggtctgatttgcatggatggactctccccctctcagagtacgaagagagggagagatcgtgggggaagctcagcttcagctgtggtagagaagacaggactcaggacaatctccagcatggccggctttccctctccctcctccacccctcctcactcactgcgcgacgggtccgtcgggcccctagtctgtgctgctcncgcccaccctnacgcgtcgtccgggacccccggnaggacggtccacctntctnttcgttcgtggacgcactacaacagtacgtaaagtattatgttagttctggtactctagacacctaccgaacgacgtcccgaacccccaacttcctaccactaccaagacgaaatactcgacggacccgtcccgttacggaccgggttacccncgtaccgttcgtttccttcggtccgtccgttaccgtaacggttccgtcggaccttacccgtaccgacccgttcccctaccccgttaccgaccgtaaccgttccggacggtccggggttacccgtttcccggggacggtaacggtggtaacggaacggtgtacggtaactttaccgttgtacggtacg

SEQ ID NO: 311014 - DNA, 878 bp, Homo sapiens
  misc_feature: GZ8MTXP02GEWQV.21.22.B11.1.454.CMB.2.raw
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcacgcccaccctcagcgtcgtcggggaccccggcaggagggtcaccatctcttgttcgtggaggcaactccaacagtacggaattaatatgtattctggtatcagacaacctaccgaaggaactaccggaaccccctaaactccctacaacgtaccgaaggaaacgtaaaattaactacgaacggcccggtacccgtaccgggaccggggttaccctacggtaaccgttactttcctcgtacggccttaaccgtaaacgttccgttcgggaccctaacccttacgaaccccgtcccccttaccccgtacgtaaaccctaacgtaccgtaacggggttaccggggtaccccgttacccggggttaacccggaaaggtacggttaacgggtacggggtacctacgtaaaacgttttaaccgtttaaacgtcgggttaccgtaaccgtaaccgttaaccgggggaaaacccgggggtaaaccctaacgaaaaccgtacgggttaaggggaaaccgttaacgggaaaacctaaaaggttcggttaacgggggtaaacggggtttacccggggggttttggggttaaccggggtttacccgggggaaaacccggggtaacggtaaaaaccccggttaaaaaccggtcccgggttaaccccggtttaaaccggtaccggttaaccggaaacccgggaacccggtttaaaccccggg

SEQ ID NO: 311015 - DNA, 780 bp, Homo sapiens
  misc_feature: GZ8MTXP02JTM2T.21.22.B11.1.454.CMB.2.raw
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcacgcccaccctcagcgtcgtcggggacccccggcaggacgggtcacctatctcttgttcgtgggacggacaactccaacagtacggaaagttaattatgttattcgttaggtactcagactaacctcccgaaggaactccggaccccctaaactccctacactaccgaaggaacggtaaaataactaccgaacgggtcccggtccccgtacggtaaccggggtcccctacggtaacccgtacttcccgttcgtcgggtaccctaccgaacgttcgtcgggacctacccgtaccgaccgtcccccttacccgtaccggaaaccctacgttaccggtacgggttccggggtacccggttacccgggtcccggaagggtacgtacggacggggtacttacgaaccgtttaaacgtttccgtgttacggactacgtaccgggaccgggtaacacgtaaacgtcggaaggtactaagaacgtaagtcggtagggtacggggtccgggggttttgggtacgggttaccgggggaagggtaaccgggtaaaacctaaccggtttacccggggtaccttaaccggggttacgacccgggaaccgtaccggtaacccggg

SEQ ID NO: 311016 - DNA, 777 bp, Homo sapiens
  misc_feature: GZ8MTXP02F9N0F.21.22.B11.1.454.CMB.2.raw
  modified_base (200)..(200): a, c, t, g, unknown or other
  misc_feature (200)..(200): n is a, c, g, or t
  modified_base (538)..(538): a, c, t, g, unknown or other
  misc_feature (538)..(538): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctcggggacccccggnagacgggtcacctatctcttgttcgtggacgcaactccaacagtacggaaagttaattatgttattcgtggtatcgacgactaacctccgaaggtaactcccggaacccccctaaacctccctactaactacccgaaaggtaaacggtaaaacttaacgtaccgacgggtaccccggtccccgttaccggtaacccgggggttcccctacggtaacccggttacttccgtccgtacggtaccctaccgtaacgttccgtcggaccctaacctcgaccgtcccctaccgtacgaccctagtcgacggtcggcccgtcggaccggtaggactggaacgtntacgtaacttagttacgtgttcgacttacgaccgggaacggacccgaccgtaaacgtagggtaacggtacgtaagtaaccgtaagttaccggtaggggttacggggtttcggggtttaagggggttccggttaccgggggaaccgggggaaaccgggtaaaaccccgtaacggttacccggggtaacccgttacccgggttaacgggtacccgaaacccggggtacccgtaacccgggg

SEQ ID NO: 311017 - DNA, 665 bp, Homo sapiens
  misc_feature: GZ8MTXP02IFC3I.21.22.B11.1.454.CMB.2.raw
  modified_base (197)..(197): a, c, t, g, unknown or other
  misc_feature (197)..(197): n is a, c, g, or t
  modified_base (231)..(231): a, c, t, g, unknown or other
  misc_feature (231)..(231): n is a, c, g, or t
  modified_base (241)..(241): a, c, t, g, unknown or other
  misc_feature (241)..(241): n is a, c, g, or t
  modified_base (246)..(246): a, c, t, g, unknown or other
  misc_feature (246)..(246): n is a, c, g, or t
  modified_base (277)..(277): a, c, t, g, unknown or other
  misc_feature (277)..(277): n is a, c, g, or t
  modified_base (294)..(294): a, c, t, g, unknown or other
  misc_feature (294)..(294): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggccagtctgtgctgactcagccaccctcagcgtctcgggaccccggnagagggtcaccatctcttgtctggagcactcaantcgaatatangtatntgatcagcactccagactcgaccccaatccncatccagacggaataancagcgcctcgacggggtccacggaccacttcctacgtcggcctactaacgtctcgggacctaaccgttccaaccgtcccccttacccgtacgacccacttaccgaacggtcggggccttcccggggtacccgagggtaacgttcgggaacggtctacggtaacttaacgtttaccgtggtcgtactactaccggaaccgggaccgtacaaacgtacggtacggggtaatacggaaactaaacgttcgtagggtaaccgggttggggtttaccggggtgggtttacccggggacgggggtaacgaaacccgtaaaacggtcggtaacccggttacccgtaagggttacccgaacggtacccggtaaaccggg

SEQ ID NO: 311018 - DNA, 560 bp, Homo sapiens
  misc_feature: GZ8MTXP02J23CT.21.22.B11.1.454.CMB.2.raw
  modified_base (179)..(179): a, c, t, g, unknown or other
  misc_feature (179)..(179): n is a, c, g, or t
  modified_base (199)..(199): a, c, t, g, unknown or other
  misc_feature (199)..(199): n is a, c, g, or t
  modified_base (232)..(232): a, c, t, g, unknown or other
  misc_feature (232)..(232): n is a, c, g, or t
  modified_base (265)..(265): a, c, t, g, unknown or other
  misc_feature (265)..(265): n is a, c, g, or t
  modified_base (289)..(289): a, c, t, g, unknown or other
  misc_feature (289)..(289): n is a, c, g, or t
  modified_base (457)..(457): a, c, t, g, unknown or other
  misc_feature (457)..(457): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctnagcgtctcgggacccccggnagaggtcacatctcttgtctggagcaactcaanatacggaagtaattatgtatctgtatcagcacncccgagactcgacccctaatcctnatccagagaatatcagcgcctcgacgggtcctagaccgtcttcctcgtcgtcctacgaagtcgtcgccacctcagtccctacctgacctatccgaggtcggtactccgggtcgagtatcggagtcctagaaccttgttactgtcgactacgtaccggaacggtaccanaaacgtggtacggtaatagaaaacctagtcgtggacgggttcggttaggcggtcggacggtaaccgaactaacgcgtacccgtctacggctacgaccgtacgg

SEQ ID NO: 311019 - DNA, 731 bp, Homo sapiens
  misc_feature: GZ8MTXP02GO57A.21.22.B11.1.454.CMB.2.raw
  modified_base (290)..(290): a, c, t, g, unknown or other
  misc_feature (290)..(290): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctcgggaccccggcagaggtcaccatctcttgtctggaggcaactccaacatcggaagtaattatgtattctgtatcagcaactcccagaatcgaccccaactccncatcagagaataatcagccgcctcgagggtccctagaccgtactctcgtcggacctaccgaacgttcgtcgggactaccctcgacgtccctccctagacccataccgtacggttcgggggcccgttcccggggtacccggaaggggacttacgggaacggggtccttaggtaccctttaaaagtttacccggtggttaccggacctaacgttacccggaacccgggggtaaccaaccgaaaccgtaaggttacggggaattaacggaactaaaagtttccggtagggtacgggggtttcgggggtttacggggttaccggggttaccgggggaaaccgggggtaacggggtaaaaaccccgtaaaccgggttacccgggtaaaccccgggtttacccgggtaaacgggttaccggaaacccgggtaaccccggtaacgggg

SEQ ID NO: 311020 - DNA, 787 bp, Homo sapiens
  misc_feature: GZ8MTXP02FO5D5.21.22.B11.1.454.CMB.2.raw
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtcgtcgggacccccggcaggagggtcaccatctcttgttctggaggcaactccaacatacggaaagttattatgttattctggtatcagcaacctccaggaatccggaccccctaaactccctacactaccgaagaaggaaataacgtacaacggcccggaccccttacggaccggggtccctacggtacccgtactttccttaccgcgggtacctaccgtaaacgttcgttcgggaccctacccttccgaccgttcccccgttaccccctcgggtaacccctaacgtccgtacggttcgggggtaccccgttcccggggttacccgggaagggtcgtacgggtaccgggtactacgggtaacctttacgtttaccgtggttacgaccttaccggtccgggaaaccggggaccctaacgaaacgtaggggttaagggaataccgggtaaaactaacgttccggtaggtacgggggttcggggttttacgggggtaccggtttaccgggggaccggggtaacgggttaaaacccgaaaacggttcccgggtaacccggtacccgggtttaacgggacccgaacccgggtacccgtaaacccgggg

SEQ ID NO: 311021 - DNA, 752 bp, Homo sapiens
  misc_feature: GZ8MTXP02JG9WQ.21.22.B11.1.454.CMB.2.raw
  modified_base (375)..(375): a, c, t, g, unknown or other
  misc_feature (375)..(375): n is a, c, g, or t
tcagtcgtcgctcgcacgaccggtgctcgatttagacgacagctcaggggagcttcagctgtggtagagaagacaggactcaggacaatctccagcatggccggcttccctctcctcctcacctcctcactcactgcgcagggtcctgggcccagtctgtgctgactcagcccacctcagcgtcgtcgggacccccggcaggacgggtccaccattctcttgttcgtggaggccaacctaccaacagttacggaaagttaattagtagttattcgtaggtactacagaccaactacccgaaggaactccggacccccaaactcctacactaccagagtaatactcagccgtcctacgacggggtccctaggaccncgttcctacgtcgtcctacctaaacggtccgttcggcctaacccgtccgtaccgtacccccgttccctagggaaccccctagttcccgaaggttcccggggtccccgtccgggttacccgggaaaggtcgtacggaacggtcgtacgttaacttaacgtttacgtgttacgcgtaaaccgttcgggaaaccggggtacaaccgtaaaaccggtggttacggggaaactacggtaaaactaacccggttggtacggggtacggggttccggggtttaggggtttccgggaccgggggaacggggttaacggaaacccgtaaaacgggttcggtaacccccgttacggtacggtactacccgggaaccggtaaacccgg

SEQ ID NO: 311022 - DNA, 595 bp, Homo sapiens
  misc_feature: GZ8MTXP02JADPR.21.22.B11.1.454.CMB.2.raw
  modified_base (200)..(200): a, c, t, g, unknown or other
  misc_feature (200)..(200): n is a, c, g, or t
  modified_base (289)..(289): a, c, t, g, unknown or other
  misc_feature (289)..(289): n is a, c, g, or t
  modified_base (350)..(350): a, c, t, g, unknown or other
  misc_feature (350)..(350): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagcccacctcagcgtcgtcgggacccccggnagagggtcaccatctcttgttctggagcaactccaacatacggaataattatgtattctgtatcagcactccagatcgaccccaactcncatccagagaatatcagcgcctcgacgggtcctgaccgattctcgtcgctccgaacgttcncggccaccctcaccgccctcccgtacgaccactcgacggtcgggcctcccgggtacgaggtgtggacggctgaacttagttacgtgtacgacacgtcggaaaccgggactaccaaagtaggtaggggaactacggaaactaacgttcgtagggacgggttccggggttaggggttcggttacggggacgggaacggtaaacctaaacgtcggtaaacccgtcgtaaggccgacgtacccgaacgg

SEQ ID NO: 311023 - DNA, 602 bp, Homo sapiens
  misc_feature: GZ8MTXP02I44TQ.21.22.B11.1.454.CMB.2.raw
  modified_base (200)..(200): a, c, t, g, unknown or other
  misc_feature (200)..(200): n is a, c, g, or t
  modified_base (215)..(215): a, c, t, g, unknown or other
  misc_feature (215)..(215): n is a, c, g, or t
  modified_base (232)..(232): a, c, t, g, unknown or other
  misc_feature (232)..(232): n is a, c, g, or t
  modified_base (253)..(253): a, c, t, g, unknown or other
  misc_feature (253)..(253): n is a, c, g, or t
  modified_base (278)..(278): a, c, t, g, unknown or other
  misc_feature (278)..(278): n is a, c, g, or t
  modified_base (323)..(323): a, c, t, g, unknown or other
  misc_feature (323)..(323): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcacgccaccctcagcgtcgtcgggaccccggnagaggtcaccatctnttgtctggagcactcantcgaatatatgtatctgtatnagcactcagatccgaccccaatccnactcagaagatatcacgcgcctcgacgggtcctagccgtacttcncgtcgcctactaacgttcgtcggacctacccgtcaccgtccctccgtacgaccctaacgtccgtagggtccgggtcccggttaccgggtaccggtaagtacgtcgggacggttctacgtacgtttaaacttcgtgtcgtactacgtacggaaccggtcgaaccagtagtggatagactagtcgtgggtaggttcggggttggtacgtaccgggggacggtaacggtaacctaacgttcggtaacccggtaccgtaggtaccgacgtaacccgtaaccgg

SEQ ID NO: 311024 - DNA, 673 bp, Homo sapiens
  misc_feature: GZ8MTXP02H1NQ2.21.22.B11.1.454.CMB.2.raw
  modified_base (138)..(138): a, c, t, g, unknown or other
  misc_feature (138)..(138): n is a, c, g, or t
  modified_base (259)..(259): a, c, t, g, unknown or other
  misc_feature (259)..(259): n is a, c, g, or t
  modified_base (269)..(269): a, c, t, g, unknown or other
  misc_feature (269)..(269): n is a, c, g, or t
  modified_base (291)..(291): a, c, t, g, unknown or other
  misc_feature (291)..(291): n is a, c, g, or t
  modified_base (302)..(302): a, c, t, g, unknown or other
  misc_feature (302)..(302): n is a, c, g, or t
  modified_base (330)..(330): a, c, t, g, unknown or other
  misc_feature (330)..(330): n is a, c, g, or t
tcagtcgtcgctcgcacgaccggtgctcgatttagacgacagctcagggtggggtcaaaaacccggggagggggtctgatttgcatggatggactctcccctctcagagtacgaagagagggagagatctgggggaanctcagcttcagctgtggtagagaagacaggactcaggacaatctccagcatggccgcttccctctcctcctccaccctctcactcactgcgcagggtcctgggcccagtctgtgctgctcncgccaccctnacgtcgtccgcgggaccccggnagcggccaccntctcttcgtagtggacgacactaccaangtaacggtaatacttagtgttattcgtaggtactacgacgactacctcccgaaagtaaccgtcccggaaccccctaaacgtccctaacgtaacctacccgaagtaaacgtaactaaacgtaccgacgacccggtcccgtaaccggaaccggggttccctaacgggtaccctaacgtttccgacccgtttacgacccgtaccgtacgttcgttaccgaccctaaccgtaccgaaccctccctacccgtacgtaccctaacgttcccgaaacgggttccggacccgttacccggaccgtaggtacgcggtaacggtacgtacgtactttaacttcggtaacgtcg

SEQ ID NO: 311025 - DNA, 595 bp, Homo sapiens
  misc_feature: GZ8MTXP02H0GSC.21.22.B11.1.454.CMB.2.raw
  modified_base (200)..(200): a, c, t, g, unknown or other
  misc_feature (200)..(200): n is a, c, g, or t
  modified_base (236)..(236): a, c, t, g, unknown or other
  misc_feature (236)..(236): n is a, c, g, or t
  modified_base (250)..(250): a, c, t, g, unknown or other
  misc_feature (250)..(250): n is a, c, g, or t
  modified_base (289)..(289): a, c, t, g, unknown or other
  misc_feature (289)..(289): n is a, c, g, or t
  modified_base (296)..(296): a, c, t, g, unknown or other
  misc_feature (296)..(296): n is a, c, g, or t
  modified_base (306)..(306): a, c, t, g, unknown or other
  misc_feature (306)..(306): n is a, c, g, or t
  modified_base (314)..(314): a, c, t, g, unknown or other
  misc_feature (314)..(314): n is a, c, g, or t
  modified_base (322)..(322): a, c, t, g, unknown or other
  misc_feature (322)..(322): n is a, c, g, or t
  modified_base (326)..(326): a, c, t, g, unknown or other
  misc_feature (326)..(326): n is a, c, g, or t
  modified_base (331)..(331): a, c, t, g, unknown or other
  misc_feature (331)..(331): n is a, c, g, or t
  modified_base (335)..(335): a, c, t, g, unknown or other
  misc_feature (335)..(335): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtcgtcgggacccccggnagacggtcacatctcttgttctggacgcaactcaanagtcgaagtaattntgtattctgtatcagcaactccagaatccggaccccaancctcacncagagaatancagcgccncgaggccngacntctcngctnagtctgcactcacgtcctcctagacccatcgaggtcgcccgtccgggtacgcggatcggacgtcgtagtaccttaattcgtcgagtacgtaaccgcggaacgggaacccagaaaaccgttgtacggggattacgaactaaccgtacgtgggtaacggtccgggtttgggggtaacttccgggggacggtaaaacccggaaccgtaaacggttccgtacccggtaccgtaaggggtccccacgggtttaacccgaaccggg

SEQ ID NO: 311026 - DNA, 729 bp, Homo sapiens
  misc_feature: GZ8MTXP02IL8II.21.22.B11.1.454.CMB.2.raw
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccacctcagcgtcgtcgggaccccggcagagggtcaccatcctcttgttctggacggcaactccaacagtacggaattaattatgtattcgtggtatcagcaactccgaaggactcggaccccctaaactccacactccaagaggaataatcaggccgtcctacgacggggtcccctaggacccgtatttccgtctacggccttaccaacgttctcgggcctaccctccgaccgtcccccttccgtacgaaccctagtccgacgggttccggggccttcccggggtaccgtagggacgttacgggacgggtccttaacggactttaacgtttacgttcggtacggtactaacgttccgggaaaccgggggacccataaaccggtagtacgggggattacgaaaacgtacgttacggtaggtaccgggttcgggggtttcggggtaacggtttcgggggaacccggggttaaagggaaaaccccgttaaaacggttccgggaaccccggtttaccggtaaacgggtacccggtaacccggaacccggttaaacccgggg

SEQ ID NO: 311027 - DNA, 703 bp, Homo sapiens
  misc_feature: GZ8MTXP02HU8LP.21.22.B11.1.454.CMB.2.raw
  modified_base (179)..(179): a, c, t, g, unknown or other
  misc_feature (179)..(179): n is a, c, g, or t
  modified_base (200)..(200): a, c, t, g, unknown or other
  misc_feature (200)..(200): n is a, c, g, or t
  modified_base (435)..(435): a, c, t, g, unknown or other
  misc_feature (435)..(435): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctnagcgtcgtcgggacccccggnaggacggtccacattctcttgttcgtggagacaactacaatagtacggaaattaattatgttacttcgtaggtactcaacgacctaaaccgtcccgaaggtaaacctccggaacccccctaaaatcccctactaactaccgaaggaaacgtaaataacgtccgaacggtcccgtaccctacggaacggggtttccccagaccgttacttccgtgtacggacctacgtaacgttcncgcctaaccctcgaccgtcccctaccgtataccagttcgaggttccgacccgtaccggggtactaagggtcgtcggaaggtcctacgtaaacgttacttactggtacgactaacgccggggaaccgggactaaccgaaagtagggtaggaacttacggaaaactaggtaccgtgggtaccgggtggggtttgggtacggtaccgggaacggaaccggtacctaaaacgtcggtacccgtacggtacgaccgaaccgttacccgaacgg

SEQ ID NO: 311028 - DNA, 695 bp, Homo sapiens
  misc_feature: GZ8MTXP02IE41S.21.22.B11.1.454.CMB.2.raw
  modified_base (201)..(201): a, c, t, g, unknown or other
  misc_feature (201)..(201): n is a, c, g, or t
  modified_base (238)..(238): a, c, t, g, unknown or other
  misc_feature (238)..(238): n is a, c, g, or t
  modified_base (323)..(323): a, c, t, g, unknown or other
  misc_feature (323)..(323): n is a, c, g, or t
  modified_base (589)..(589): a, c, t, g, unknown or other
  misc_feature (589)..(589): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtcgtcgggacccccgggnagagggtcaccatctcttgttctggagcaactccaanatcggaaataattatgtattctggtatcagcaaactcccaaggaactcggaccccccaaatccacactccgagaacggaataaancaagcccggtaccctcgaacggggtcccctggaaccgtactttccgtcgttcgggaccttacccgtaaaagttccgttcggggccctaaaccttccgaaccgggtccccccttaccccggttacgtaaacccccaattccgaacggggtttccggggccctttcccgggggtacccgaggggtaacgttggaacgggtcctaggtaacttaagtttaaccgtgtacgactacgtacgaacggggacaccgaaaacgtggtacgganagaaactaatcggtaggtacgggttcgggtttgggtacggttacggggaccggtaaacgaaaccgtaacggtacgtacccgtacgtacgtaccgacggaccgaacg

SEQ ID NO: 311029 - DNA, 645 bp, Homo sapiens
  misc_feature: GZ8MTXP02IH1PN.21.22.B11.1.454.CMB.2.raw
  modified_base (200)..(200): a, c, t, g, unknown or other
  misc_feature (200)..(200): n is a, c, g, or t
  modified_base (239)..(239): a, c, t, g, unknown or other
  misc_feature (239)..(239): n is a, c, g, or t
  modified_base (353)..(353): a, c, t, g, unknown or other
  misc_feature (353)..(353): n is a, c, g, or t
  modified_base (458)..(458): a, c, t, g, unknown or other
  misc_feature (458)..(458): n is a, c, g, or t
  modified_base (470)..(470): a, c, t, g, unknown or other
  misc_feature (470)..(470): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagcccaccctcagcgtcgtcgggaccccggnaggagggtcaccatctcttgttcgtggagcaactccaangtacggaataattatgtattctggtatcagccaactcccgaaggatccggaaccccccaaactcctcaactccgaagaaggaaatactcgagccggtccctcggacggggtccncgaccgacttctcgtggtcctacaagtcgtggccctacctcaccgccccttcccgagaccctagtcgaggtcggcccgtccggtaccgaggactggacgtcgtanacgttattacgngtcgacctagtccggaaccggactcgaaacgtggtagggaactagaaccgtaagttccgtagggtaccgggttgggggttttacgggacggggttacccggggacggggaaccggaaacccgtaagtacccggtacccgttacggtaccggcctaacccgggaccctaacccggg

SEQ ID NO: 311030 - DNA, 553 bp, Homo sapiens
  misc_feature: GZ8MTXP02FGY3H.21.22.B11.1.454.CMB.2.raw
  modified_base (198)..(198): a, c, t, g, unknown or other
  misc_feature (198)..(198): n is a, c, g, or t
  modified_base (222)..(222): a, c, t, g, unknown or other
  misc_feature (222)..(222): n is a, c, g, or t
  modified_base (237)..(237): a, c, t, g, unknown or other
  misc_feature (237)..(237): n is a, c, g, or t
  modified_base (330)..(330): a, c, t, g, unknown or other
  misc_feature (330)..(330): n is a, c, g, or t
  modified_base (340)..(340): a, c, t, g, unknown or other
  misc_feature (340)..(340): n is a, c, g, or t
  modified_base (446)..(446): a, c, t, g, unknown or other
  misc_feature (446)..(446): n is a, c, g, or t
  modified_base (452)..(452): a, c, t, g, unknown or other
  misc_feature (452)..(452): n is a, c, g, or t
  modified_base (477)..(477): a, c, t, g, unknown or other
  misc_feature (477)..(477): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccacctcagcgtctcgggacccccggnagagggtcaccatcctcttgttcnggagcaactccaacntcggaataatatgtatctggtatcagcaactccccaggaatcggacccccaaactcctcatccagaggaatatcagcggccctcaggggtccngaccgattcnctggctacaacgttctcggcacctcagccctcctgaccaatcagtgggctcccgggtcgaggactggacggctgaactattacctgtcgcaagtccacgggggacnccaaanagttcgggatgaacaaagttcaggngacggttggggtacgtcggggacggaggggtaaccaaaacgtgacccgtcgttacggacaaccggccctaaagggg

SEQ ID NO: 311031 - DNA, 607 bp, Homo sapiens
  misc_feature: GZ8MTXP02FTGRZ.21.22.B11.1.454.CMB.2.raw
  modified_base (198)..(198): a, c, t, g, unknown or other
  misc_feature (198)..(198): n is a, c, g, or t
  modified_base (295)..(295): a, c, t, g, unknown or other
  misc_feature (295)..(295): n is a, c, g, or t
  modified_base (309)..(309): a, c, t, g, unknown or other
  misc_feature (309)..(309): n is a, c, g, or t
  modified_base (336)..(336): a, c, t, g, unknown or other
  misc_feature (336)..(336): n is a, c, g, or t
  modified_base (477)..(477): a, c, t, g, unknown or other
  misc_feature (477)..(477): n is a, c, g, or t
  modified_base (493)..(493): a, c, t, g, unknown or other
  misc_feature (493)..(493): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctgggacccccggnaggagggtcaccatctcttgttctggagcaactccaacatcggaagttaatatgtattctggtatcagcaactcccaggaatcgaccccaaactccncatccagagaatancagccgcctgacgggtccctagaccgnttacctcgtcggctccgaacgtcgtggccacctcaccgccccttacccgtgaccctactcgtacggtcgggccttcccggggtccgaggtacgtggaacggtctacgtacttattacgtgtacgctagtaccgacggaacnccgaatggtagggtanacgaacgtacgtcgtagggtacggttcggggttagggtcggtacggggacggtaaccggtaaaccgtaacggtccggtaaccggtacgtaccggtaccgacggtacccgtacgg

SEQ ID NO: 311032 - DNA, 732 bp, Homo sapiens
  misc_feature: GZ8MTXP02FOKQ5.21.22.B11.1.454.CMB.2.raw
  modified_base (201)..(201): a, c, t, g, unknown or other
  misc_feature (201)..(201): n is a, c, g, or t
  modified_base (339)..(339): a, c, t, g, unknown or other
  misc_feature (339)..(339): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagcccaccctcagcgtccgtcgggaccccggnaggagggtcaccatctcttgttcgtggagcaactaccaacagtacggaaagttaattagtagttattctggttatcacgaccaacctccgaaggtaactaccgacccccaaactcctacactaccaagaacgaaatanacacggccgcctcggacgggtaccctgacctacttactcgtacgcctaccgtaacgttcgtgcccacctacgaccgtccctcctacgacctacgtcgaacgggtcggtcccggtcccgggtaccggaagtcggtagaccgggtactaaccgtcgtttaaaacgtttccgttagtaccgtaacccgtagtacccggggaaacggggacccaaagtaaaccgtaggttaccggaagttaaccggaaataaacccgttgggtaggttaaacggggtccggggtttaagggggttccggttaccgggggtaacggggaaaccggtaaaacgtaacccggtaaccggttacccggtaccggttaagggacccgtaaacccggacccgggtaaacccgg

SEQ ID NO: 311033 - DNA, 736 bp, Homo sapiens
  misc_feature: GZ8MTXP02IY1GW.21.22.B11.1.454.CMB.2.raw
  modified_base (201)..(201): a, c, t, g, unknown or other
  misc_feature (201)..(201): n is a, c, g, or t
  modified_base (305)..(305): a, c, t, g, unknown or other
  misc_feature (305)..(305): n is a, c, g, or t
  modified_base (320)..(320): a, c, t, g, unknown or other
  misc_feature (320)..(320): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagcccaccctcagcgtcgtcgggacccccggnagacgggtcaccatctcttgttctggagcaactccaacatacggaagtaattatgtattcgtgtatcagcaacctccgaaggactccgacccccaactcctcanaccagaacgaataancgaggccgtccctacggtacggggtcccctaggaccgtacttccgtccgtacgccttacgtaacgttcgtacggtcctacccgtcaccgtcccctacccgtacgacccgactccggacggtcggggtccccgttcccgggtaacggagggtagttacgggacggtactaggtaactttaggtttacttgggtactacgtaacgtccgggaaaccgggtaccgaaccgtaaaggtagggtacgggtaacgtacgtaaaacgtacgttacgggttacggggtaacggggttccgggggtttttaagggggtccggtttacgggggaacccgggtaaaccggggtaaacccgtaaaccgggttccggttacccggttaaccgggtaccggtaccgacccgggtaacccggtaaccccgg

SEQ ID NO: 311034 - DNA, 745 bp, Homo sapiens
  misc_feature: GZ8MTXP02GHR7E.21.22.B11.1.454.CMB.2.raw
  modified_base (200)..(200): a, c, t, g, unknown or other
  misc_feature (200)..(200): n is a, c, g, or t
  modified_base (213)..(213): a, c, t, g, unknown or other
  misc_feature (213)..(213): n is a, c, g, or t
  modified_base (335)..(335): a, c, t, g, unknown or other
  misc_feature (335)..(335): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctgggaccccccgggnaggacggtcaccntctcttgttctggacgacaactaccaacagtacggaatattagtagtattcgtagtatcagacaacgtccgaaggactccggaccccctaaatccctacactaccgaaggaacgtaataacncgaacggccgacccgtacggaccggggtacccctaggaccgttacttccgtcgtcggacccttaccgagttcgtcggacctaccctcgaccgtccccctacccgtacaaccctaacgttcgtaacgggtccgggtaccggttacccgggtaccggaggtacgtacgggaacggtaccgtacgttaacgtttaacgtttccgtaggtacgtacgtaaccgtaccgggaaccgggtacgaaccgaacggtaggtacggggtactaacggaaacttaacgttacggtcgggtacgggttcgggggttacgggggtacggttaccgggggaaacggggaaccgggtaaacccgtaaaaccggtcccggtaaacccggttccggtaacggtacccgaaccgggtaccccgaacgg

SEQ ID NO: 311035 - DNA, 693 bp, Homo sapiens
  misc_feature: GZ8MTXP02JIPSQ.21.22.B11.1.454.CMB.2.raw
  modified_base (179)..(179): a, c, t, g, unknown or other
  misc_feature (179)..(179): n is a, c, g, or t
  modified_base (212)..(212): a, c, t, g, unknown or other
  misc_feature (212)..(212): n is a, c, g, or t
  modified_base (222)..(222): a, c, t, g, unknown or other
  misc_feature (222)..(222): n is a, c, g, or t
  modified_base (252)..(252): a, c, t, g, unknown or other
  misc_feature (252)..(252): n is a, c, g, or t
  modified_base (420)..(420): a, c, t, g, unknown or other
  misc_feature (420)..(420): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccatcctnagcgtcgtcgggacccccggaggagggtcaccntctcttgtcnggagcaactcaacagtacggaagttaattntgttattcgtggtatcagaccaacctcccgaggaactcccggaaccccctaaactcctacactaccgaaggaagtaataacgtcgacggaccggccctaggaccggggtccctaggaccccgtatttcctcgtcggtcctaccgtaagtccgtcggacctaccgtccncgtcccctccacgtaacctactacgtacgggtcggcccgtacccgggacggacggtagtacgggacggtactacggtaacttacgtttacgtggtacgacctacggtaccggaacgggtacaaccgtaagaggttacgggaacgtacgaacctaagtccgtgggtaaacggggttcggggtttcggggtaccgggttaccgggggaccggtaaacgggtaacccgtaacggtaccggtacccgttacggtaccggtaccgaccgtaaccccgg

SEQ ID NO: 311036 - DNA, 609 bp, Homo sapiens
  misc_feature: GZ8MTXP02HM12S.21.22.B11.1.454.CMB.2.raw
  modified_base (179)..(179): a, c, t, g, unknown or other
  misc_feature (179)..(179): n is a, c, g, or t
  modified_base (201)..(201): a, c, t, g, unknown or other
  misc_feature (201)..(201): n is a, c, g, or t
  modified_base (237)..(237): a, c, t, g, unknown or other
  misc_feature (237)..(237): n is a, c, g, or t
  modified_base (344)..(344): a, c, t, g, unknown or other
  misc_feature (344)..(344): n is a, c, g, or t
  modified_base (378)..(378): a, c, t, g, unknown or other
  misc_feature (378)..(378): n is a, c, g, or t
  modified_base (382)..(382): a, c, t, g, unknown or other
  misc_feature (382)..(382): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctnagcgtcgtcgggacccccgggnagagggtcaccatctcttgtctggagcaactccaanatcggaatattatgtatctgtatcagccaactccgaaggatccggacccccaaatccctacatccgagaagaataatcagccgcctgacgggtcctgacgtacttcntacgctacgagtctcgcactcacgtccctccgtnaccntcgacggttcggcgttacccgggtcgacggtacgtgggtacggtcgtaactacgtttacttaccgttaggtaccgtatacgaccggaaaccggggtacaccgaaaacgtgtaggggtactaggaaacctaagtttccggaggtacgggttcgggtgggttacggtaccgggacgggtaaccggaaccgtaacgcggtaccgtacggtagccgacgtacccgaccggg

SEQ ID NO: 311037 - DNA, 644 bp, Homo sapiens
  misc_feature: GZ8MTXP02JT2VP.21.22.B11.1.454.CMB.2.raw
  modified_base (179)..(179): a, c, t, g, unknown or other
  misc_feature (179)..(179): n is a, c, g, or t
  modified_base (233)..(233): a, c, t, g, unknown or other
  misc_feature (233)..(233): n is a, c, g, or t
  modified_base (294)..(294): a, c, t, g, unknown or other
  misc_feature (294)..(294): n is a, c, g, or t
  modified_base (354)..(354): a, c, t, g, unknown or other
  misc_feature (354)..(354): n is a, c, g, or t
  modified_base (384)..(384): a, c, t, g, unknown or other
  misc_feature (384)..(384): n is a, c, g, or t
  modified_base (542)..(542): a, c, t, g, unknown or other
  misc_feature (542)..(542): n is a, c, g, or t
  modified_base (551)..(551): a, c, t, g, unknown or other
  misc_feature (551)..(551): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctnagcgtcctgggacccccggagagggtcaccatctcttgtctggagcaactcaantcggaatatatgtattctgtatacagcaactcccgaaggaactcggacccccaaatcctanactacccaagacgaataactcgagccgtcctacgaccggggtccagacccgtatccgtcnggacctcgaagttctcgggcctaacccgtnccgtccccgtacctacgaacccatcccgtaggtccgggtccgtccccggtaccggtaagggtctacgggtaaggtcctaacggtactttaaacgttccgtaggttaccgaccttacgtacggaacccgggtacacgtaaacggagtgggactacgganagttaccgnggtaacccggcggggtttagtcggggttcggacggggtaaccgtaccggaagttacggacccgtttacggacgttaccggacgttaccaccgg

SEQ ID NO: 311038 - DNA, 689 bp, Homo sapiens
  misc_feature: GZ8MTXP02IRMCX.21.22.B11.1.454.CMB.2.raw
  modified_base (200)..(200): a, c, t, g, unknown or other
  misc_feature (200)..(200): n is a, c, g, or t
  modified_base (242)..(242): a, c, t, g, unknown or other
  misc_feature (242)..(242): n is a, c, g, or t
  modified_base (269)..(269): a, c, t, g, unknown or other
  misc_feature (269)..(269): n is a, c, g, or t
tcagtcgtcgctcgcacgaccggtgctcgatttagacgacagctcaggggagcttcagctgtggtagagaagacaggactcaggacaatctccagcatggccggcttcctctcctcctcaccctcctcactcactgcgcagggtcctgggcccagtctgtgctgactcacgcccaccctcagcgtcgtcgggaccccggnaggacggtccaccgtatctcttgttctggagacaactccaanagtacggaatatagtgtattctaggtntacagcaaccctccaacggtatccgacccccaactcctactactaccgaagaacgtaaactacgtcgagtcccggaccctcggaacggggtcccctcggaccgtacgtttccctcgcggttaccctaccgtaacgtccgtacggcctacccttccgacgtcccccttacgaccgacctacgtacgacggttccgggtcgtcccggtaccggagagtcggacgtgacgttacgttaacttgtggtacccgtataccggtaccgggaaccgaccgtaacgtaacgtcggtacgacgtaacgaacctaggttcggaggtacggggttcggggtttcgggtacgggtaccggggtaacggggaacccgtaaacggtaaccggtaacggttaccgtacggacccggtaccgacgtaacccggccg

SEQ ID NO: 311039 - DNA, 603 bp, Homo sapiens
  misc_feature: GZ8MTXP02H5BT6.21.22.B11.1.454.CMB.2.raw
  modified_base (233)..(233): a, c, t, g, unknown or other
  misc_feature (233)..(233): n is a, c, g, or t
  modified_base (246)..(246): a, c, t, g, unknown or other
  misc_feature (246)..(246): n is a, c, g, or t
  modified_base (267)..(267): a, c, t, g, unknown or other
  misc_feature (267)..(267): n is a, c, g, or t
  modified_base (307)..(307): a, c, t, g, unknown or other
  misc_feature (307)..(307): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctcgggccagtctgtgctgactcacgccacctcagcgtcgtcgggaccccggcaggacggtcacatctcttgtctggagcactcaanatcgaagtaattngtattcgtgatcacgcaaccncgagactccgaccctaatctacacacgaagaagtaataanacgacgcgccgacgacgtaccgtacgacgtactctcgtcgtactactacgtcgtcgactactaccacgtcctacctacactactacgacgtacggtcgtaccggtacgacgtacgtacgtacgtacgtacgtacgttacgttacgtagtacgtacgacgacgacggacgacgaacgtacgtacggtacgtacgtaacgtaacgtacgtacggtaggtacggttacgggtacgggtacgggtacggaacggaacgtaacgtacggtaccgtaccgtacgtacgtaccgtaccgtacg

SEQ ID NO: 311040 - DNA, 687 bp, Homo sapiens
  misc_feature: GZ8MTXP02J2JBB.21.22.B11.1.454.CMB.2.raw
  modified_base (200)..(200): a, c, t, g, unknown or other
  misc_feature (200)..(200): n is a, c, g, or t
  modified_base (355)..(355): a, c, t, g, unknown or other
  misc_feature (355)..(355): n is a, c, g, or t
  modified_base (495)..(495): a, c, t, g, unknown or other
  misc_feature (495)..(495): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtcgtcgggacccccggnagacgggtcaccatctcttgtcgtggagcaactcaacatacggaagttaatatgtattctggtatcagcaactccaggtactccggacccccaaactcctacactccgaagaaggtaaactaatccgaagcccggtaccctcggtacgggtcccnggaccgtacttcctcgtcggcctacgtacgtcgtcggaccacccgtcacgcccctcccgtacgaacccgctacggacggtcgggtcccgttacccggggacgaggtcgtggacggtcctagtaccttaagttcctggtcnccgtagtaccgggaacgggactaacccgtaaagacggtagggtaacacggtaaaactaacgttcggaacggggtgggttacgggggttcggttacggggttcccggggaacggggttaaaccggaaccggtaacgtcccggggtaaacccgttccggttaaaggtcccgtaaaaccggccgttaaacccggg

SEQ ID NO: 311041 - DNA, 594 bp, Homo sapiens
  misc_feature: GZ8MTXP02FE9PE.21.22.B11.1.454.CMB.2.raw
  modified_base (321)..(321): a, c, t, g, unknown or other
  misc_feature (321)..(321): n is a, c, g, or t
  modified_base (360)..(360): a, c, t, g, unknown or other
  misc_feature (360)..(360): n is a, c, g, or t
tcagtcgtcgctcgcacgaccggtgctcgatttagacgacagctcaggagagcttcagctgtggtagagaagacaggactcaggacaatctccagcatggccggcttccctctcctcctcaccctcctcactcactgcgcagggtcctgggcccagtctgtgctgactcagccaccctcagcgtctcgggacccccggcagagggtcaccatctcttgttctggagcaactccaacatcggaagtaattatgtattctggtatcagcaactcccaaggaatcggaccccccaaaatcctacaactccaagacggaataaancagccggccctgacggggtcccctggaccccgtattccnctggcctccaaagttctggccacctcacgccctccctgacccattccaggtcgggcctccgggtaccgagggtataggagctacgaacttattactgtgactaatccgaaccgggacgacaaacgagtaggggatgaaacctaagtcgtaggacgggtcggggtttgggtcgttccggggacggtaagggaaccctaaaagtcggaacccgtccgttaaaggccacggaacccg

SEQ ID NO: 311042 - DNA, 558 bp, Homo sapiens
  misc_feature: GZ8MTXP02GRHQA.21.22.B11.1.454.CMB.2.raw
  modified_base (239)..(239): a, c, t, g, unknown or other
  misc_feature (239)..(239): n is a, c, g, or t
  modified_base (369)..(369): a, c, t, g, unknown or other
  misc_feature (369)..(369): n is a, c, g, or t
  modified_base (397)..(397): a, c, t, g, unknown or other
  misc_feature (397)..(397): n is a, c, g, or t
  modified_base (494)..(494): a, c, t, g, unknown or other
  misc_feature (494)..(494): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccacctcagcgtctcgggaccccccgggcaggagggtccaccatctcttgtctggagcaactccaacntcggaatatatgtatctggtatcagcaactcccgaaggactcggaccccctaaatccctcgatccagtacggaataatcaagccggtacctcgaacggggtcccagaccgattccactgctcaacgttcngccactcacgtccctaccgtgaccctancgtaggcggtccacggtcgagatgacgctagactttattacgtggtacacgtagaccggacggaccacaacgacgtaggactagactagtcgtaggnggttacggtggtacggtacggacgtacggaacaacgtcgacccgtagacgtacgacgtacgacg

SEQ ID NO: 311043 - DNA, 631 bp, Homo sapiens
  misc_feature: GZ8MTXP02JU632.21.22.B11.1.454.CMB.2.raw
  modified_base (180)..(180): a, c, t, g, unknown or other
  misc_feature (180)..(180): n is a, c, g, or t
  modified_base (202)..(202): a, c, t, g, unknown or other
  misc_feature (202)..(202): n is a, c, g, or t
  modified_base (225)..(225): a, c, t, g, unknown or other
  misc_feature (225)..(225): n is a, c, g, or t
  modified_base (239)..(239): a, c, t, g, unknown or other
  misc_feature (239)..(239): n is a, c, g, or t
  modified_base (294)..(294): a, c, t, g, unknown or other
  misc_feature (294)..(294): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagcccaccctnagcgtcgtcgggaccccccggnaggagggtcaccatctcttgtcnggagcaactccaantcggaatattatgtattctggtatcagcaactcccagaatcggcccccaaatccnatccagagaataatcagccggcctcgaggggtccctagaccgattcctacgtggcctcgaacgtctcggcaccctcacgccctccctgacccatcgacggtgggcctccggtacccgaggacttcggacggtctaggaaccttagttaccgttggtagaccgtactcggaaccgggtaccgacaaacgtacgttcggggattacgaacctaattccgtaggtacggtaccggggtttggggtcggttaccgggaccggtaacggggtaacccgaaaacggtcggtaaaccccgttacccggttaagggtaccccaacgggtaccccggtaaaccggg

SEQ ID NO: 311044 - DNA, 684 bp, Homo sapiens
  misc_feature: GZ8MTXP02FLHKK.21.22.B11.1.454.CMB.2.raw
  modified_base (202)..(202): a, c, t, g, unknown or other
  misc_feature (202)..(202): n is a, c, g, or t
  modified_base (214)..(214): a, c, t, g, unknown or other
  misc_feature (214)..(214): n is a, c, g, or t
  modified_base (218)..(218): a, c, t, g, unknown or other
  misc_feature (218)..(218): n is a, c, g, or t
  modified_base (225)..(225): a, c, t, g, unknown or other
  misc_feature (225)..(225): n is a, c, g, or t
  modified_base (237)..(237): a, c, t, g, unknown or other
  misc_feature (237)..(237): n is a, c, g, or t
  modified_base (326)..(326): a, c, t, g, unknown or other
  misc_feature (326)..(326): n is a, c, g, or t
  modified_base (499)..(499): a, c, t, g, unknown or other
  misc_feature (499)..(499): n is a, c, g, or t
tcagtcgtcgctcgcacgaccggtgctcgatttagacgacagctcaggggagcttcagctgtggtagagaagacaggactcaggacaatctccagcatggccggcttcccctctcctcctcaccctcctcactcactgcgcgagggtcctgggcccagtctgtgctgactcacgcccaccctcagcgtcgtcggaccccggnagagggtcaccntctnttgttcnggagcactcacntacggaatattatgtattgtggtatcagcaaacctcccaggaactccggaccccctaaacctcctacactaccgaaggaagaaattacncgaccggcccggtcccttcggaccggggtcccctacggtaccgtacctttcctccgtcggcctaccgacggttccgcgacccacctcaccgtccctccgtacgacctactacgtacggtcgggtcccttccgggaccgagacgttacggacgtcgtacgtaccttattacggngtacgaccgtacgtaccgggaccgggaccgtacaaacgtaggtcgggaactagtaaccgtaatccggttaggaccgggttcggggttagggttccggttaccggggaaccgggtaaccggtaaaccccgaaacgtcccggtaaacccgttaccggtacggtacccgaccggaccccgtaaacggg

SEQ ID NO: 311045 - DNA, 750 bp, Homo sapiens
  misc_feature: GZ8MTXP02ITB5B.21.22.B11.1.454.CMB.2.raw
  modified_base (201)..(201): a, c, t, g, unknown or other
  misc_feature (201)..(201): n is a, c, g, or t
  modified_base (301)..(301): a, c, t, g, unknown or other
  misc_feature (301)..(301): n is a, c, g, or t
  modified_base (315)..(315): a, c, t, g, unknown or other
  misc_feature (315)..(315): n is a, c, g, or t
tcagtcgtcgctcgcacgaccggtgctcgatttagacgacagctcagggggagcttcagctgtggtagagaagacaggactcaggacaatctccagcatggccggcttccctctcctcctcaccctcctcactcactgcgcagggtcctgggcccagtctgtgctgactcagccaccctcagcgtctcggggacccccggnagacgggtcaccatctcttgttctggagcaactccaacatacggaaagtaattatgtattctggtatcagcaactcccaggaactcggacccccaatccncatccagagataancagccgcctcgacggggtccctagaccgtacttcctctcggccctacgtaaacgttccgtcgggacctacccgttacgaccgtccccctcccgtacggaccctaagtccgaaggtcgggtcccgttcccggggtacccgtaagggtacgttagggtaccggtaccgttacggtaactttaacgtttaaacccgtttgggtaccggtacctaacggtttaccgggtaaacccccggggggaatacccccggaaaagtaccggggttaagggggtaacttaaccgaaacgttaaacgtcggttaagggaacgggttcgggggtttacgggggtcggtttaccgggggaacgggggttaaccggaaaccttaaaaccgggtcggaaaccccgggtttaccgtaccgggttaacccgaccggtacccggtaacccgggg

SEQ ID NO: 311046 - DNA, 749 bp, Homo sapiens
  misc_feature: GZ8MTXP02I97VK.21.22.B11.1.454.CMB.2.raw
  modified_base (199)..(199): a, c, t, g, unknown or other
  misc_feature (199)..(199): n is a, c, g, or t
  modified_base (239)..(239): a, c, t, g, unknown or other
  misc_feature (239)..(239): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtcgtcgggaccccggnagagggtcaccgatctcgttgtctggacgacaactccaangtacggtaatatatgtattcaggtatccagcaactccgaggaactccgacccctaaatctcactccaagagtaatactcgacggcgtaccctcgacggggttccccagggtacctatttccgtcgtggtacccttaccgtaaacgttctacggggccctaaacccgtttcgaacccggttccccctttaccggacggtaaaccctaacgttctaaacgggggtcccggtaacccggtcccccgggttaacggaaagggtctacgggggtaaacccggtttctaaacggttaactttaaccgtttacgtacggttacgaccgtaacggtaccgggaaaccggtacctaaacgtaacgggtagggtaacggtacgtaacgaaacgtaacgttacggtacgggtacggggtttacgggggtttacgggttccggtaaccgggggaaccgggtaaccggtaaaccgtaaacggttccggtaaccgttacggtacgtaccgaaccggtacgtccg

SEQ ID NO: 311047 - DNA, 608 bp, Homo sapiens
  misc_feature: GZ8MTXP02JBBBF.21.22.B11.1.454.CMB.2.raw
  modified_base (200)..(200): a, c, t, g, unknown or other
  misc_feature (200)..(200): n is a, c, g, or t
  modified_base (217)..(217): a, c, t, g, unknown or other
  misc_feature (217)..(217): n is a, c, g, or t
  modified_base (311)..(311): a, c, t, g, unknown or other
  misc_feature (311)..(311): n is a, c, g, or t
  modified_base (368)..(368): a, c, t, g, unknown or other
  misc_feature (368)..(368): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtcgtcgggacccccggnaggagggtcaccatctnttgttctggaggcaacctccaacatcggaaataattatgtattctgtatcagcactccaggactcgaccccaatcctcatccaagagtaaatancgacgcgaccctaggacggtccctagaccgtacttcgtcgcgtcctacgaacgttcncgggtccaacccgtcaccgtcccctccgtacgaacccagtcgaggttcggccgtccgggtaccgagacgtcggacgtctagtaacttagtactggtacgctaacggtcggaacggaccgacgtaacgagtagggacagtaactaagtcgtaggaggggttcgggttagggtacggttacggggaccggaacggaccgtaaaacggcgtaaaccggtcgtacggcgaccggaccggtaccg

SEQ ID NO: 311048 - DNA, 714 bp, Homo sapiens
  misc_feature: GZ8MTXP02I2SUW.21.22.B11.1.454.CMB.2.raw
  modified_base (201)..(201): a, c, t, g, unknown or other
  misc_feature (201)..(201): n is a, c, g, or t
  modified_base (239)..(239): a, c, t, g, unknown or other
  misc_feature (239)..(239): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtcgtcggggacccccggnaggagggtcaccatctcttgttctggagcaactccaantcggaataattatgtattctgtatcagcaactccaggaactccggacccccaaactccctcactaccgaagaaggtaaataactcgacggccggaccctacgacggggtccctacggaccgtacttctcgtcggcctacccgtaagtcctcgggcctaccgtccaccgtccctacccgtagaaccctactcggtacggttcggggcccgttacccggggtacccgaagggtacgtacgggtacggtccttagggtaacttaaacgtttaccggtgttcggacctacgtacccgggaacgggtaaccgaccgaaacgtacgggtgggaactacgaaacgttaacgtcgttaggggacggttcgggggtttacggggacggtttcccggggaacggggttaacggtaaccccgtaaaaggttcccggggacccgtttaccccgggaggtacccgaaacccggtaccggaaacccggg

SEQ ID NO: 311049 - DNA, 581 bp, Homo sapiens
  misc_feature: GZ8MTXP02J3CKP.21.22.B11.1.454.CMB.2.raw
  modified_base (232)..(232): a, c, t, g, unknown or other
  misc_feature (232)..(232): n is a, c, g, or t
  modified_base (234)..(234): a, c, t, g, unknown or other
  misc_feature (234)..(234): n is a, c, g, or t
  modified_base (241)..(241): a, c, t, g, unknown or other
  misc_feature (241)..(241): n is a, c, g, or t
  modified_base (247)..(247): a, c, t, g, unknown or other
  misc_feature (247)..(247): n is a, c, g, or t
  modified_base (251)..(251): a, c, t, g, unknown or other
  misc_feature (251)..(251): n is a, c, g, or t
  modified_base (253)..(253): a, c, t, g, unknown or other
  misc_feature (253)..(253): n is a, c, g, or t
  modified_base (275)..(275): a, c, t, g, unknown or other
  misc_feature (275)..(275): n is a, c, g, or t
  modified_base (277)..(277): a, c, t, g, unknown or other
  misc_feature (277)..(277): n is a, c, g, or t
  modified_base (290)..(290): a, c, t, g, unknown or other
  misc_feature (290)..(290): n is a, c, g, or t
  modified_base (299)..(299): a, c, t, g, unknown or other
  misc_feature (299)..(299): n is a, c, g, or t
  modified_base (319)..(319): a, c, t, g, unknown or other
  misc_feature (319)..(319): n is a, c, g, or t
  modified_base (424)..(424): a, c, t, g, unknown or other
  misc_feature (424)..(424): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtcgtcgggacccccggagagggtcaccatctcttgtctggagcactcanancgatatntgtatntgtntnagcactccagatcgacccaatncnatccagagaatancacgcgccncgacggtccagccctattcncgtgtcctacacgtctgccctactcacgtccctccacactacgtcgacggttcggcgtccggtccggagaccgtggaccggcttacggacttaatccgtggtccncgacgtaccgaacggcgaacaacgtgagggtacaggaactaacggttcagggacgggtttacggggttcgggttaccggtacgggaccggggtaaaccggtaacgaaaaccggtcccggtaaccttacccggtacggtaccggaaccgtaacccggg

SEQ ID NO: 311050 - DNA, 739 bp, Homo sapiens
  misc_feature: GZ8MTXP02GIFEG.21.22.B11.1.454.CMB.2.raw
  modified_base (204)..(204): a, c, t, g, unknown or other
  misc_feature (204)..(204): n is a, c, g, or t
  modified_base (220)..(220): a, c, t, g, unknown or other
  misc_feature (220)..(220): n is a, c, g, or t
  modified_base (242)..(242): a, c, t, g, unknown or other
  misc_feature (242)..(242): n is a, c, g, or t
  modified_base (263)..(263): a, c, t, g, unknown or other
  misc_feature (263)..(263): n is a, c, g, or t
  modified_base (268)..(268): a, c, t, g, unknown or other
  misc_feature (268)..(268): n is a, c, g, or t
  modified_base (276)..(276): a, c, t, g, unknown or other
  misc_feature (276)..(276): n is a, c, g, or t
tcagtcgtcgctcgcacgaccggtgctcgatttagacgacagctcaggggagcttcagctgtggtagagaagacaggactcaggacaatctccagcatggccggcttccctctcctcctccaccctcctcactcactgcgcgagggtcctgggcccagtctgtgctgactcacgcccacctcacgcgtccgtcgggaccccggnaggacggcaccatctnttgtcgtggagacactaccaanagtacggaattatatgtattnagtancagcaccncaagactccgaccccaactcctacactacgaaggaagtaaataactacgacggcccggtacccttacggaccggggttaccccgtacggtaccttaccgtttccgtaccggtcgtacccttaccgtaaacgtccgtccggaccctaacccttccgaccgtcccccttaaccgccgaaaccctacgtacccggtacgggttccggtacccgtacccggggtacgtaacggtaggttcggaaggtaccttacgtaaactttaggttacctggtacgacgttaccgaccgggacgggaaaacctcgaaaagtaggtacggacgttaaacgtactaaacgttcgggtggttacggggttaccgggggttttggggtacggttccgggggtaaaaccgacggggtaaacccgtaaaacgttcccggtaaccggttaccggcgtaaacgggccccgaccggtaaaccgg

SEQ ID NO: 311051 - DNA, 717 bp, Homo sapiens
  misc_feature: GZ8MTXP02IR8WV.21.22.B11.1.454.CMB.2.raw
  modified_base (302)..(302): a, c, t, g, unknown or other
  misc_feature (302)..(302): n is a, c, g, or t
  modified_base (477)..(477): a, c, t, g, unknown or other
  misc_feature (477)..(477): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctcgggacccccggcaggacgggtcaccatctcttgttctggaggcaactccaacagtacggaagtaattatgtattctaggtatcagcaacctccaggaatcggacccccaaatccncactccagaagaactaatcgagccggcctacgacggggtcccagtaccgtacttcctcgtcggctaccgaagttcctcgggacctacctccgacgccccttcccgacgaccctacgtcgacggtcggaccgtcccgggtacgaggtactgacggtcctagacttaacgtttacgnggtacgtactacgtacccgggaaacggggacctaccgaaaaccgttaggtacgggtaaccttaagaaaaccgtaaacgttccgtagggggtaaccgggttacgggggttttcgggggtaaccggtttacccgggggaaacggggttaacccggaaaaccccgtaaaaacggttcccggggaaaccccgtttaaccggaaaccgggttaccgaaacccgggaaccccggttaaacccgggg

SEQ ID NO: 311052 - DNA, 575 bp, Homo sapiens
  misc_feature: GZ8MTXP02I8O6Q.21.22.B11.1.454.CMB.2.raw
  modified_base (200)..(200): a, c, t, g, unknown or other
  misc_feature (200)..(200): n is a, c, g, or t
  modified_base (298)..(298): a, c, t, g, unknown or other
  misc_feature (298)..(298): n is a, c, g, or t
  modified_base (403)..(403): a, c, t, g, unknown or other
  misc_feature (403)..(403): n is a, c, g, or t
  modified_base (476)..(476): a, c, t, g, unknown or other
  misc_feature (476)..(476): n is a, c, g, or t
  modified_base (498)..(498): a, c, t, g, unknown or other
  misc_feature (498)..(498): n is a, c, g, or t
  modified_base (504)..(504): a, c, t, g, unknown or other
  misc_feature (504)..(504): n is a, c, g, or t
  modified_base (516)..(516): a, c, t, g, unknown or other
  misc_feature (516)..(516): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtcgtcgggacccccggnaggagggtcaccatctcttgttctggagcaactccaacatacggaagtaattatgtaattctggtatcagcaactccaggaactcgaccccaatccanactccagagaatatcagccgcctcggacgggtccagaccgtacttctcgtacggcctaccgaagttctcggcctacctccacgtcccctacctcgaaccctaacncgtaacggtcgggcccgttcccgggaaccgaggtacgtcggaggtcctaggaaccttattaccgtgtacgtanagtaccgggaggacacgaaagngtaganagacatcgtggnggtcggttggtcggtcggaacggacgaacgaagtacgaccgtacgacgcgacgacgacg

SEQ ID NO: 311053 - DNA, 646 bp, Homo sapiens
  misc_feature: GZ8MTXP02H2RT3.21.22.B11.1.454.CMB.2.raw
  modified_base (419)..(419): a, c, t, g, unknown or other
  misc_feature (419)..(419): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactacgcagggtcctgggcccagtctgtgctgactcacgccaccctcagcgtcgtcggggacccccgggcagagggtccaccatctcttgttctggagcaactccaacatacggaagtaattatgtattctagtatcagacactaccaggaaactcggacccccaaactccacactccagaacgaatatacagccgtcctacgacgggtccctagaccgtattccctcgcggtctaccgacgtctcggcctacctccacgtccccttcccgagacccacttccggnggtccggtccgtacccgggtacgaacggtacgtggacgtcgtacgtacttacgttacgtcgtcgactacgtaccggaaccgggaccgacaaaggtaggtaggaactacgaaactagtcggtaggtacggggtttccggggttagggtccggttacggggaccgggtaaccggtaaccgtaaacgtccggtacccgtacggtacgtaccgaccgtaccgtacgtcccg

SEQ ID NO: 311054 - DNA, 641 bp, Homo sapiens
  misc_feature: GZ8MTXP02GOGKH.21.22.B11.1.454.CMB.2.raw
  modified_base (201)..(201): a, c, t, g, unknown or other
  misc_feature (201)..(201): n is a, c, g, or t
  modified_base (420)..(420): a, c, t, g, unknown or other
  misc_feature (420)..(420): n is a, c, g, or t
  modified_base (529)..(529): a, c, t, g, unknown or other
  misc_feature (529)..(529): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcacgccaccctcagcgtcgtcgggacccccggnagagggtcaccatctcttgttctggaggcaactccaaactatacggaaagtaattagtagttattcgtggtatcagacaacctccgaaggaactccggacccccaaactcctacactccaagacgaataatcacgcgcctcgacggggtccaggaccgtacttctacgtcggtctaccgtaacgttcgtcggaccaccgttcgaccgtccccttcccgngaacccctagtccgtagggttcgggacccgttcccgggtacggaacggtacggtggaacggtcctagtaacgttaacttacgtgtcgactagtaccgggaacgggaccncgaaacgtggtacgggatagaacagttcagggacgtcggggttcggacggttcgggacggtacggaacctaaaggccgtaccggttaccgaaggtccgaacgccggtaacgg

SEQ ID NO: 311055 - DNA, 673 bp, Homo sapiens
  misc_feature: GZ8MTXP02IQTW9.21.22.B11.1.454.CMB.2.raw
  modified_base (204)..(204): a, c, t, g, unknown or other
  misc_feature (204)..(204): n is a, c, g, or t
  modified_base (345)..(345): a, c, t, g, unknown or other
  misc_feature (345)..(345): n is a, c, g, or t
  modified_base (375)..(375): a, c, t, g, unknown or other
  misc_feature (375)..(375): n is a, c, g, or t
  modified_base (437)..(437): a, c, t, g, unknown or other
  misc_feature (437)..(437): n is a, c, g, or t
  modified_base (561)..(561): a, c, t, g, unknown or other
  misc_feature (561)..(561): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcgagcccaccctcagcgttccgacgggacccccggntaggacggtccacctatccgttcttacggtttcgacgggacgaccaaccgtaccaaacgtacgtacgggaaagttattatcgtaatttcgtagtctacacgactaaccctccgaaggactccggaacccccctaatccctnactccgaagacgaatactcgacgccgtccncggacggtccctagacgtcttcgcgtcggacctacgtacgtcgtaccgtccaccgttacccnccgtcccgtaccgtacgtaacctacgtcggtaccgggtcggtacccggtaccgggtacggacgtagacggtacgtacgtacgtacttacgttcgtgaccgtacgaccgtacggaaccgtacganaacgtagcgtagtaacacgtacgtaggacggtcgggtacgggttacgggtcggtacggacggggtaaaccgtaacgaacggtacgtacgtacgaccgtaccgcgaccggacg

SEQ ID NO: 311056 - DNA, 717 bp, Homo sapiens
  misc_feature: GZ8MTXP02I76KJ.21.22.B11.1.454.CMB.2.raw
  modified_base (199)..(199): a, c, t, g, unknown or other
  misc_feature (199)..(199): n is a, c, g, or t
  modified_base (238)..(238): a, c, t, g, unknown or other
  misc_feature (238)..(238): n is a, c, g, or t
  modified_base (320)..(320): a, c, t, g, unknown or other
  misc_feature (320)..(320): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctcgggacccccggnaggacgggtcaccatcttcttgtctggagcaactccaantacggaagtattatgttattcgtggtatcagctaactccgaaggactccggacccccaaactcctacactccagagtaatanctacgccgccctcggtacgggtcccctggaccgtattccgtctcggtctaccgacgttcgtcggccacccttcgaccgtcccttacccgacaccctataccgttacggccgggtaccgttcccgggtaccggtaaggtaccgtaggtacgggtactacggtaacgtttaaaccgtttacgttcgggtctaacggtacttacccggggaaacggggtaacccaccgtaaaacgttgggaacggggttctaaacgtaccgttaaaacgttccggagggttaacgggttacccgggggtttgggtaaacgggttccggggaacgggttaaccgggaaaccgtaaccgttcgggtaaacccccgtggttaaacggccgtaaacccgggaccgttaaccggg

SEQ ID NO: 311057 - DNA, 578 bp, Homo sapiens
  misc_feature: GZ8MTXP02JGS35.21.22.B11.1.454.CMB.2.raw
  modified_base (198)..(198): a, c, t, g, unknown or other
  misc_feature (198)..(198): n is a, c, g, or t
  modified_base (237)..(237): a, c, t, g, unknown or other
  misc_feature (237)..(237): n is a, c, g, or t
  modified_base (255)..(255): a, c, t, g, unknown or other
  misc_feature (255)..(255): n is a, c, g, or t
  modified_base (312)..(312): a, c, t, g, unknown or other
  misc_feature (312)..(312): n is a, c, g, or t
  modified_base (331)..(331): a, c, t, g, unknown or other
  misc_feature (331)..(331): n is a, c, g, or t
  modified_base (356)..(356): a, c, t, g, unknown or other
  misc_feature (356)..(356): n is a, c, g, or t
  modified_base (415)..(415): a, c, t, g, unknown or other
  misc_feature (415)..(415): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccacctcagcgtcgtcgggaccccggnagacggtcaccatctcttgttctggacgacaactccaanatcggaagtactatagtnttcgtgtatcagcaactccgaagaactcggaccccaatcctacacgccagagaatancgacgcgcctgacggtccngcctactctcgtcgcctacgacgtncgcctacgtcacgtccctacctcgacacgtcgcggtcgcctcgttcgtaccgagggtanacggcgtcataccgttatctgtacacgagtaccggaacggacgacctaaggagtagggatacgaactacgttcggaaagttcggtaggggttcgggttacgtcggggtacgggaaaccgtaacgtacgtaccggtccggtaccgtacgtaccgacggtaccgg

SEQ ID NO: 311058 - DNA, 677 bp, Homo sapiens
  misc_feature: GZ8MTXP02I5GSQ.21.22.B11.1.454.CMB.2.raw
  modified_base (179)..(179): a, c, t, g, unknown or other
  misc_feature (179)..(179): n is a, c, g, or t
  modified_base (199)..(199): a, c, t, g, unknown or other
  misc_feature (199)..(199): n is a, c, g, or t
  modified_base (260)..(260): a, c, t, g, unknown or other
  misc_feature (260)..(260): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctnagcgtctcgggacccccggnaggagggtcaccatctcttgttctggaggcaactccaacatcggaagtaattatgtattcnggttatcagcaactcccaggaatcggaccccccaaatcccacactccagaggaataactcaggcgccctcgacggggtcccctagaccgactttactccgtggcccttcgaaaccgttctcgggcctaccctcgtaccgcccccttaccgacgaccctatccgtaagtcggggctcccgggttaccgaggtactggacgggtactacgacgttaaactttaacgtgtcgactacgtcgaaccgggaaccgcgaaacgtagtagggaacgtagaacgtaaaattcggcggtaaagggtcggggtttaaacgggggttcgggttacggggaccggggtaaacggggtaaacccctaaaaacggttcgggtaaacccgttacccggttaacggtacggacgtacccccgggtaaaacggg

SEQ ID NO: 311059 - DNA, 687 bp, Homo sapiens
  misc_feature: GZ8MTXP02IA9E8.21.22.B11.1.454.CMB.2.raw
  modified_base (201)..(201): a, c, t, g, unknown or other
  misc_feature (201)..(201): n is a, c, g, or t
  modified_base (273)..(273): a, c, t, g, unknown or other
  misc_feature (273)..(273): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtcgtcgggacccccgggnaggacgggtcaccatctcttgttctggagcaactccaacatcggaaagtattatgtattctgatcagcaacnccaggaactcgacccccaatcctcactccaagaagaataactcagccggccctcgacggggtccctgaccgtacttcctcgtcggcctactaagtctcggacctaccctcgaccgtcccctcctacgaaccctacgtacgaggttcggggcctcccggggtaccgagggtactgggaacgtctcgtaaaccttagtttacctgggtacttaccgaacgtccgggaaacggggtaccgaaaccaaagttaggaggggttaactaggaaaactaaacgttccgtaggggtaaaccgggttgggtttacgggggttacggttccgggggacgggggtaaaaccggggaaaccctaaaacggttcggaaaacccccggttcttaacgggggtaccctaaccggtaccccggaaccggg

SEQ ID NO: 311060 - DNA, 628 bp, Homo sapiens
  misc_feature: GZ8MTXP02JRP1W.21.22.B11.1.454.CMB.2.raw
  modified_base (237)..(237): a, c, t, g, unknown or other
  misc_feature (237)..(237): n is a, c, g, or t
  modified_base (310)..(310): a, c, t, g, unknown or other
  misc_feature (310)..(310): n is a, c, g, or t
  modified_base (340)..(340): a, c, t, g, unknown or other
  misc_feature (340)..(340): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtcgtcgggacccccggcagagggtcaccatctcttgtctggagcaactccaacntacggaagtaattatgtattctggtatcagcaactccaaggactcgaccccaaactcctcactcagagaatancagcgcctgacgggtcctgaccgtacttcncgtcggtcctccgaagttcgtcggccacctccgaccgtcccgtacccctacgaccctacgtccgacggttcggggcccgtacccgggttacccggaggtaccgtaggaacgggtctacggtacttaacgttacgttggtcgactagttaccgggaccgggacgtaccgaaacgtaggttaggggactacgtaacgtaagttccgtaggacggggtccggggttggggtacgttcgggacggggtacggacgaaacggtcgtaccgtccgtaggtccacggtaccacgg

SEQ ID NO: 311061 - DNA, 647 bp, Homo sapiens
  misc_feature: GZ8MTXP02GSWRK.21.22.B11.1.454.CMB.2.raw
  modified_base (200)..(200): a, c, t, g, unknown or other
  misc_feature (200)..(200): n is a, c, g, or t
  modified_base (236)..(236): a, c, t, g, unknown or other
  misc_feature (236)..(236): n is a, c, g, or t
  modified_base (293)..(293): a, c, t, g, unknown or other
  misc_feature (293)..(293): n is a, c, g, or t
  modified_base (308)..(308): a, c, t, g, unknown or other
  misc_feature (308)..(308): n is a, c, g, or t
  modified_base (339)..(339): a, c, t, g, unknown or other
  misc_feature (339)..(339): n is a, c, g, or t
  modified_base (342)..(342): a, c, t, g, unknown or other
  misc_feature (342)..(342): n is a, c, g, or t
  modified_base (359)..(359): a, c, t, g, unknown or other
  misc_feature (359)..(359): n is a, c, g, or t
  modified_base (440)..(440): a, c, t, g, unknown or other
  misc_feature (440)..(440): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagcccaccctcagcgtctcgggacccccggnaggaggtcaccatctcttgtctggagcaactccaantacggaataattatgttattcgtggtatcagcaactccgagactcgaccccaatccnactccagagaatacncgacgccggcctggaccgggtcctagacctntcnctcgcctacgtacgtcncggcctactcgacgtcccctaccgtcgaacctctacgtacggtcgggtcccgtaccggtccgaaggtacgtacggacggtntacgtaactttacgtagtcgtacgcctagtacccggaccgggaaactaccgaaagtcggggtaagtacgtacggaaaacttcggttacggtacgggtacgggttccgggggttttagggggtacggttacccgggggaaacgggttaacccggaaacgtaaaccgtcggtaaacccgtcggtaaacgtcgacccgttaccggaccgg

SEQ ID NO: 311062 - DNA, 750 bp, Homo sapiens
  misc_feature: GZ8MTXP02FNWNJ.21.22.B11.1.454.CMB.2.raw
  modified_base (286)..(286): a, c, t, g, unknown or other
  misc_feature (286)..(286): n is a, c, g, or t
  modified_base (320)..(320): a, c, t, g, unknown or other
  misc_feature (320)..(320): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcacgcccaccctcacgcgtccgtcgggacccccgggcaggacgggtccaccatccttctttggttcgtaggacggcaactccaacatacggaaattaatatgttattcgtggtatcancaacctccaaggactccggacccccaaactcctnactaccgaagaagaaatatcgacgccgtacccgtacggtaccggggtcctacggaccgttaccttcgtccgtcggtcctacgtaaccggttcgtcgggcctacccgtactacccgtccccctaccctaccgtaacccgtagtaccgtaacgggtcgggggtaacccgttcccgggttaacccgggaggtaaacggttcgggaacgtcgtaccggtaactttaaagttacgttacggtcgaccttaccgaccgggtaacggaaccgtaacgaaccgtagggtacgggtaactaacgtaacgttaacgttcggtacggggttaggggttcgggggttacgggttaccggggttacggggaaccggggtaaacgtaaccggtaaacggtaccggtaaccggtacggtacggtaccgtaaccgaccggtaccgg

SEQ ID NO: 311063 - DNA, 614 bp, Homo sapiens
  misc_feature: GZ8MTXP02I70BK.21.22.B11.1.454.CMB.2.raw
  modified_base (236)..(236): a, c, t, g, unknown or other
  misc_feature (236)..(236): n is a, c, g, or t
  modified_base (292)..(292): a, c, t, g, unknown or other
  misc_feature (292)..(292): n is a, c, g, or t
  modified_base (371)..(371): a, c, t, g, unknown or other
  misc_feature (371)..(371): n is a, c, g, or t
  modified_base (480)..(480): a, c, t, g, unknown or other
  misc_feature (480)..(480): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctcgggacccccggaggagggtcaccatctcttgtctggagcaactccaacntcggaagtattatgtattcgtgtatcagcaactccgaagactcggaccccaatccnactccaagagaataatcgagccgacctcgacggggtcccagacctacttctcgtgcctacgaagtctcggcctaccctnaccgtcctccgtagacccatcgaggtcggcctccgggtacgaggtctggacgtctagacttagttacgtgtcgactacgtcggaaccgggacagaacgaggtacggganacgtaaaacagttccgtagggacggtttacggggtcggggttacgttaccggggaacgggtaccgggtaaaaccctaaaggttccggaaacccggtttccggacggtaccgaccgggtaacccccgtaacgggg

SEQ ID NO: 311064 - DNA, 692 bp, Homo sapiens
  misc_feature: GZ8MTXP02F8Q1S.21.22.B11.1.454.CMB.2.raw
  modified_base (199)..(199): a, c, t, g, unknown or other
  misc_feature (199)..(199): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagcccacctcagcgtcgtcgggaccccggnagagggtcaccatcttcttgttgtggaggccaactccaactagtacggaaattaattagtgttattcgtggtatcagactaactccgaggaactccggacccccaaactcctacaactccgaagaaggtaataacgtcgaacgggcccgacccccggtacgggtcccctacggaccgttacttccccgtcgacgtacctaccgtaagtcctcgggtcctaccctacgccgtaccccctcgttacgaccagtccgaggttccggcccgttaccggggcgtagtacgtcgggacgtcgttacgtaaccttagttaccggttagacgtactacgtacccggaaccgggggtacaaaccggtatagggtacggtacgtataaacctaggtccgtaggggtacggttcgggggttagggttcggaccgggggacgggttaaacggacccgttaaagtccggaccggtacgaccggtacaccggttaccgaggtccccg

SEQ ID NO: 311065 - DNA, 738 bp, Homo sapiens
  misc_feature: GZ8MTXP02IOON6.21.22.B11.1.454.CMB.2.raw
  modified_base (201)..(201): a, c, t, g, unknown or other
  misc_feature (201)..(201): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagcccaccctcagcgtcgtcggggaccccggnaggacgggtcaccatctcttgttcgtggacgacaactaccaacagtacggaattaattatgtattctggtatcagcaacctccgaagactccggacccccaaactcctcactccaagaagtaataactcacggccggtccctcggtaccgggtcctacgtaccgtacttcctcgtcgtcctacgtaacgtcgtcggtacctacctaccgtaccgtccccttacccgtacgaaccctagtccgacgggttccgggtaccggttcccgggttaccgggaaacgggtcggtacggtacgggtccttacggtaacctttaacggtttaccgttggtacgtaccgtaaccggttacccgggtaaaccggggaccgtaaaccgtaaaccggtagggttacggaacgttaccgaaaacgttaacgttcggtaacggggttcggggtcggggttacggggttcgggttaccggggaaccggggtaaccggaacgtaaaaccgtccggtaaacgtccggttaagccgtaaccgacccggtaaccgg

SEQ ID NO: 311066 - DNA, 718 bp, Homo sapiens
  misc_feature: GZ8MTXP02JUH2K.21.22.B11.1.454.CMB.2.raw
  modified_base (204)..(204): a, c, t, g, unknown or other
  misc_feature (204)..(204): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgccagggtcctgggcccagtctgtgctgactcagcccaccctcagcgtccgtcggggacccccggnaggacgggtccaccattcctcgttgttcgtgggacggacctaacctccaaacagtacggaaagttaattatgttattcgtaggtatacagcctaaacctcccgaaggtactcccggaacccccaaactccgtacactccgaagaagaatacgtaccgacgcccggcccgtacgaccggggtcccctacgaccgtacttccgtcgtcgtcctaccgagtctcggccaccctcgacgtcccgtccctacacctacgtcgtacggtcgggcccgttaccgggaccggagttacgcgggacggtccgtacgtaaccgttattaccgttcgacgtacgtacgtaccggacgggtaccgaaccctaaggtagggttggaaaccgttagaaaccgttaacgtcgtaggtcggggtacggggtttcggggttacggtacccgggggacgggtaaccgggtaaccaaaccggttcccggtaacccggttcgttacggggacccaccggttaacccgtacccgg

SEQ ID NO: 311067 - DNA, 864 bp, Homo sapiens
  misc_feature: GZ8MTXP02H9QG7.21.22.B11.1.454.CMB.2.raw
  modified_base (112)..(112): a, c, t, g, unknown or other
  misc_feature (112)..(112): n is a, c, g, or t
  modified_base (198)..(198): a, c, t, g, unknown or other
  misc_feature (198)..(198): n is a, c, g, or t
  modified_base (252)..(252): a, c, t, g, unknown or other
  misc_feature (252)..(252): n is a, c, g, or t
  modified_base (462)..(462): a, c, t, g, unknown or other
  misc_feature (462)..(462): n is a, c, g, or t
tcagtcgtcgctcgcacgaccggtgctcgatttagacgacagctcaggggagcttcagctgtggtagagaagacaggactcaggacaatctccagcatggccggcttccctntcctcctcaccctcctcactcactgcgcagggtcctgggcccagtctgtgctgactcagcatcctcagcgtctcgggacccccggnaggaggtcaccatctctgttctggaggcaactcaacagtacggaagttaattangttatcgtaggtatcagaccaacctccgaaggtaactccggaccccaaactcctccaataccgaaggacggtaaataacgacgtacggaccggtacccctggtaacggggtccccctaggaccccccgtaacgttcctacgtcggtacctaccgttaaacgttccgtacgggtacccaaccgtttccgaaccgggttccccctaccgtanaaccccctaagcgtaagggtccgggtaacccgcccggaccgggtaagtaccgtaaggtaccgggtaccgtaaggttaaacccttgttttaaaccccgtggggttttacaaccccgtttaaacgggttaccgggtaaaccccgggggtaaacctaaccccggaaaacggttacggttaagggggtaaccttaaaaccggggaaaccctttaaaagttaaacccggttcgggggtaaaaccgttcccggggggtttttaaagggggttccgggtttaccccgggggtaaaaccgggggttaaacccggtaaaaccccggttaaaacccggtaccgggttaaaaccccccgggtttaaccgggtttacggtaacccccggttaaaaaccgggtaccccccggggg

SEQ ID NO: 311068 - DNA, 659 bp, Homo sapiens
  misc_feature: GZ8MTXP02IAEO2.21.22.B11.1.454.CMB.2.raw
  modified_base (202)..(202): a, c, t, g, unknown or other
  misc_feature (202)..(202): n is a, c, g, or t
  modified_base (244)..(244): a, c, t, g, unknown or other
  misc_feature (244)..(244): n is a, c, g, or t
  modified_base (309)..(309): a, c, t, g, unknown or other
  misc_feature (309)..(309): n is a, c, g, or t
  modified_base (356)..(356): a, c, t, g, unknown or other
  misc_feature (356)..(356): n is a, c, g, or t
  modified_base (369)..(369): a, c, t, g, unknown or other
  misc_feature (369)..(369): n is a, c, g, or t
  modified_base (523)..(523): a, c, t, g, unknown or other
  misc_feature (523)..(523): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtcgtcggggacccccgggnaggcgggtcaccgatcctcttgttctggaggcaactccaaanatacggaaagtattatgtattctggtatcagcaactacccaggaatccggaccccctaaatcctnactccaggaggaactaagtcacggccggtccctcggacggggtcccnggaccgtacttcnctcggactcgaacgttcgtcggcctacctcgacctccctcctagaccattcgacgggttcggccgttcccggacggacggtagtcgggaacggtccttaggacttaacgtttcgtgttcggactactccggggaacgggaccgtacaaaccggngtacggggattcggaaactaacgtttcggaagggagttcgggggtttacgggcgttaccgggggaacggtaaaggggtacccaaaacgtccgggttccccgtacggttaacggcccgaaaccggttcccgaaccgg

SEQ ID NO: 311069 - DNA, 642 bp, Homo sapiens
  misc_feature: GZ8MTXP02HO901.21.22.B11.1.454.CMB.2.raw
  modified_base (179)..(179): a, c, t, g, unknown or other
  misc_feature (179)..(179): n is a, c, g, or t
  modified_base (199)..(199): a, c, t, g, unknown or other
  misc_feature (199)..(199): n is a, c, g, or t
  modified_base (241)..(241): a, c, t, g, unknown or other
  misc_feature (241)..(241): n is a, c, g, or t
  modified_base (256)..(256): a, c, t, g, unknown or other
  misc_feature (256)..(256): n is a, c, g, or t
  modified_base (260)..(260): a, c, t, g, unknown or other
  misc_feature (260)..(260): n is a, c, g, or t
  modified_base (264)..(264): a, c, t, g, unknown or other
  misc_feature (264)..(264): n is a, c, g, or t
  modified_base (270)..(270): a, c, t, g, unknown or other
  misc_feature (270)..(270): n is a, c, g, or t
  modified_base (430)..(430): a, c, t, g, unknown or other
  misc_feature (430)..(430): n is a, c, g, or t
  modified_base (435)..(435): a, c, t, g, unknown or other
  misc_feature (435)..(435): n is a, c, g, or t
tcagtcgtcgctcgcacgaccggtgctcgatttagacgacagctcaggggagcttcagctgtggtagagaagacaggactcaggacaatctccagcatggccggcttccctctccctcctcaccctcctcactcactgcgcagggtcctgggcccagtctgtgctgactcagccacctnagcgtctcggggaccccggnaggaggtcaccatctcgttgtcgtggacgtacaactccaaanatcggaaagtattanagtnttcnggtatnagacaactccgagatcgaccccctaaactctacagtaccaaggaagtaaactaataccgagcccggtcctaaaccggcggggtacccctgtaacgccctttactacgtgaccgttacaaacgttgacggccaaaccttcgacgtcccctcgtacaaccgntacgnggtcgccgtacggacgagcgtgacgtcgtactacgttacttacgacgtgtactaacgtcgaacggtacctaacgtacgagtacggctaacggaactacgttacgtgggtaaggttcggggtacggtacggtacgggtaccgggaaaagtaaaccctaacggtaccgacccggtttaccggaaccggtaccaaccggtaaccggtacg

SEQ ID NO: 311070 - DNA, 683 bp, Homo sapiens
  misc_feature: GZ8MTXP02F6LYB.21.22.B11.1.454.CMB.2.raw
  modified_base (241)..(241): a, c, t, g, unknown or other
  misc_feature (241)..(241): n is a, c, g, or t
  modified_base (253)..(253): a, c, t, g, unknown or other
  misc_feature (253)..(253): n is a, c, g, or t
  modified_base (280)..(280): a, c, t, g, unknown or other
  misc_feature (280)..(280): n is a, c, g, or t
  modified_base (295)..(295): a, c, t, g, unknown or other
  misc_feature (295)..(295): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcaggtcctggcccagtctgtgctgactcacgccaccctcagcgtcgtcggggaccccccggcaggagggtccaccgatctcttgtctggagcacgtccaacntacgaattaatntgtattctgtatcagctaactccaganccgaccccaactccnactcgagagatatcgagccggtcctacgacgggtcctgacctacttccgtacgtgcctacgacgtcgtcgccacgtcaccgtccctaccgttcgaccctagtcgtacggttcggcctacccggtgacggtactcggacgtctacggaactttacggtacctttagggcacgaccgtttaccgggaaccggacggaaaaccctaagtaccgttaaggggtacaaccggtaaccttaaaagtccggtttaaaggggaccgggtttccgggtttaaaggggtccggggtttaaccggggaccggggttaaaccggaacgtaaaaacccggggtcccggttaaaccggtacgttaacccgggacgaaacccgggttaaccctaccccggggg

SEQ ID NO: 311071 - DNA, 746 bp, Homo sapiens
  misc_feature: GZ8MTXP02JDPBO.21.22.B11.1.454.CMB.2.raw
  modified_base (247)..(247): a, c, t, g, unknown or other
  misc_feature (247)..(247): n is a, c, g, or t
  modified_base (463)..(463): a, c, t, g, unknown or other
  misc_feature (463)..(463): n is a, c, g, or t
  modified_base (566)..(566): a, c, t, g, unknown or other
  misc_feature (566)..(566): n is a, c, g, or t
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcacgggtcctgggcccagtctgtgctgactcacgccaccctcagccgtcgtcgggaccccgggcaggacgggtcaccatcttacttgtctagggagctaacgtccaanagtacggaaactattatagttacttcgtaggtatcagtaccaacgtcccaacggaactccggacccccaaacgttacctccgaactacccgaagaagaataaactcgaacggccggtacccctacggtaccggggtaccctcggtaaccacgtttacctcgtcggtactaccgtaacgtccgttcggacctaacccgtccgaaccgtcccgtaccncgtaacctcgtacgcggtcggcgtcccgggtacccgaagcttcggacggtactagtaccttacgtttagacggttcactaacggtccgaaccggggtaacccncgtaaccgtaggtacgggtacttacgaaaacgttaccgttcggttacgggacggggttacggggtttacggggttaacccggttcgggggtaaccgggaaacccgggtaaaccgtaaaacggtaccccggtaccgggttaaacccttagggtaaaccccgtacggttaaccccgtaacgg

SEQ ID NO: 311072 - DNA, 869 bp, Homo sapiens
  misc_feature: GZ8MTXP02JWMOE.21.22.B11.1.454.CMB.2.raw
tcagtcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcacgccaccctcagcgtcgtcgggaccccggcagagggtcacatcttcttgtcgtggaggaccaactccaactagtacggtaagttaattatagttattcgtaggtatcaacgcaacctacccgaaggtaacgtacccggtaaccccccaaaaccttcccctactaaccgtacccgaaaggaacggtaaaattaacgtaccgaaccgggacccccgggtaccccccggtacgggggttacccctacgtaaccccggtaactttccccgtacgtcggtacctaccgtaaagtccgttacggccctaccgtcctaaccgtccccttaccccgtacgaacccctagtacccgacggggtttccggggtacccgttaccccgggggtaccggtaaaggggtacgacggggtaacgggtaccgttaacgttaacgtttaactttaaccggttggtaaccggtaaccgtaaccggttaccgggtaaaacccgggggacccctaaacggtaaaacggtacgggtacggggttaaagtaccgtaaacggtaacgttacgggtaggggttaccggggttacggggttcgggggtttacggggtaaccgggggtaccggggaaaaccggggtaaacccgtaaacggttaaccggggtaaacccgttacgggttaccggaacgacccggtaacccggtacggtacccccggg

SEQ ID NO: 311073 - DNA, 598 bp, Homo sapiens
  misc_feature: GZ8MTXP01EKZOV.45.34.D01.1.454.CMB.2.raw
  modified_base (227)..(227): a, c, t, g, unknown or other
  misc_feature (227)..(227): n is a, c, g, or t
  modified_base (282)..(282): a, c, t, g, unknown or other
  misc_feature (282)..(282): n is a, c, g, or t
  modified_base (305)..(305): a, c, t, g, unknown or other
  misc_feature (305)..(305): n is a, c, g, or t
tcagacgcgatcgacacgaccggtgctcgatttagatcgtctgtgttgggtttgggggcaggagtcagacccactcaggacacagcatggacatgagggtccccgctcagctcctggggctcctgctgctctggctcccaggtgccagatgtgccatccagatgacccagtctccattcctccctgtctgcatctgtaggagacagagttaccataacttgccgggnaagtcaggatattagaaatgagttaggctggtatcagcagagaccgagggggacncccccaaatcctagtctatggtncttccaggttacaaagtgggtccatcaaggttcagtggcggtggtctgggcacagaattcaactctcaccatcagcccgctcgcgacgaccgaacggtacgtttagtactaacttaactttacttacgttacttaacctaaagtaactttacttaaacttaacccgtaccggtaacctacgttaccggtaccgaaacgggaaccgaacgtaccgttacgtaggaacgtaactaaaccgaaaccgttacgttaggtcggtcgtaaccgtaccaacttacttcgttcgttttccc

SEQ ID NO: 311074 - DNA, 503 bp, Homo sapiens
  misc_feature: GZ8MTXP01DWJH3.45.34.D01.1.454.CMB.2.raw
  modified_base (224)..(224): a, c, t, g, unknown or other
  misc_feature (224)..(224): n is a, c, g, or t
  modified_base (277)..(277): a, c, t, g, unknown or other
  misc_feature (277)..(277): n is a, c, g, or t
  modified_base (393)..(393): a, c, t, g, unknown or other
  misc_feature (393)..(393): n is a, c, g, or t
  modified_base (438)..(438): a, c, t, g, unknown or other
  misc_feature (438)..(438): n is a, c, g, or t
  modified_base (443)..(443): a, c, t, g, unknown or other
  misc_feature (443)..(443): n is a, c, g, or t
tcagacgcgatcgacacgaccggtgctcgatttagatcgtctgtgttgggtttgggggcaggagtcagacccactcaggacacagcatggacatgagggtccccgctcagctcctggggctcctgctgctctggctcccaggtgccagatgtgccatccagatgacccagtctccattctccctgtctgcatctgtaggagacagagttaccataacttgcggnaagtcaggatatagaatgagttaggctggtatcagcagagaccgagggggacncccccaatcctagtctatggtgcttccaggttacaaagtgggtccatcgaagttcagtggcggtggtctgggcacagaaattcactctcaccatcagccgctgcacgcccgaagtntttgactaacttattactggtacttacaagtatttacaattcccngactnttcgacaagggccaagcttaggacatacaacgattgttaggctagcacattctgttcttc

SEQ ID NO: 311075 - DNA, 664 bp, Homo sapiens
  misc_feature: GZ8MTXP01DVVGC.45.34.D01.1.454.CMB.2.raw
  modified_base (224)..(224): a, c, t, g, unknown or other
  misc_feature (224)..(224): n is a, c, g, or t
  modified_base (229)..(229): a, c, t, g, unknown or other
  misc_feature (229)..(229): n is a, c, g, or t
  modified_base (462)..(462): a, c, t, g, unknown or other
  misc_feature (462)..(462): n is a, c, g, or t
tcagacgcgatcgacacgaccggtgctcgatttagatcgtctgtgttgggtttgggggcaggagtcagacccactcaggacacagcatggacatgagggtccccgctcagctcctggggctcctgctgctctggctcccaggtgccagatgtgccatccagatgacccagtctccattctccctgtctgcatctgtaggagacagagttaccataactgccggnaagtnaggatattagaaatgagtagctggtatcagcagagaccgagggggacacccccaaatcctaagtctaagtggtcgtctttacccgaaggtttaacaaaggttcgggggtaccccaagtaccgtaaagggtttcgagggttggggcggggtgggttcctgggcaacgaaggtaaactttccaacttcctacaacccattccgacgtcccgctggaccaacggccccgtaaagtnttttacgactaaactttattacctggtactaactaagtactttacaaactttcccctacggaactacgttccgggaaccaaacggggtaccctaaagtcgtttaggaaagttacgttaaaccgaaaacggttaaccgttgggttacgggtaacccttacggaaccctaacccgtagttccgtttcgtttcccgtttaacccg

SEQ ID NO: 311076 - DNA, 519 bp, Homo sapiens
  misc_feature: GZ8MTXP01B2RNC.45.34.D01.1.454.CMB.2.raw
  modified_base (200)..(200): a, c, t, g, unknown or other
  misc_feature (200)..(200): n is a, c, g, or t
  modified_base (225)..(225): a, c, t, g, unknown or other
  misc_feature (225)..(225): n is a, c, g, or t
  modified_base (279)..(279): a, c, t, g, unknown or other
  misc_feature (279)..(279): n is a, c, g, or t
  modified_base (393)..(393): a, c, t, g, unknown or other
  misc_feature (393)..(393): n is a, c, g, or t
  modified_base (484)..(484): a, c, t, g, unknown or other
  misc_feature (484)..(484): n is a, c, g, or t
tcagacgcgatcgacacgaccggtgctcgatttagatcgtctgtgttgggtttggggcaggagtcagacccactcaggacacagcatggacatgagggtccccgctcagctcctggggctcctgctgctctggctcccaggtgccagatgtgccatccagatgacccagtctccattctccctgtctgcatctgtagganacagagttaccataacttgccgggnaagtcaggatatagaaatgagttaggctggtatcagcagagaccgagggggacnccccccaatcctagtctatggtgctttccaggttacaaagtgggtccatcaaggttcagtggcgtggtctgggcacagattcactctcaccatcagccgctgcacgccgaagtntttgactaactttattaactggtactaacaagtactttcaaactttccctaggactacgttccgggaccaaaggggcccaaagcttagganatacaaacgacgttgaggctgcacattctgttctc

SEQ ID NO: 311077 - DNA, 544 bp, Homo sapiens
  misc_feature: GZ8MTXP01EKBB9.45.34.D01.1.454.CMB.2.raw
  modified_base (221)..(221): a, c, t, g, unknown or other
  misc_feature (221)..(221): n is a, c, g, or t
  modified_base (251)..(251): a, c, t, g, unknown or other
  misc_feature (251)..(251): n is a, c, g, or t
  modified_base (271)..(271): a, c, t, g, unknown or other
  misc_feature (271)..(271): n is a, c, g, or t
  modified_base (333)..(333): a, c, t, g, unknown or other
  misc_feature (333)..(333): n is a, c, g, or t
  modified_base (347)..(347): a, c, t, g, unknown or other
  misc_feature (347)..(347): n is a, c, g, or t
  modified_base (370)..(370): a, c, t, g, unknown or other
  misc_feature (370)..(370): n is a, c, g, or t
tcagacgcgatcgacacgaccggtgctcgatttagatcgtctgtgttgggtttgggggagtcagacccactcaggacacagcatggacatgagggtccccgctcagctcctggggctcctgctgctctggctcccaggtgccagatgtgccatccagatgacccagtctccattctccctgtctgcatctgtaggagacagagttaccataacttgccggnaagtcagatatagaaatgagtaggctggancagcagagaccgaggggacncccccaatcctagtctatggtgcttcaggttacaaaggtgggtccatcaaggttcaggtggnggtggtctggcacngattcactctacacatcacgccnctgcacgacccgtaagtattttgactaacttatactagtacttacaaagtactttacaactttacccgtcggactacgttaccggactaaacggggaaccaagtcttaaggaagactaacgaaaacggtaacttggttacggcttcgcacctaatctgttcttcttaacttccc

SEQ ID NO: 311078 - DNA, 525 bp, Homo sapiens
  misc_feature: GZ8MTXP01ENCXL.45.34.D01.1.454.CMB.2.raw
  modified_base (197)..(197): a, c, t, g, unknown or other
  misc_feature (197)..(197): n is a, c, g, or t
  modified_base (221)..(221): a, c, t, g, unknown or other
  misc_feature (221)..(221): n is a, c, g, or t
  modified_base (254)..(254): a, c, t, g, unknown or other
  misc_feature (254)..(254): n is a, c, g, or t
  modified_base (275)..(275): a, c, t, g, unknown or other
  misc_feature (275)..(275): n is a, c, g, or t
  modified_base (297)..(297): a, c, t, g, unknown or other
  misc_feature (297)..(297): n is a, c, g, or t
  modified_base (333)..(333): a, c, t, g, unknown or other
  misc_feature (333)..(333): n is a, c, g, or t
  modified_base (348)..(348): a, c, t, g, unknown or other
  misc_feature (348)..(348): n is a, c, g, or t
  modified_base (370)..(370): a, c, t, g, unknown or other
  misc_feature (370)..(370): n is a, c, g, or t
  modified_base (386)..(386): a, c, t, g, unknown or other
  misc_feature (386)..(386): n is a, c, g, or t
tcagacgcgatcgacacgaccggtgctcgatttagatcgtctgtgttgggtttgggggagtcagacccactcaggacacagcatggacatgagggtccccgctcagctcctggggctcctgctgctctggctcccaggtgccagatgtgccatccagatgacccagtctccattctccctgtctgcatctgtagganacagagttaccataacttgccggnaagtcaggatatagaaatgagttaggctggtancagcagagaccgagggggacncccccaatcctagtctatggtncttcaggttacaaagtgggccatcaaggtcagtggnggtggtctggacacngaattcactctcacatcagccnctgcagcccgaaagtnttttagactaaacttattactagttactaacaagttaatttacaacttaccctcggactagttccggactaaagggacctaaagcttaagagatacaaacgaactgttagcttgcactaatctgttacttcaacttccc

SEQ ID NO: 311079 - DNA, 540 bp, Homo sapiens
  misc_feature: GZ8MTXP01BAICX.45.34.D01.1.454.CMB.2.raw
  modified_base (156)..(156): a, c, t, g, unknown or other
  misc_feature (156)..(156): n is a, c, g, or t
  modified_base (214)..(214): a, c, t, g, unknown or other
  misc_feature (214)..(214): n is a, c, g, or t
  modified_base (342)..(342): a, c, t, g, unknown or other
  misc_feature (342)..(342): n is a, c, g, or t
  modified_base (351)..(351): a, c, t, g, unknown or other
  misc_feature (351)..(351): n is a, c, g, or t
  modified_base (408)..(408): a, c, t, g, unknown or other
  misc_feature (408)..(408): n is a, c, g, or t
  modified_base (413)..(413): a, c, t, g, unknown or other
  misc_feature (413)..(413): n is a, c, g, or t
  modified_base (415)..(415): a, c, t, g, unknown or other
  misc_feature (415)..(415): n is a, c, g, or t
  modified_base (417)..(417): a, c, t, g, unknown or other
  misc_feature (417)..(417): n is a, c, g, or t
  modified_base (419)..(419): a, c, t, g, unknown or other
  misc_feature (419)..(419): n is a, c, g, or t
tcagacgcgatcgacacgaccggtgctcgatttagatcgtctgtgttgggtttgaggtctcagagaggagccttagccctggactccaaggcctttccacttggtgaccagcactgagcacagaggactcaccatggaattggggctgagcgtggngttcctaggtgctatttagagtgtcaatgtgagatgaaagtggtggagtctggggganacttggtccagtccgggggggtccctgagactctcctgtacagcctctggactcaccttgagcaattatggatgaccctgggtccgccaggctccgaggggaagggctgggagtggggtggcccaaanataaaaggnaagtagtaggggatagaaagataagtgtgactgtggtaggagggtcgtacactatcncagananananacaatatatagttagttagtaagtaggtagtagtgtagagtagtacgagagtacgtatagtatataatgcgcgagagagttagttgttagtaacgtaggtaagggtaggagactgttgttg

SEQ ID NO: 311080 - DNA, 547 bp, Homo sapiens
  misc_feature: GZ8MTXP01AJM1A.45.34.D01.1.454.CMB.2.raw
  modified_base (201)..(201): a, c, t, g, unknown or other
  misc_feature (201)..(201): n is a, c, g, or t
  modified_base (226)..(226): a, c, t, g, unknown or other
  misc_feature (226)..(226): n is a, c, g, or t
  modified_base (303)..(303): a, c, t, g, unknown or other
  misc_feature (303)..(303): n is a, c, g, or t
  modified_base (395)..(395): a, c, t, g, unknown or other
  misc_feature (395)..(395): n is a, c, g, or t
  modified_base (409)..(409): a, c, t, g, unknown or other
  misc_feature (409)..(409): n is a, c, g, or t
tcagacgcgatcgacacgaccggtgctcgatttagatcgtctgtgttgggtttgggggcaggagtcagacccactcaggacacagcatggacatgagggtccccgctcagctcctggggctcctgctgctctggctcccaggtgccagatgtgccatccagatgacccagtctccattctccctgtctgcatctgtagganacagagttaccataacttgccgggnaagtcaggatattagaaatgagttagctggtatcagcagagaccagggggacgccccccaaatcctagtctatggtnctttccaggttacaaagtgggcccatcaaggttcagtggcggtggtctggcacagattcactctcaccatcagccgcctgcaggcccaagtnttttgctaaacttnttaactggtacttacaagtatttacaattaccctggtacctattccgggacctaaaggggacccaaaggtcctttggaagacgttacaaaacggttaaccttgttcgggcttggccaaccttcgttcgttcgttctcg

SEQ ID NO: 311081 - DNA, 608 bp, Homo sapiens
  misc_feature: GZ8MTXP01AILCY.45.34.D01.1.454.CMB.2.raw
  modified_base (281)..(281): a, c, t, g, unknown or other
  misc_feature (281)..(281): n is a, c, g, or t
tcagacgcgatcgacacgaccggtgctcgatttagatcgtctgtgttgggtttgggggcaggagtcagacccactcaggacacagcatggacatgagggtccccgctcagctcctggggctcctgctgctctggctcccaggtgccagatgtgccatccagatgacccagtctccattctccctgtctgcatctgtaggagacagagttaccataacttgccgggcaagtcaggatattagaaatgagttaggctggtatcagcagagaccgagggggacnccccccaatcctagtctatggtgcttcaggttacaaagtcgggtccatcaaggttcagtggcggtggtctggcacagaattcactctcaccatcagccgctgcacgcccgaagtatttgactaacttattacctggtactaacgtaagtactttttaccaaactttaccccgacgggtaaacctacgtttacccggggaacccgtaaaacgggggaccccaaagggtccctttagggaaagttaacttaaccgaaaaacggttaaccttggttacggggaaccttcgggaacccaaaccccttacgttccgttcgttaacctttccg

SEQ ID NO: 311082 - DNA, 538 bp, Homo sapiens
  misc_feature: GZ8MTXP01AZRU0.45.34.D01.1.454.CMB.2.raw
  modified_base (225)..(225): a, c, t, g, unknown or other
  misc_feature (225)..(225): n is a, c, g, or t
  modified_base (277)..(277): a, c, t, g, unknown or other
  misc_feature (277)..(277): n is a, c, g, or t
tcagacgcgatcgacacgaccggtgctcgatttagatcgtctgtgttgggtttgggggcaggagtcagacccactcaggacacagcatggacatgagggtccccgctcagctcctggggctcctgctgctctggctcccaggtgccagatgtgccatccagatgacccagtctccattctccctgtctgcatctgtaggagacagagttaccataactgccgganaagtcaggatatagaaatgagttagctggtatcagcagagaccgaggggacncccccaatcctagtctatggtgcttccgaggttacaaaggtcgggtccagtcaaggttcaggtggcggtggtctggcacagattcactctcacatcagccgctgcacggcccgtaagtactttgactaacttattactggtactaataagtatttaccaacttaccctacggtactcgttccggacctaaacggggaccaagtcttagaagactaacaaacgacgttgttacggctcgccacctattccgtgttcttaacc

SEQ ID NO: 311083 - DNA, 347 bp, Homo sapiens
  misc_feature: GZ8MTXP01B2ZON.45.34.D01.1.454.CMB.2.raw
  modified_base (251)..(251): a, c, t, g, unknown or other
  misc_feature (251)..(251): n is a, c, g, or t
  modified_base (254)..(254): a, c, t, g, unknown or other
  misc_feature (254)..(254): n is a, c, g, or t
  modified_base (258)..(258): a, c, t, g, unknown or other
  misc_feature (258)..(258): n is a, c, g, or t
  modified_base (260)..(260): a, c, t, g, unknown or other
  misc_feature (260)..(260): n is a, c, g, or t
  modified_base (264)..(264): a, c, t, g, unknown or other
  misc_feature (264)..(264): n is a, c, g, or t
  modified_base (278)..(278): a, c, t, g, unknown or other
  misc_feature (278)..(278): n is a, c, g, or t
  modified_base (310)..(310): a, c, t, g, unknown or other
  misc_feature (310)..(310): n is a, c, g, or t
  modified_base (341)..(341): a, c, t, g, unknown or other
  misc_feature (341)..(341): n is a, c, g, or t
  modified_base (346)..(347): a, c, t, g, unknown or other
  misc_feature (346)..(347): n is a, c, g, or t
tcagacgcgatcgacacgaccggtgctcgatttagatcgtctgtgttgggtcggttcaccatctccagagacaatgccaagaattcagtctttttggaaatggacagtctgagatccgaagatacggcagtatattactgcgcgagagatgatagtcctaagtggggtagagacatctggtttgatgctttcgatgtgtgggccagggacaacggtcaccgtctctcagcctcacaggccatcgtctcccngcncctncncagncactcgagagcacngcgcctgggctgcctggtcaaggctacttccngatcgcgtcctggagcgggctggcaagggcncatgnn

SEQ ID NO: 311084 - DNA, 637 bp, Homo sapiens
  misc_feature: GZ8MTXP01AXJ7M.45.34.D01.1.454.CMB.2.raw
  modified_base (221)..(221): a, c, t, g, unknown or other
  misc_feature (221)..(221): n is a, c, g, or t
  modified_base (255)..(255): a, c, t, g, unknown or other
  misc_feature (255)..(255): n is a, c, g, or t
tcagacgcgatcgacacgaccggtgctcgatttagatcgtctgtgttgggtttggggagtcagacccactcaggacacagcatggacatgagggtccccgctcagctcctggggctcctgctgctctggctcccaggtgccagatgtgccatccagatgacccagtctccattctccctgtctgcatctgtaggagacagagttaccataacttgccgggnaagtcaggatattagaaatgagttaggctggtancagcagaacgacggagggaccccacccctactcgtagtctagtggtctctacgtagtaacgaagggtccggacctagtacgtagttcgtaggtcgggtcgggtcggtcgtggaaccaacgtaagttaacttccgtaccttccaccaacctactaccgaccgcccgtacgtcgaccgaacccggtaaccgtaagtttacgtttcgaacttaaactttacttacgtacttaacctaaaggtaatttactttaacctaaacctttacccgacgtacttacggttaccggaacgtaaacggaactacgtcgtaaggaattactaaacgaaacgtagtggttcgcgttcgaacctactaattcgtcttccttaacgttctttccccg

SEQ ID NO: 311085 - DNA, 556 bp, Homo sapiens
  misc_feature: GZ8MTXP01DAUKL.45.34.D01.1.454.CMB.2.raw
  modified_base (222)..(222): a, c, t, g, unknown or other
  misc_feature (222)..(222): n is a, c, g, or t
  modified_base (248)..(248): a, c, t, g, unknown or other
  misc_feature (248)..(248): n is a, c, g, or t
  modified_base (273)..(273): a, c, t, g, unknown or other
  misc_feature (273)..(273): n is a, c, g, or t
  modified_base (354)..(354): a, c, t, g, unknown or other
  misc_feature (354)..(354): n is a, c, g, or t
tcagacgcgatcgacacgaccggtgctcgatttagatcgtctgtgttgggtttggggaggagtcagacccactcaggacacagcatggacatgagggtccccgctcagctcctggggctcctgctgctctggctcccaggtgccagatgtgccatccagatgacccagtctccattctccctgtctgcatctgtaggagacagagttaccataacttgcggnaagtcagatatagaaatgagttaggntgatcagcagagaccgagggggacncccccaaatcctagtctatggtgcttcgaggttaacaaggtgggtcccatcaaggttccaggtggcggtgggtctgggacncagtaacttcactctcacatcagccgctgcagaccgaagtatttcgactaaacttattaactgttactaactaagttacttttacaaactttacccgtacggactaacgttccggacctaaaggggaccaaggtcttagagaaacttacgaaaacgtacttaggttcggcttcgaccaacctattcttagttcttctaaccg

SEQ ID NO: 311086 - DNA, 558 bp, Homo sapiens
  misc_feature: GZ8MTXP01EM0YZ.45.34.D01.1.454.CMB.2.raw
  modified_base (201)..(201): a, c, t, g, unknown or other
  misc_feature (201)..(201): n is a, c, g, or t
  modified_base (226)..(226): a, c, t, g, unknown or other
  misc_feature (226)..(226): n is a, c, g, or t
  modified_base (253)..(253): a, c, t, g, unknown or other
  misc_feature (253)..(253): n is a, c, g, or t
  modified_base (280)..(280): a, c, t, g, unknown or other
  misc_feature (280)..(280): n is a, c, g, or t
  modified_base (303)..(303): a, c, t, g, unknown or other
  misc_feature (303)..(303): n is a, c, g, or t
  modified_base (404)..(404): a, c, t, g, unknown or other
  misc_feature (404)..(404): n is a, c, g, or t
tcagacgcgatcgacacgaccggtgctcgatttagatcgtctgtgttgggtttgggggcaggagtcagacccactcaggacacagcatggacatgagggtccccgctcagctcctggggctcctgctgctctggctcccaggtgccagatgtgccatccagatgacccagtctccattctccctgtctgcatctgtagganacagagttaccataacttgccgggnaagtcaggatatagaaatgagttaggntggtatcagcagagaccgagggggacncccccaaatcctagtctatggtncttccaggttacaaaggttcgggtccatctaaggttcaggtggcggtgggctgggcacagaacttcactcacaccatcacgccgctgcacgcccgtaagtntttgactaacttattactggtactaacgaatactttactaaccttaccgtcggtaactacgttaccggaccaaacgggtaccaaagtcgttaggaacgaataacaaaacgttaacgttgttacgggctcgcacctattccttaagttcttaacc

SEQ ID NO: 311087 - DNA, 623 bp, Homo sapiens
  misc_feature: GZ8MTXP01DMSFG.45.34.D01.1.454.CMB.2.raw
  modified_base (321)..(321): a, c, t, g, unknown or other
  misc_feature (321)..(321): n is a, c, g, or t
  modified_base (325)..(325): a, c, t, g, unknown or other
  misc_feature (325)..(325): n is a, c, g, or t
  modified_base (352)..(352): a, c, t, g, unknown or other
  misc_feature (352)..(352): n is a, c, g, or t
  modified_base (359)..(359): a, c, t, g, unknown or other
  misc_feature (359)..(359): n is a, c, g, or t
  modified_base (365)..(365): a, c, t, g, unknown or other
  misc_feature (365)..(365): n is a, c, g, or t
tcagacgcgatcgacacgaccggtgctcgatttagatcgtctgtgttgggtttgggggagacttggtccatccgggggggtccctgagactctcctgtacagcctctggactcaccttgagcaattattggatgacctgggtccgccaggctccagggaaggggctggagtgggtggccaacataaagcaagatgggagtcgaaagaactatgtggactctgtgaagggtcgttcaccatctccagagacaatgaccaagaattcagttctttttaggaaatggacagtctgagataccgaagatacggcagtatattacngcgngagagatgatagtctaagtgggggtanagacatntggttnatgtctttgatgtggtggggccacgggacaacggtcaccgtctctcacgccctaccaccgaacgggccccagttcccggtcccttcccccgtgggccgccccgttggaccctccgaggaccgcctacccgtacccggagacgccaaccgcgggtcccggcccgttggggccttcggccccgttgggttaccgttaacgggttaccctttaacccgttccgtccggtacgtcccggttcggttccgttgggaaccgggg

SEQ ID NO: 311088 - DNA, 603 bp, Homo sapiens
  misc_feature: GZ8MTXP01B9S30.45.34.D01.1.454.CMB.2.raw
  modified_base (197)..(197): a, c, t, g, unknown or other
  misc_feature (197)..(197): n is a, c, g, or t
  modified_base (261)..(261): a, c, t, g, unknown or other
  misc_feature (261)..(261): n is a, c, g, or t
  modified_base (280)..(280): a, c, t, g, unknown or other
  misc_feature (280)..(280): n is a, c, g, or t
  modified_base (350)..(350): a, c, t, g, unknown or other
  misc_feature (350)..(350): n is a, c, g, or t
  modified_base (389)..(389): a, c, t, g, unknown or other
  misc_feature (389)..(389): n is a, c, g, or t
tcagacgcgatcgacacgaccggtgctcgatttagatcgtctgtgttgggtttgggggagtcagacccactcaggacacagcatggacatgagggtccccgctcagctcctggggctcctgctgctctggctcccaggtgccagatgtgccatccagatgacccagtctccattctccctgtctgcatctgtagganacagtagttaccattaacttggccggacaagtcaggtatattaagaaatgagttaggctggtancagcagagacgaggggacncccccatcctagtctatggtcgcttaccgaggttacaaaggtcgggtacccatcgtaaggttcaggtggnggtggtctggacacaagattcactctcacatcagcctcngcacgacccgtaagtactttcgactaacttacttactagtactaacgaaagttactttaccaaactttacccacggtaactagttaccgggaccgtaaagggggaccctaaagggtcctttaaggaacgttaataccgaaaacgtaaaccgtggttacgggttcacgtaacctaacccgtaattccgtcgttacctttaacgaacgtttccccg

SEQ ID NO: 311089 - DNA, 761 bp, Homo sapiens
  misc_feature: GZ8MTXP01BN6AP.45.34.D01.1.454.CMB.2.raw
  modified_base (201)..(201): a, c, t, g, unknown or other
  misc_feature (201)..(201): n is a, c, g, or t
  modified_base (224)..(224): a, c, t, g, unknown or other
  misc_feature (224)..(224): n is a, c, g, or t
  modified_base (275)..(275): a, c, t, g, unknown or other
  misc_feature (275)..(275): n is a, c, g, or t
tcagacgcgatcgacacgaccggtgctcgatttagatcgtctgtgttgggtttgggggcaggagtcagacccactcaggacacagcatggacatgagggtccccgctcagctcctggggctcctgctgctctggctcccaggtgccagatgtgccatccagatgacccagtctccattctccctgtctgcatctgtagganacagagttaccataactgccggnaagtcaggatatagaatgagtaggctggtatcagcagagaccgaggggacncccccaatcctagtctagtggtgtcgttaccgaaggttacaaaggttcgggggtacccctaagtccgtaaacgggtttcgaaggttcggggtccgggttggggtccgttacgggcgaacccgtaaagggtaaactttcccgaaaccttccgtaccaaaccctaacttccgaacggccccgtcccgttacgaccgaaccggacccccggtaaagttacgtttttcggacccttaaaacttttacttaaccgttaggggttacccgtttaaacgtaaacgttactttttaaccaaaccgttttaacccccgtacgggtaaacctacgttttacccggggacccgtaaacggggtaaccccgtaaaaggttcccgtttaagggaacgttaaacgttaaccgaaaaacggttaaaccgtttcgggttaacggggtccttacgggaaccctaaaccccgttacgttaccgtttcgtttaacccgttaaccg

SEQ ID NO: 311090 - DNA, 613 bp, Homo sapiens
  misc_feature: GZ8MTXP01DC0EH.45.34.D01.1.454.CMB.2.raw
  modified_base (257)..(258): a, c, t, g, unknown or other
  misc_feature (257)..(258): n is a, c, g, or t
  modified_base (262)..(263): a, c, t, g, unknown or other
  misc_feature (262)..(263): n is a, c, g, or t
  modified_base (266)..(266): a, c, t, g, unknown or other
  misc_feature (266)..(266): n is a, c, g, or t
tcagacgcgatcgacacgaccggtgctcgatttagatcgtctgtgttgggtttgggggcaggagtcagacccactcaggacacagcatggacatgagggtccccgctcagctcctggggctcctgctgctctggctcccaggtgccagatgtgccatccacgatgacccagtctccattcgtccctggtctgcatctgtaggagacagagttaccataacttgccgggcaagtcaggatattagaaatgagtacggnngtannagnagacgacgacgggaccacccctatctagtctagtcggtctcttacgaaggttaacgaaggtcggtacctagtacgtaacggttcgaggtcgggtcggtgggtacgtggaacaacgtaacgtaacttccaccttctacaaccgtactcacgccgccgtcgacgaccgtaccgtaacgttacgtttacgtactaacttaacttacttacggttactaactaacttaacttaactaaccttaccgtacgtacgtacgtaccgtaccgaacggaacgtaacgtacgttagtacgttacgtaacgtaacgttacgttcgttacgtcgtacgtctactacttacttcgttctc

SEQ ID NO: 311091 - DNA, 624 bp, Homo sapiens
  misc_feature: GZ8MTXP01DKFNT.45.34.D01.1.454.CMB.2.raw
  modified_base (202)..(202): a, c, t, g, unknown or other
  misc_feature (202)..(202): n is a, c, g, or t
  modified_base (225)..(225): a, c, t, g, unknown or other
  misc_feature (225)..(225): n is a, c, g, or t
  modified_base (300)..(300): a, c, t, g, unknown or other
  misc_feature (300)..(300): n is a, c, g, or t
tcagacgcgatcgacacgaccggtgctcgatttagatcgtctgtgttgggtttgggggcaggagtcagacccactcaggacacagcatggacatgagggtccccgctcagctcctggggctcctgctgctctggctcccaggtgccagatgtgccatccagatgacccagtctccattcctccctgtctgcatctgtagganacagagttaccataactgccggnaagtcagatatagaatgagtaggctggtatcagcagagaccgagggggacacccccaatcctagtctagtggtcncttccaaggttacaaaggttcgggtacccatctaacggttcaggtgggcggtgggtactggcacgagtaattcactctcaccatcacgccgaccgtgaccaacgacccgtaaagtacttttacgactaaactttattacctaggttacctaactaaagttacttttaccaaactttacccgacggtaactacgtttaccgggaacctaaacggggaaccctaaagtccgtttaaggaacgttaacttaaacgtaaacccgttaaagttcgggttacgggtccttacgaacctaaccctatttccgtttcgttcccttttaaccg

SEQ ID NO: 311092 - DNA, 514 bp, Homo sapiens
  misc_feature: GZ8MTXP01ALLHV.45.34.D01.1.454.CMB.2.raw
  modified_base (197)..(197): a, c, t, g, unknown or other
  misc_feature (197)..(197): n is a, c, g, or t
  modified_base (220)..(220): a, c, t, g, unknown or other
  misc_feature (220)..(220): n is a, c, g, or t
  modified_base (225)..(225): a, c, t, g, unknown or other
  misc_feature (225)..(225): n is a, c, g, or t
  modified_base (250)..(250): a, c, t, g, unknown or other
  misc_feature (250)..(250): n is a, c, g, or t
  modified_base (270)..(270): a, c, t, g, unknown or other
  misc_feature (270)..(270): n is a, c, g, or t
  modified_base (293)..(293): a, c, t, g, unknown or other
  misc_feature (293)..(293): n is a, c, g, or t
  modified_base (391)..(391): a, c, t, g, unknown or other
  misc_feature (391)..(391): n is a, c, g, or t
  modified_base (406)..(406): a, c, t, g, unknown or other
  misc_feature (406)..(406): n is a, c, g, or t
  modified_base (478)..(478): a, c, t, g, unknown or other
  misc_feature (478)..(478): n is a, c, g, or t
  modified_base (490)..(490): a, c, t, g, unknown or other
  misc_feature (490)..(490): n is a, c, g, or t
  modified_base (500)..(500): a, c, t, g, unknown or other
  misc_feature (500)..(500): n is a, c, g, or t
  modified_base (504)..(504): a, c, t, g, unknown or other
  misc_feature (504)..(504): n is a, c, g, or t
  modified_base (510)..(510): a, c, t, g, unknown or other
  misc_feature (510)..(510): n is a, c, g, or t
tcagacgcgatcgacacgaccggtgctcgatttagatcgtctgtgttgggtttgggggagtcagacccactcaggacacagcatggacatgagggtccccgctcagctcctggggctcctgctgctctggctcccaggtgccagatgtgccatccagatgacccagtctccattctccctgtctgcatctgtagganacagagttaccataactgccggnaagtnagatatagaatgagttagctggtancagcagagaccgaggggacnccccccaatcctagtctatggtncttccgagttacaaaggtgggtcccatcgaaggttcagtggcggtggtctggacacaagaattcactctcacatcagcccgcctgccagcccgaagtnttttgctaaactttntactgtactacggaatactttacaacttaccccgtggactattcggacctaagggaccaagctaagagttanacaaacgactgngcttgctacntctnttctcnctcc

SEQ ID NO: 311093 - DNA, 562 bp, Homo sapiens
  misc_feature: GZ8MTXP01AOLI7.45.34.D01.1.454.CMB.2.raw
  modified_base (197)..(197): a, c, t, g, unknown or other
  misc_feature (197)..(197): n is a, c, g, or t
  modified_base (220)..(220): a, c, t, g, unknown or other
  misc_feature (220)..(220): n is a, c, g, or t
  modified_base (244)..(244): a, c, t, g, unknown or other
  misc_feature (244)..(244): n is a, c, g, or t
  modified_base (250)..(250): a, c, t, g, unknown or other
  misc_feature (250)..(250): n is a, c, g, or t
  modified_base (254)..(254): a, c, t, g, unknown or other
  misc_feature (254)..(254): n is a, c, g, or t
  modified_base (270)..(270): a, c, t, g, unknown or other
  misc_feature (270)..(270): n is a, c, g, or t
  modified_base (398)..(398): a, c, t, g, unknown or other
  misc_feature (398)..(398): n is a, c, g, or t
tcagacgcgatcgacacgaccggtgctcgatttagatcgtctgtgttgggtttgggggagtcagacccactcaggacacagcatggacatgagggtccccgctcagctcctggggctcctgctgctctggctcccaggtgccagatgtgccatccagatgacccagtctccattctccctgtctgcatctgtagganacagagttaccataactgccggnaagtcagatatagaatgagttagntggtancagnagagaccgaggggacncccccaatcctagtctatggtgcttccgaggttacaaaggtcgggtccatcgaggttcaggtgggcggtggtctggcacaagtaattccactcctcaccatcacgcccgcctgcacgcccgtaagttntttacgactaacttacttactcgtactaacgtaagttactttacaaacttacccgtacgtacaacgttaccggaccgtaagggaacctaacgcttaaggaattactacgaaacgtaactggttggcttcgaactactaattcgtacgttcttcgaacgtttccc

SEQ ID NO: 311094 - DNA, 610 bp, Homo sapiens
  misc_feature: GZ8MTXP01BS7SW.45.34.D01.1.454.CMB.2.raw
  modified_base (225)..(225): a, c, t, g, unknown or other
  misc_feature (225)..(225): n is a, c, g, or t
  modified_base (230)..(230): a, c, t, g, unknown or other
  misc_feature (230)..(230): n is a, c, g, or t
  modified_base (254)..(254): a, c, t, g, unknown or other
  misc_feature (254)..(254): n is a, c, g, or t
  modified_base (298)..(298): a, c, t, g, unknown or other
  misc_feature (298)..(298): n is a, c, g, or t
tcagacgcgatcgacacgaccggtgctcgatttagatcgtctgtgttgggtttgggggcaggagtcagacccactcaggacacagcatggacatgagggtccccgctcagctcctggggctcctgctgctctggctcccaggtgccagatgtgccatccagatgacccagtctccattctccctgtctgcatctgtaggagacagagttaccataacttgcgggnaagtnagatatagaatgagtagctggtancagcagagaccgaggggaccacccccactcctagtctagtggtntcctttaccgtaaggttaacgaaaggttcgggtacccagtacgtaaacggttcgagggtgggtcgggtggggtactgggcaacagtaacttccactctacaccatcacgccgctgcacgaccgtaagtctttgactaactttattactggttactaacgtaattactttaccaaactttcccgtacgtaaccgtacgttaccgggaaccgtaaacgggaccctaaaggtccgttaggaacgttaaactaaaccgaaaacgttacgttggttacggcttcgaaccctacctagttccgttcgtttccttaacc

SEQ ID NO: 311095 - DNA, 551 bp, Homo sapiens
  misc_feature: GZ8MTXP01DD6NP.45.34.D01.1.454.CMB.2.raw
  modified_base (280)..(280): a, c, t, g, unknown or other
  misc_feature (280)..(280): n is a, c, g, or t
  modified_base (397)..(397): a, c, t, g, unknown or other
  misc_feature (397)..(397): n is a, c, g, or t
tcagacgcgatcgacacgaccggtgctcgatttagatcgtctgtgttgggtttgggggcaggagtcagacccactcaggacacagcatggacatgagggtccccgctcagctcctggggctcctgctgctctggctcccaggtgccagatgtgccatccagatgacccagtctccattctccctgtctgcatctgtaggagacagagttaccataacttgccgggcaagtcaggatattagaaatgagttaggctggtatcagcagagaccagggggacnccccccaatcctagtctatggtgcttccaggtacaaagtgggtccatcaacggttcagtggcggtgggtctgggcacagaattcactctcaccatcagccgctgcagcccgtaaagnttttgactaacttattactaggtctaacaaagtactttcaaatttcccctagggtaacctatttcccgggaccaaacgggggtaaccctaaaggctttagaagaattacaaaacggttaacttggttacggctagcaccattcctgttcttaac

SEQ ID NO: 311096 - DNA, 582 bp, Homo sapiens
  misc_feature: GZ8MTXP01A5EV0.45.34.D01.1.454.CMB.2.raw
  modified_base (487)..(487): a, c, t, g, unknown or other
  misc_feature (487)..(487): n is a, c, g, or t
  modified_base (515)..(515): a, c, t, g, unknown or other
  misc_feature (515)..(515): n is a, c, g, or t
tcagacgcgatcgacacgaccggtgctcgatttagatcgtctgtgttgggtttgggggagacttggtccatccgggggggtccctgagactctcctgtacagcctctggactcaccttgagcaattattggatgacctgggtccgccaggctccagggaaggggctggagtgggtggccaacataaaagcaagatgggagtcgaaagaactatgtggactctgtgaagggtcggttcaccatctccagagacaatgccaagaattcagtctttttggaaatggacagtctgagataccgaagatacggcagtatattactgcgcgagagatgaatagtcctaagtgggggtagagaccatcgtggttgatgtctttcgatggtggtcggggaccacggggactaaacggtcaccgtctacgtcacgccctaccacgaacgggccccagtccgtcccttccccgtggcccgccctggcctccgaggcnccaccgtccgagacgcacgcggcgcccnggggccttcgccgtggttacgacggttacctaacttcccgtaacgtcgtcgcgtcgttaacgcgggg

SEQ ID NO: 311097 - DNA, 550 bp, Homo sapiens
  misc_feature: GZ8MTXP01DP73K.45.34.D01.1.454.CMB.2.raw
  modified_base (225)..(225): a, c, t, g, unknown or other
  misc_feature (225)..(225): n is a, c, g, or t
  modified_base (281)..(281): a, c, t, g, unknown or other
  misc_feature (281)..(281): n is a, c, g, or t
  modified_base (305)..(305): a, c, t, g, unknown or other
  misc_feature (305)..(305): n is a, c, g, or t
  modified_base (462)..(462): a, c, t, g, unknown or other
  misc_feature (462)..(462): n is a, c, g, or t
  modified_base (532)..(532): a, c, t, g, unknown or other
  misc_feature (532)..(532): n is a, c, g, or t
tcagacgcgatcgacacgaccggtgctcgatttagatcgtctgtgttgggtttggggaggagtcagacccactcaggacacagcatggacatgagggtccccgctcagctcctggggctcctgctgctctggctcccaggtgccagatgtgccatccagatgacccagtctccattcctccctgtctgcatctgtaggagacagagttaccataacttgccgggnaagtcaggatattaagaaatgagttaggctggtatcagcagagaccgagggggacncccccaaatcctagtctagtggtncttcaggttacaaggtgggtccatcaaggttcaggtggcggtggtctgggctaacgagtaacttcactctacacatcacgtccgctgcacgaccgtaagtattttcgactaaactttatacttcgttactaactaagtactttacaaactttacccnggtactacgttcggaccaaagggccaaagtcttagacgtacttacgaaacggtcttaggttcgactgacnctatcgttctcttctaac

SEQ ID NO: 311098 - DNA, 555 bp, Homo sapiens
  misc_feature: GZ8MTXP01AZZ00.45.34.D01.1.454.CMB.2.raw
  modified_base (223)..(223): a, c, t, g, unknown or other
  misc_feature (223)..(223): n is a, c, g, or t
  modified_base (274)..(274): a, c, t, g, unknown or other
  misc_feature (274)..(274): n is a, c, g, or t
tcagacgcgatcgacacgaccggtgctcgatttagatcgtctgtgttgggtttggggaggagtcagacccactcaggacacagcatggacatgagggtccccgctcagctcctggggctcctgctgctctggctcccaggtgccagatgtgccatccagatgacccagtctccattctcctgtctgcatctgtaggagacagagttaccataacttgccgggnaagtcaggatattagaatgagtagctggatcagcagagaccgagggggacncccccaatcctagtctatggtgcttcaggttacaaaggtcgggtaccatcgaaggttccaggtggcggtgggtctagggcaacagtaattcactctcacatcacgccgcctgccacgaccccgtaaagtacttttacgacttaaacttacttactgtactaactaaagtactttacaaactttacccgtcggactagttccggacctaagggaccaagtcttagagtacttacgaaacgtacttggttcgctgcaacctacttcgttgttccttctaaccg

SEQ ID NO: 311099 - DNA, 557 bp, Homo sapiens
  misc_feature: GZ8MTXP01BMMN1.45.34.D01.1.454.CMB.2.raw
  modified_base (305)..(305): a, c, t, g, unknown or other
  misc_feature (305)..(305): n is a, c, g, or t
  modified_base (339)..(339): a, c, t, g, unknown or other
  misc_feature (339)..(339): n is a, c, g, or t
  modified_base (481)..(481): a, c, t, g, unknown or other
  misc_feature (481)..(481): n is a, c, g, or t
  modified_base (489)..(489): a, c, t, g, unknown or other
  misc_feature (489)..(489): n is a, c, g, or t
  modified_base (509)..(509): a, c, t, g, unknown or other
  misc_feature (509)..(509): n is a, c, g, or t
  modified_base (519)..(519): a, c, t, g, unknown or other
  misc_feature (519)..(519): n is a, c, g, or t
tcagacgcgatcgacacgaccggtgctcgatttagatcgtctgtgttgggtttgaggtctcagagaggagccttagccctggactccaaggcctttccacttggtgaccagcactgagcacagaggactcaccatggaattggggctgagcgtgggctttccttgttgctattttagaaggtgtccaatgtgagatgaaagtggtggagtcgtgggggagacttggtccagtccggggggtccctgagactctcctgtacagcctctggactcaccttgagcaattattggatgacctgggtccncaggctccaggggagggctggagtgggtgccaanataaagcaagatggggatacgaaagactaatgtggactctggtgaaggggttcggtacaccatctccagagactaaatcgaccaaagtaattcgaagtttcttttagggaaattgggggaactaggtctgaagatccggaanactacggnagtataattaacgtgacggngagagagagngttagtaacgtaggtaagggtaggagacgtaagttgtg

SEQ ID NO: 311100 - DNA, 624 bp, Homo sapiens
  misc_feature: GZ8MTXP01EWMBA.45.34.D01.1.454.CMB.2.raw
  modified_base (226)..(226): a, c, t, g, unknown or other
  misc_feature (226)..(226): n is a, c, g, or t
  modified_base (251)..(252): a, c, t, g, unknown or other
  misc_feature (251)..(252): n is a, c, g, or t
  modified_base (605)..(605): a, c, t, g, unknown or other
  misc_feature (605)..(605): n is a, c, g, or t
  modified_base (613)..(613): a, c, t, g, unknown or other
  misc_feature (613)..(613): n is a, c, g, or t
tcagacgcgatcgacacgaccggtgctcgatttagatcgtctgtgttgggtttgggggcaggagtcagacccactcaggacacagcatggacatgagggtccccgctcagctcctggggctcctgctgctctggctcccaggtgccagatgtgccatccagatgacccagtctccattcctccctgtctgcatctgtaggagacagtagttaccataactgccggnaagtcaggatatagaaatgagtagnngtatcagcagagaccgaggggacccacccccatccgtagtctagtggtctccttaccgtaaggttaacgaaaggttcgggtaccctagtaccgtaaggttcgagggtcgggtcgggttgggtactgggcctaaacgtaagtaaacttccaccttactaccaaaccctactaccgaccggcccgcctagaccgaacgtacccgtaaagttacttttacgaaccttaactttaacttaccgtcgttaacttaaagtaaacttacttaactaaacccttccgtacgtaactacgtccggaaccgtaaacgggaccaagtcttaggaattacaacgaaacgttagttgacggtcacncaccgttnttctcgttctc

SEQ ID NO: 311101 - DNA, 668 bp, Homo sapiens
  misc_feature: GZ8MTXP01CB5UY.45.34.D01.1.454.CMB.2.raw
  modified_base (255)..(255): a, c, t, g, unknown or other
  misc_feature (255)..(255): n is a, c, g, or t
  modified_base (297)..(297): a, c, t, g, unknown or other
  misc_feature (297)..(297): n is a, c, g, or t
tcagacgcgatcgacacgaccggtgctcgatttagatcgtctgtgttgggtttggggagagaggagccttagccctggactccaaggcctttccacttggtgaccagcactgagcacagaggactcaccatggaattggggctgagctgggctttccttgttgctattttagaaggtgtccaatgtgagatgaaagtggtggagtcgtgggggagacttggtccagtccggggggtcctgagactctcctgtacngcctctggactcaccttgagcaatatggatgacctgggtccnccgaggctccgaggggagggctgggaggtggggtggaccaacaagtaaagcaaggagtaggggaagtaccggaaaagactagtcggtaggaacctcgtggtaggtaaagggggttccggttcaacctagttcctaccgagaagaaccaatacgaccaaagtaatttactagtttactttttaggaaagtaggaactaggtcgttaggaagtaacgttacccggaaagtaacgtaacggacgtaaagttaagttacgttaacgtcggcggaacggtaagaaggtagttagtaaagttacggttaaccgttaaggggttacggggggttaagaaggtaacgtagttcggttaggggtttaagttaagtttggg

SEQ ID NO: 311102 - DNA, 517 bp, Homo sapiens
  misc_feature: GZ8MTXP01DGDIC.45.34.D01.1.454.CMB.2.raw
  modified_base (325)..(325): a, c, t, g, unknown or other
  misc_feature (325)..(325): n is a, c, g, or t
  modified_base (351)..(351): a, c, t, g, unknown or other
  misc_feature (351)..(351): n is a, c, g, or t
  modified_base (366)..(366): a, c, t, g, unknown or other
  misc_feature (366)..(366): n is a, c, g, or t
  modified_base (464)..(464): a, c, t, g, unknown or other
  misc_feature (464)..(464): n is a, c, g, or t
  modified_base (468)..(468): a, c, t, g, unknown or other
  misc_feature (468)..(468): n is a, c, g, or t
  modified_base (471)..(472): a, c, t, g, unknown or other
  misc_feature (471)..(472): n is a, c, g, or t
  modified_base (474)..(474): a, c, t, g, unknown or other
  misc_feature (474)..(474): n is a, c, g, or t
  modified_base (476)..(476): a, c, t, g, unknown or other
  misc_feature (476)..(476): n is a, c, g, or t
  modified_base (482)..(482): a, c, t, g, unknown or other
  misc_feature (482)..(482): n is a, c, g, or t
  modified_base (486)..(486): a, c, t, g, unknown or other
  misc_feature (486)..(486): n is a, c, g, or t
  modified_base (505)..(505): a, c, t, g, unknown or other
  misc_feature (505)..(505): n is a, c, g, or t
  modified_base (514)..(514): a, c, t, g, unknown or other
  misc_feature (514)..(514): n is a, c, g, or t
tcagacgcgatcgacacgaccggtgctcgatttagatcgtctgtgttgggtttgggggagacttggtccatccgggggggtccctgagactctcctgtacagcctctggactcaccttgagcaattattggatgacctgggtccgccaggctccagggaagggctggagtgggtggccaacataaaagcaagatgggagtcgaaaagaactatgtggactctgtgaagggtcgttcaccatctccagagacaatgccaaagaattcagtctttttggaaatggacagctgagatccgaagatacggcagtatattactgcgcganagatgatagtcctaaagtgggggtanagaccatctggtttnatgctttgatgtgtggggccacgggacaaacggtcacgtctcttcagccctacaccgaagggcccatcggtcttcccctggcgccctgctccaggacncacncgnncncngcgcgnggcngctgacgagactctctcgntcgcgtcgngcg

SEQ ID NO: 311103 - DNA, 578 bp, Homo sapiens
  misc_feature: GZ8MTXP01CJTXJ.45.34.D01.1.454.CMB.2.raw
  modified_base (216)..(216): a, c, t, g, unknown or other
  misc_feature (216)..(216): n is a, c, g, or t
  modified_base (220)..(220): a, c, t, g, unknown or other
  misc_feature (220)..(220): n is a, c, g, or t
  modified_base (244)..(244): a, c, t, g, unknown or other
  misc_feature (244)..(244): n is a, c, g, or t
  modified_base (265)..(265): a, c, t, g, unknown or other
  misc_feature (265)..(265): n is a, c, g, or t
  modified_base (288)..(288): a, c, t, g, unknown or other
  misc_feature (288)..(288): n is a, c, g, or t
tcagacgcgatcgacacgaccggtgctcgatttagatcgtctgtgttgggtttgggggagtcagacccactcaggacacagcatggacatgagggtccccgctcagctcctggggctcctgctgctctggctcccaggtgccagatgtgccatccagatgacccagtctccattctccctgtctgcatctgtagagacagagttacatactgcggnagtnagatatagaatgagttagctgtancagcagagaccgaggggaccncccccatccgtagtctagtggtntcttcgaggttacgaaaggtcggggtacccagtacgtaggttcgacggtgggcggtgggtctggacacgtaagtacttcactctacacatcacgccgcctgcacgcccgtaatcttttagactaacttacttactgtactaacagttactttaccaacttacccgtacggactacgttacggaccgaaacgggtaccaagtcgttaaggaagttaactaaacgaaacccgtaagttggacgttcttcggtaaccacgtaactcttcgttcctttcgttaacctttccccg

SEQ ID NO: 311104 - DNA, 586 bp, Homo sapiens
  misc_feature: GZ8MTXP01B5TX8.45.34.D01.1.454.CMB.2.raw
  modified_base (216)..(216): a, c, t, g, unknown or other
  misc_feature (216)..(216): n is a, c, g, or t
  modified_base (262)..(262): a, c, t, g, unknown or other
  misc_feature (262)..(262): n is a, c, g, or t
  modified_base (408)..(408): a, c, t, g, unknown or other
  misc_feature (408)..(408): n is a, c, g, or t
  modified_base (506)..(506): a, c, t, g, unknown or other
  misc_feature (506)..(506): n is a, c, g, or t
  modified_base (511)..(511): a, c, t, g, unknown or other
  misc_feature (511)..(511): n is a, c, g, or t
tcagacgcgatcgacacgaccggtgctcgatttagatcgtctgtgttgggtttggggagagaggagccttagccctggactccaaggcctttccacttggtgaccagcactgagcacagaggactcaccatggaattggggctgagctgggcttttccttgttgctattttagaaggtgtccaatgttagatgaaagtggtggagtcgtggggganacttggtccagtccggggggtccctgagactctcctgtacagcctntggactcacttgagcaattatggatgacctgggtccgcaggctccgaggggaaggggctggagtgggtaggaccaacataaagcaaagatagggagtacgaaagactagtgtggactgtgtggaagggtcgtacacatcaccaganacaatcgacaaagtaattacgtagttacgttttaggaaattgggaactagtcgttagggaagtacgtaccgaaagactacggactagtaattattacngtcgngaagaagatagttagtaacggtcttaaaggttgggggttaagaagtagtaagttcgttggttagtaagttgttcg

SEQ ID NO: 311105 - DNA, 605 bp, Homo sapiens
  misc_feature: GZ8MTXP01AW1WQ.45.34.D01.1.454.CMB.2.raw
  modified_base (249)..(249): a, c, t, g, unknown or other
  misc_feature (249)..(249): n is a, c, g, or t
  modified_base (276)..(276): a, c, t, g, unknown or other
  misc_feature (276)..(276): n is a, c, g, or t
tcagacgcgatcgacacgaccggtgctcgatttagatcgtctgtgttgggtttgggggcaggagtcagacccactcaggacacagcatggacatgagggtccccgctcagctcctggggctcctgctgctctggctcccaggtgccagatgtgccatccagatgacccagtctccattctccctgtctgcatctgtaggagacagagttaccataactgccggcaagtcaggatatagaatgagtaggntggtatcagcagacgaccgaggggacncccccaactcctagtctatggtgcttccgaggttacaaaggtcgggggtacccagtacgaaggttccgaggtggtcgggtggtctgggcactagaattccactctacaccatcacgcccgctgccacggacccgtaaagtacttttcgacttaaactttattaacgtacgttactaaccgtaaagttactttaaccaaactttaccccgaggtaacctacgtttaccgggacctaaacgggggaccaaaggtccttaggaacggttaactaacgaaaacgaaccgttggttacggtaactcgaaccacctattcctaagttcctttaac

SEQ ID NO: 311106 - DNA, 644 bp, Homo sapiens
  misc_feature: GZ8MTXP01EPUBK.45.34.D01.1.454.CMB.2.raw
  modified_base (217)..(217): a, c, t, g, unknown or other
  misc_feature (217)..(217): n is a, c, g, or t
tcagacgcgatcgacacgaccggtgctcgatttagatcgtctgtgttgggtttggggagagaggagccttagccctggactccaaggcctttccacttggtgaccagcactgagcacagaggactcaccatggaattggggctgagctgggcttttccttgttgcttattttagaaggtgtccaatgtgagatgaaagtggtggagtcgtggggganacgttggtccaggtcccgggggggtccctgagactctcctgtacagcctctggactcaccttgagactaatattggatgaccgtgggtccgccgaggctccgaggggagggcgtgggagtgggtggaccaaacaagtaaagcgaaagagtaggggaagtaaccgaaaagtaactagtggtaggaaacttcgtggtagggtaaacggggttccggttacaaccgtattctaccgagaacgaacaagtcgaaccgtaaagtaactttacgtaagtttacgttttaagaaagtggtaacgtagtacggtagagtaacgtaccggaaagtaagtacggactaagttaatattacgtgccgaagaagaggtattagtaagtagttaccgttaaggttaggggtaagagtaatagtgttaggttgttaagttg

SEQ ID NO: 311107 - DNA, 552 bp, Homo sapiens
  misc_feature: GZ8MTXP01AC0FB.45.34.D01.1.454.CMB.2.raw
  modified_base (260)..(260): a, c, t, g, unknown or other
  misc_feature (260)..(260): n is a, c, g, or t
  modified_base (298)..(298): a, c, t, g, unknown or other
  misc_feature (298)..(298): n is a, c, g, or t
  modified_base (468)..(468): a, c, t, g, unknown or other
  misc_feature (468)..(468): n is a, c, g, or t
  modified_base (522)..(522): a, c, t, g, unknown or other
  misc_feature (522)..(522): n is a, c, g, or t
tcagacgcgatcgacacgaccggtgctcgatttagatcgtctgtgttgggtttggggagagaggagccttagccctggactccaaggcctttccacttggtgaccagcactgagcacagaggactcaccatggaattggggctgagctgggctttccttgttgctattttagaaggtgtccaatgtgagatgaaagtggtggagtctgggggagacttggtccagtccggggggtccctgagactctcctgtacagcctntggactcaccttgagcaatattggatgacctgggtccncaggctccgaggggaaggggctggagtgggtggccaacataaagcaagatgggatccgaaagactatgtggaactctgtgaaagggtcggttcacatctccagagacaatgaccaagtaattctagttcttttaggaaatggaacagtcgtgagataccgaagatacganagtatattactgcgcgagagattgaagtgttaccgttaaggttagggggttaanagggtaacagtcgttgggtttgaagtttcg

SEQ ID NO: 311108 - DNA, 609 bp, Homo sapiens
  misc_feature: GZ8MTXP01C3J7P.45.34.D01.1.454.CMB.2.raw
  modified_base (202)..(202): a, c, t, g, unknown or other
  misc_feature (202)..(202): n is a, c, g, or t
  modified_base (222)..(222): a, c, t, g, unknown or other
  misc_feature (222)..(222): n is a, c, g, or t
  modified_base (226)..(226): a, c, t, g, unknown or other
  misc_feature (226)..(226): n is a, c, g, or t
  modified_base (243)..(243): a, c, t, g, unknown or other
  misc_feature (243)..(243): n is a, c, g, or t
  modified_base (248)..(248): a, c, t, g, unknown or other
  misc_feature (248)..(248): n is a, c, g, or t
  modified_base (252)..(252): a, c, t, g, unknown or other
  misc_feature (252)..(252): n is a, c, g, or t
  modified_base (289)..(289): a, c, t, g, unknown or other
  misc_feature (289)..(289): n is a, c, g, or t
tcagacgcgatcgacacgaccggtgctcgatttagatcgtctgtgttgggtttgggggcaggagtcagacccactcaggacacagcatggacatgagggtccccgctcagctcctggggctcctgctgctctggctcccaggtgccagatgtgccatccagatgacccagtctccattcctccctgtctgcatctgtagganacagattaccatactgcggnagtnagatatagaatgagtgntgtancagnagagaccgagggaccacccccatctagtctagtggtncttacgtaaggtacgaaggtcgggtaccatacgtaaggttcaggtggcggtggtctggcacgagtaacttcactctacactatcacgccgctgccgacgacccgtaagttactttacgaacttaactttacttacttacgggttaactaacgttaaacgttaccttttacctaaaccgtttaccccgtacgggtaaaccttcggttacccgggaaccgaaacggggtaccctaaaggtcttagggaacgttaacgttaaacgaaacgttaacgttggttaccggtctacggcctaactcgttaccttcgttcctttaacc

SEQ ID NO: 311109 - DNA, 613 bp, Homo sapiens
  misc_feature: GZ8MTXP01CTMDO.45.34.D01.1.454.CMB.2.raw
  modified_base (222)..(222): a, c, t, g, unknown or other
  misc_feature (222)..(222): n is a, c, g, or t
  modified_base (227)..(227): a, c, t, g, unknown or other
  misc_feature (227)..(227): n is a, c, g, or t
  modified_base (244)..(245): a, c, t, g, unknown or other
  misc_feature (244)..(245): n is a, c, g, or t
  modified_base (248)..(248): a, c, t, g, unknown or other
  misc_feature (248)..(248): n is a, c, g, or t
  modified_base (250)..(250): a, c, t, g, unknown or other
  misc_feature (250)..(250): n is a, c, g, or t
tcagacgcgatcgacacgaccggtgctcgatttagatcgtctgtgttgggtttgggggcaggagtcagacccactcaggacacagcatggacatgagggtccccgctcagctcctggggctcctgctgctctggctcccaggtgccagatgtgccatccagatgacccagtctcattctccctgtctgcatctgtagagacagtagtaccataactgcgganaagtnagatatagaatgagtgnngancngcagagaccgagggcaccccaatctagtctagtggtctacttaccgaaggttaacgaaaggttcgggtaccccatacgtaaacggttcagggtcgggtcgggttgggtaacgttgggaaccaagtagtaaacttcaacctctacaaccataccacgcccgctacgaccgacgtacccgaagttactttacgacttaaacttagttactaggttacttaaacgtaagtactttaactaaacttaccccgtggtaaccacgttccgggaaccaaacgggacctaaagtcgttaggtaaacacgttaaaccgaaacgttaacgttggttaggcctagtaacacctattccttaacgttccttaacc

SEQ ID NO: 311110 - DNA, 706 bp, Homo sapiens
  misc_feature: GZ8MTXP01CMQ0M.45.34.D01.1.454.CMB.2.raw
  modified_base (195)..(195): a, c, t, g, unknown or other
  misc_feature (195)..(195): n is a, c, g, or t
  modified_base (499)..(499): a, c, t, g, unknown or other
  misc_feature (499)..(499): n is a, c, g, or t
  modified_base (621)..(621): a, c, t, g, unknown or other
  misc_feature (621)..(621): n is a, c, g, or t
  modified_base (631)..(631): a, c, t, g, unknown or other
  misc_feature (631)..(631): n is a, c, g, or t
  modified_base (687)..(687): a, c, t, g, unknown or other
  misc_feature (687)..(687): n is a, c, g, or t
tcagacgcgatcgacacgaccggtgctcgatttagatcgtctgtgttgggtttgaggtctcagagaggagccttagccctggactccaaggcctttccacttggtgaccagcactgagcacagaggactcaccatggaattggggctgagcgtgggtctttccttgttgcttattttagaaggtgtcaatgtganatagaaagtggtggagtcgtgggggatacgttggtccaggtccggggggtcctggagtactctcctgtacacgtcctcgtcggactcaccttgagtactaaattagttaggatgtacgttcgggtcccgaccgacgggcctaccggaagggggaaggggtcgtgggggaggttgggggtacggaccaaacgaagtaaacggagaaaggtacggtaggggaagtacgaaaagtaactaaagtggtcggtacgtgtagggtagggtaacgggtccgttacaaccctagttacccgacaaagggaanaaccgtaagtacgaaaccctaaaggtaaactttcgaagttttacgttttaaagggaaattcggggggaaacttaggttacaggggaactacgtaaccgaaggtaacgtaccggataagttanaacgtttcgnggcgagttagaaagtgttacgttagttaaacgttaacggtaaggtaacggggtaanagttacgttaagtttgtgg

SEQ ID NO: 311111 - DNA, 580 bp, Homo sapiens
  misc_feature: GZ8MTXP01AHK9U.45.34.D01.1.454.CMB.2.raw
  modified_base (501)..(501): a, c, t, g, unknown or other
  misc_feature (501)..(501): n is a, c, g, or t
  modified_base (573)..(573): a, c, t, g, unknown or other
  misc_feature (573)..(573): n is a, c, g, or t
tcagacgcgatcgacacgaccggtgctcgatttagatcgtctgtgttgggtttggggagagaggagccttagccctggactccaaggcctttccacttggtgaccagcactgagcacagaggactcaccatggaattgggctgagctgggctttccttgttgctatttagaagtgtccaatgtgagatgaaagtggtggagtcgtgggggagacgttggtccgaggtccgggggggtcctgagactctcctgtacagcctctggactcaccttgagctaatagtggatcgaccgtgggtccgccaggctccgaggggaagggcgtggaggtgggtggaccaaacgaagtaaagcaagagtgggagtacgaaagactagtggtgaactcgtggtgaagggtcgtcacatctaccagatacaagtcgaccaagaacttcgagttcgttttagaaatggactagtcgtagagactacgaagtagtacgcgtaagtatagttacncgtgaacgaagagtattagtacgtagttaccgttaaggttggggaagagtaacgtaagttcgttagggttgngtttcgg

SEQ ID NO: 311112 - DNA, 566 bp, Homo sapiens
  misc_feature: GZ8MTXP01BM7WS.45.34.D01.1.454.CMB.2.raw
  modified_base (202)..(202): a, c, t, g, unknown or other
  misc_feature (202)..(202): n is a, c, g, or t
  modified_base (224)..(224): a, c, t, g, unknown or other
  misc_feature (224)..(224): n is a, c, g, or t
  modified_base (277)..(277): a, c, t, g, unknown or other
  misc_feature (277)..(277): n is a, c, g, or t
tcagacgcgatcgacacgaccggtgctcgatttagatcgtctgtgttgggtttgggggcaggagtcagacccactcaggacacagcatggacatgagggtccccgctcagctcctggggctcctgctgctctggctcccaggtgccagatgtgccatccagatgacccagtctccattcctccctgtctgcatctgtagganacagagttaccataactgcggnaagtcaggatatagaaatgagtaggctggtatcagcagagaccgagggggacnccccccaatcctagtctagtggtgcctttaccgaggtttaacaaaggttcggggtacccagtcgaaaggttcaggtgggcggtgggtctgggcacgagaacttcactctacacatcacgccgctgcacgccgtaatctttgactaacttattactggtactaacgaagtactttacaacttaccctggtaacctagttccggacctaaacggggacccaaagtcttaggacttagtaaccaaaacgttacgttggttacggctcgcctactattccttgttccttaacc

SEQ ID NO: 311113 - DNA, 635 bp, Homo sapiens
  misc_feature: GZ8MTXP01BY16H.45.34.D01.1.454.CMB.2.raw
  modified_base (202)..(202): a, c, t, g, unknown or other
  misc_feature (202)..(202): n is a, c, g, or t
  modified_base (227)..(227): a, c, t, g, unknown or other
  misc_feature (227)..(227): n is a, c, g, or t
  modified_base (232)..(232): a, c, t, g, unknown or other
  misc_feature (232)..(232): n is a, c, g, or t
  modified_base (251)..(252): a, c, t, g, unknown or other
  misc_feature (251)..(252): n is a, c, g, or t
  modified_base (258)..(258): a, c, t, g, unknown or other
  misc_feature (258)..(258): n is a, c, g, or t
tcagacgcgatcgacacgaccggtgctcgatttagatcgtctgtgttgggtttgggggcaggagtcagacccactcaggacacagcatggacatgagggtccccgctcagctcctggggctcctgctgctctggctcccaggtgccagatgtgccatccagatgacccagtctccattcctccctgtctgcatctgtagganacagagttaccataacttgccgggnaagtnaggatatagaatgagtagnnggtatnagcagacgacggagggacacccccatcctagtctagtggtctcttaccgtaaggttaacgaaaggtcggggtacccagtacgtaacggttctagggtcgggtcgggtgggtctacgggctaaacgtaagtaacttccgactcctacacctatccacgcccgctcgacaaccggaccgtaaatctttacgacttaaacttacttactcggtaacttaacgtaacgttaacttactaaacctttacccgtacgtaacgtacgttaccggaaccgtaaacgggaacccgaagtccgttaggaacgaactaaacccgtaaagttaaccgttggttacggtaacttccggaacctacctagttccttgttaacccgtttccc

SEQ ID NO: 311114 - DNA, 564 bp, Homo sapiens
  misc_feature: GZ8MTXP01DQLXW.45.34.D01.1.454.CMB.2.raw
  modified_base (219)..(219): a, c, t, g, unknown or other
  misc_feature (219)..(219): n is a, c, g, or t
  modified_base (308)..(308): a, c, t, g, unknown or other
  misc_feature (308)..(308): n is a, c, g, or t
  modified_base (346)..(346): a, c, t, g, unknown or other
  misc_feature (346)..(346): n is a, c, g, or t
  modified_base (373)..(373): a, c, t, g, unknown or other
  misc_feature (373)..(373): n is a, c, g, or t
  modified_base (425)..(425): a, c, t, g, unknown or other
  misc_feature (425)..(425): n is a, c, g, or t
  modified_base (515)..(515): a, c, t, g, unknown or other
  misc_feature (515)..(515): n is a, c, g, or t
tcagacgcgatcgacacgaccggtgctcgatttagatcgtctgtgttgggtttgaggtctcagagaggagccttagccctggactccaaggcctttccacttggtgaccagcactgagcacagaggactcaccatggaattggggctgagctgggctttccttgttgctattttagaaggtgtccaatgtgagatgaaagtggtggagtcgtggggganacgttgggtccaggtccgggggggtccctgagactctcctgtacagcctctggactcaccttgagcaattattggatgacctgggtccncaggctccgaggggaagggctgggagtgggtgccaaanataaagcaagacgtgggatacgaaaanactaagtgtggactcgtggtagaaggggttcgttacaccatctacagagaanaatacgaccaaagtaattcagttcttttaaggaaattggggaactgtactagagtataccgaagtatacggatagtatattaacgtgcgngagagattgattagtaactaaggtggggtagagactgttaacgtttggg

SEQ ID NO: 311115 - DNA, 582 bp, Homo sapiens
  misc_feature: GZ8MTXP01EDT0I.45.34.D01.1.454.CMB.2.raw
  modified_base (556)..(556): a, c, t, g, unknown or other
  misc_feature (556)..(556): n is a, c, g, or t
tcagacgcgatcgacacgaccggtgctcgatttagatcgtctgtgttgggtttggggagagaggagccttagccctggactccaaggcctttccacttggtgaccagcactgagcacagaggactcaccatggaattggggctgagctgggcttttccttgttgctattttagaaggtgtccaatgtgagatgaaagtggtggagtcgtggggagacttggtccagtccggggggtcctgagactctcctgtacagcctctggactcaccttgagcaatattggatgacctgggtccgccaggctccgaggggaagggctggagtgggtggccaaacataaagcaaagataggggataccgaaagtaactagtgtaggaacttctggtagaaaggggttcggttacaccagtctacccagagacaatgaccaaagtaattctaagttcgtttttaggaaatggaactagtcgtagagtataccgaaagatacggacaagttatattactgcgcgtaagagtattagaagtagttaccgttaaggttagggggtaanaggaactatcgttggtttgaagttgg

SEQ ID NO: 311116 - DNA, 566 bp, Homo sapiens
  misc_feature: GZ8MTXP01C55RR.45.34.D01.1.454.CMB.2.raw
  modified_base (206)..(206): a, c, t, g, unknown or other
  misc_feature (206)..(206): n is a, c, g, or t
  modified_base (228)..(228): a, c, t, g, unknown or other
  misc_feature (228)..(228): n is a, c, g, or t
  modified_base (233)..(233): a, c, t, g, unknown or other
  misc_feature (233)..(233): n is a, c, g, or t
  modified_base (251)..(252): a, c, t, g, unknown or other
  misc_feature (251)..(252): n is a, c, g, or t
  modified_base (260)..(260): a, c, t, g, unknown or other
  misc_feature (260)..(260): n is a, c, g, or t
  modified_base (414)..(414): a, c, t, g, unknown or other
  misc_feature (414)..(414): n is a, c, g, or t
  modified_base (544)..(545): a, c, t, g, unknown or other
  misc_feature (544)..(545): n is a, c, g, or t
  modified_base (553)..(553): a, c, t, g, unknown or other
  misc_feature (553)..(553): n is a, c, g, or t
tcagacgcgatcgacacgaccggtgctcgatttagatcgtctgtgttgggtttgggggcaggagtcagacccactcaggacacagcatggacatgagggtccccgctcagctcctggggctcctgctgctctggcctcccaggtgccagatgtgccatccagatcgacccagtctcctattcctccctgtctgctatctgtagganacagtattaccatactgcgganaagtnagatatagaatgagtagnngatcaganagacgaccggacggggacccaccccctaactcctagtactagtggtctcttacgtaaggtaacgtaaaggtcgggtacctagtacgtaacggttcgaggtggtcgggtggtcgtgcagtaagtaacttcactctacacctatcgacgccgtacncgacgacgaccgtaagtctttacgactaattacttactggtactaagtaattacttactaacttccgtaggactacgtcggaccaaggaccaaagtcttagaacataaacgaaagttacgttgacggtcnnctaacctnttctcgttctaac

SEQ ID NO: 311117 - DNA, 725 bp, Homo sapiens
  misc_feature: GZ8MTXP01DE2YE.45.34.D01.1.454.CMB.2.raw
  modified_base (686)..(686): a, c, t, g, unknown or other
  misc_feature (686)..(686): n is a, c, g, or t
tcagacgcgatcgacacgaccggtgctcgatttagatcgtctgtgttgggtttggggagagaggagccttagccctggactccaaggcctttccacttggtgaccagcactgagcacagaggactcaccatggaattggggctgagctgggctttccttgttgctattttagaaggtgtccaatgtgagatgaaagtggtggagtcgtgggggagacttggtccagtccggggggtccctgagactctcctgtacagcctctggactcaccttgagcaatatggatcgacctgggtccgccaggctccgaggggagggctgggagtgggtggaccaacagtaaagcaaagagtggggagtaccggaaaagtaaacgtagtaggtacggaaccttcgtgggttagggtaaacgggggttccgggtttaccaaccgtattccgtacccgaagagaaacctaaagtacgacccgtaaaaggtaaatttccgtaacggtttacgttttttagggaaaagtttcggggtaaactacgggttaaccgttacggtaaaggtaacgttaaccccggtaaaaggtaacgttaaccgggaccgtaaaggttaatttaaacgttacgtggtaccgggaacggaaggaagtaaggttagtaaagttacggttaaccgttaagggtttaggggggtaanaagggtaacgtactggtttagggtttaagcgttttaagg

SEQ ID NO: 311118 - DNA, 640 bp, Homo sapiens
  misc_feature: GZ8MTXP01BW4BY.45.34.D01.1.454.CMB.2.raw
  modified_base (230)..(230): a, c, t, g, unknown or other
  misc_feature (230)..(230): n is a, c, g, or t
  modified_base (255)..(255): a, c, t, g, unknown or other
  misc_feature (255)..(255): n is a, c, g, or t
  modified_base (264)..(264): a, c, t, g, unknown or other
  misc_feature (264)..(264): n is a, c, g, or t
tcagacgcgatcgacacgaccggtgctcgatttagatcgtctgtgttgggtttgggggcaggagtcagacccactcaggacacagcatggacatgagggtccccgctcagctcctggggctcctgctgctctggctcccaggtgccagatgtgccatccagatgacccagtctccattcctccctgtctgcatctgtaggagacagtagttaccataacgttgccggganaagtcaggataatagaatgagtagntgtatcagnagagaccgaggggaccacccccatcctagtctagtggtcgtcttaccgaaggttacgaaaggtcgggtaccagtacgaacggttcaggtgggcggtggtactggcactaagtacttcactctacactatcacgccgctgacacggtaccgtaagttacttttacgtaaactttattaacttcgtaactaaacgtaaacttactttaactaaaccgttaccccgtacggtacttaaccggttaccgggaacccgtaaaacggggtaccctaaaggtccttaaggaaacgtaacttaaaccgaaaaccggtagttcggttacggttacttaaccggacctaacccttattccgttacgttccgttaaccgttaacccg

SEQ ID NO: 311119 - DNA, 546 bp, Homo sapiens
  misc_feature: GZ8MTXP01ELQCZ.45.34.D01.1.454.CMB.2.raw
  modified_base (256)..(256): a, c, t, g, unknown or other
  misc_feature (256)..(256): n is a, c, g, or t
  modified_base (296)..(296): a, c, t, g, unknown or other
  misc_feature (296)..(296): n is a, c, g, or t
  modified_base (436)..(436): a, c, t, g, unknown or other
  misc_feature (436)..(436): n is a, c, g, or t
  modified_base (452)..(452): a, c, t, g, unknown or other
  misc_feature (452)..(452): n is a, c, g, or t
  modified_base (455)..(455): a, c, t, g, unknown or other
  misc_feature (455)..(455): n is a, c, g, or t
  modified_base (470)..(470): a, c, t, g, unknown or other
  misc_feature (470)..(470): n is a, c, g, or t
  modified_base (481)..(481): a, c, t, g, unknown or other
  misc_feature (481)..(481): n is a, c, g, or t
  modified_base (490)..(490): a, c, t, g, unknown or other
  misc_feature (490)..(490): n is a, c, g, or t
  modified_base (492)..(492): a, c, t, g, unknown or other
  misc_feature (492)..(492): n is a, c, g, or t
  modified_base (495)..(495): a, c, t, g, unknown or other
  misc_feature (495)..(495): n is a, c, g, or t
  modified_base (523)..(523): a, c, t, g, unknown or other
  misc_feature (523)..(523): n is a, c, g, or t
  modified_base (529)..(529): a, c, t, g, unknown or other
  misc_feature (529)..(529): n is a, c, g, or t
tcagacgcgatcgacacgaccggtgctcgatttagatcgtctgtgttgggtttggggagagaggagccttagccctggactccaaggcctttccacttggtgaccagcactgagcacagaggactcaccatggaattggggctgagctgggcttttccttgttgctattttagaaggtgtccaatgtgagatgaaagtggtggagtcgtgggggagacttggtccagtccggggggtcctgagactctcctgtacngcctctggactcaccttgagcaatatggatgactggtccncaggctcgaggggaggctggagtgggtgaccaacataaagcaaagatggggaagtaccgaaaagaactagtgtaggaaactgtggtgaaaggggttcgttacacatctccagagaacaatgaccaaagtaattctagttnttttaggaaatgaacngtntagagatacgaaganacggcagtatnttactgcgnanggnttgatagttacgttaaggttggggtaanagaacntagttggtttgaagttg

SEQ ID NO: 311120 - DNA, 660 bp, Homo sapiens
  misc_feature: GZ8MTXP01DJSKL.45.34.D01.1.454.CMB.2.raw
  modified_base (216)..(216): a, c, t, g, unknown or other
  misc_feature (216)..(216): n is a, c, g, or t
  modified_base (540)..(540): a, c, t, g, unknown or other
  misc_feature (540)..(540): n is a, c, g, or t
  modified_base (610)..(610): a, c, t, g, unknown or other
  misc_feature (610)..(610): n is a, c, g, or t
tcagacgcgatcgacacgaccggtgctcgatttagatcgtctgtgttgggtttggggagagaggagccttagccctggactccaaggcctttccacttggtgaccagcactgagcacagaggactcaccatggaattggggctgagctgggcttttccttgttgctattttagaaggtgtccaatgtgagatgaaagtggtggagtcgtggggganacttggtccagtccggggggtcctgagactctcctgtacagcctctggactcaccttgagctaatattggatcgaccgtgggtccgccaggcctccgagggggaagggctgggaggtgggtcggaccaaacgaataaagcaaagagtgggagtaccgaaagtactagtgtaggaacttgtggtaggtaacggggtcgttcactatcctaccagagaacaagtcgaacctaaagtaattctaagtttcgttttaggaaattgggaactagttcgtagagtaactaccggaaagtacgaccggtataaagttattaagtttaccgnggccggtaacgaaggaggtagttaggtaaagttaacggttaccggttaaagggttacgggggggttaaanaaacgggtaacttaacggttcggtttaggggttttaacgttaagtttcgg

SEQ ID NO: 311121 - DNA, 660 bp, Homo sapiens
  misc_feature: GZ8MTXP01BCLDC.45.34.D01.1.454.CMB.2.raw
tcagacgcgatcgacacgaccggtgctcgatttagatcgtctgtgttgggtttgaggtctcagagaggagccttagccctggactccaaggcctttccacttggtgaccagcactgagcacagaggactcaccatggaattggggctgagctgggctttccttgttgcttattttagaaggtgtccaatgtgagatgaaagtggtggagtcgtgggggagtacgttggtccaggtccgggggggtccctgagactctcctgtacagcctctggactcaccttgagctaattagtggatgaccgtgggtcccgccgaggcctaccggagggggaacggggctgggaggtggggtcggaccaaacaagtaaagcgaaagagtggggaagtacgaaaagtactaagtggtcggactcgtggtaggtaaggggttcggttacaaccgtatcctaccgaaggaacgaacgaaagtacgaacctaaagtaactttacgtaagtttacgtttttaagggaaagttcgggggtaacgtaggttctaggaagtaacgtaccggaaagtaacgtacggtacgtaagttaattaagttaacgtggcgacggagagtaattagttagttagtaacgtaagggtgggggtaagagttactaagttcgtttggg

SEQ ID NO: 311122 - DNA, 652 bp, Homo sapiens
  misc_feature: GZ8MTXP01BOTQX.45.34.D01.1.454.CMB.2.raw
  modified_base (206)..(206): a, c, t, g, unknown or other
  misc_feature (206)..(206): n is a, c, g, or t
  modified_base (260)..(260): a, c, t, g, unknown or other
  misc_feature (260)..(260): n is a, c, g, or t
tcagacgcgatcgacacgaccggtgctcgatttagatcgtctgtgttgggtttgggggcaggagtcagacccactcaggacacagcatggacatgagggtccccgctcagctcctggggctcctgctgctctggcctcccaggtgccagatgtgccatccagatcgacccagtcctccattcctccctgtctgcatctggtagganacagtacgttaccattaacgtggccggactaagtcagtatataagaatgagtgntgtatcagcagacggaccgacggggaccacccccaatccgtagtctagtgtcgtcttacgaggttaacgaaggtcggtacccagtcgtaacggttcgaggttcgggcgggttacgggtcgtaggcaaacgtaacgtaacttcccaacttccctactaaaccctacgttaccgaccggtcccgccgtacggacccgaaccggtaccccggtaaagtttaccgttttacgaacctttaaacttactttaccgttcgggtaacttaacgtaacgttacctttaactaaccgtttacccgtacgtaacgtacgtcccggaacgtaacggaaccaagtacttacgaagactaacgaacgttacgttgcgtaactcgaactaccattctcgttctccg

SEQ ID NO: 311123 - DNA, 748 bp, Homo sapiens
  misc_feature: GZ8MTXP01EULZK.45.34.D01.1.454.CMB.2.raw
  modified_base (200)..(200): a, c, t, g, unknown or other
  misc_feature (200)..(200): n is a, c, g, or t
  modified_base (223)..(223): a, c, t, g, unknown or other
  misc_feature (223)..(223): n is a, c, g, or t
  modified_base (273)..(273): a, c, t, g, unknown or other
  misc_feature (273)..(273): n is a, c, g, or t
  modified_base (296)..(296): a, c, t, g, unknown or other
  misc_feature (296)..(296): n is a, c, g, or t
tcagacgcgatcgacacgaccggtgctcgatttagatcgtctgtgttgggtttggggaggagtcagacccactcaggacacagcatggacatgagggtccccgctcagctcctggggctcctgctgctctggctcccaggtgccagatgtgccatccagatgacccagtctccattcctccctgtctgcatctgtagganacagtagttaccataactgcggnaagtcagatatagaatgagtagctggatcagcagagaccgagggggaccncccccaatcctagtctagtggtntcttaccgaaggtttaacgaaagggttcggggtaccctaagtacgtaaggttcccgaaggttggggtcggggttagggtccgttacggggaccaacgtaaggtaaactttccgaaccttccttaccaaccctaacgttacccgaacggtccccgtccgtcgaccgtaaccgggtaaccccggtaaaagtttacgtttttacggaaacctttaaaccgtttaactttaaccgttacggttaaccgttaaacttaaaacggtttaccttttaaaccgtaaaccgtttaaccccgtacggtaccttaaacggtttcccgggaacccgtaaacggggtaacccctaaaggtccgtttaaggaaacgtaacgttaaaccgaaaaccggtaacttcgggttcgggttaccttcggaccctaaccgtaattccgttcgttaaccgtttcccgtaacccg

SEQ ID NO: 311124 - DNA, 600 bp, Homo sapiens
  misc_feature: GZ8MTXP01EQT4E.45.34.D01.1.454.CMB.2.raw
  modified_base (258)..(258): a, c, t, g, unknown or other
  misc_feature (258)..(258): n is a, c, g, or t
  modified_base (536)..(536): a, c, t, g, unknown or other
  misc_feature (536)..(536): n is a, c, g, or t
  modified_base (542)..(542): a, c, t, g, unknown or other
  misc_feature (542)..(542): n is a, c, g, or t
tcagacgcgatcgacacgaccggtgctcgatttagatcgtctgtgttgggtttggggagagaggagccttagccctggactccaaggcctttccacttggtgaccagcactgagcacagaggactcaccatggaattggggctgagctgggcttttccttgttgctattttagaaggtgtccaatgtgagatgaaagtggtggagtcgtgggggagacttggtccagtcccggggggtccctgagactctcctgtacngcctctggactcaccttgagactaatatggatggaccgtgggtcccgccgaggctccgagggggaaggggcgtgggaggtggggtggacccaaagaagtaaagcaaagagtaggggagtaccgaaagactagtggtagaactgtggtaggtaaagggtcgttacaccatctacagagacaatgaccaaagtaattcgtaagtttcgttttaaggaaagttaggacgtagtcggtagagtacgtacgaaagacgtacggataagttatattactggcgngagagnttagagtagttaccgttaggttagggggtaacagtaacagttgttggtttgttgtttg

SEQ ID NO: 311125 - DNA, 812 bp, Homo sapiens
  misc_feature: GZ8MTXP01BV59J.45.34.D01.1.454.CMB.2.raw
tcagacgcgatcgacacgaccggtgctcgatttagatcgtctgtgttgggtttggggagagaggagccttagccctggactccaaggcctttccacttggtgaccagcactgagcacagaggactcaccatggaattggggctgagctgggcttttccttgttgcttattttagaaggtgtccaatgtgagatgaaagtggtggagtcgtgggggagacttggtccgaggtccgggggggtccctggagactctcctgtacagcctctggacctcaccttgagctaattattggatcgaccgtgggtcccgccgaggcctccggagggggaacggggcgtaggggaggttgggggttacggaccaaacgaagtaaaggacaaaggagtagggggaagtaaccggaaaagtaactagtaggtaggtaaacttcgttgggtagggtaaacggggttccggtttaccaacccgtacttacccgtacccgaaggtaacgaaaccgtaaacgttcgaaacccgtaaaagttaaacgttttacgttaacgtttttacgttttttaagggaaaacgttcgggtaaaccttagggttaccggttaaggtaacggtaacgttaacccgggaaaagtaacgttacccggggaacttaaagggtttaattaacgtttaacccgtgggaacccggaacgggtaaggttaaggtaacgttagggtaaagtttaaccgggttaaccggtttaaagggggttaggggggttaagaacgggtaaccgttaagggttccggttttagggtttcggttaagttttccggg

SEQ ID NO: 311126 - DNA, 607 bp, Homo sapiens
  misc_feature: GZ8MTXP01DD4KV.45.34.D01.1.454.CMB.2.raw
  modified_base (406)..(406): a, c, t, g, unknown or other
  misc_feature (406)..(406): n is a, c, g, or t
  modified_base (415)..(415): a, c, t, g, unknown or other
  misc_feature (415)..(415): n is a, c, g, or t
  modified_base (436)..(436): a, c, t, g, unknown or other
  misc_feature (436)..(436): n is a, c, g, or t
tcagacgcgatcgacacgaccggtgctcgatttagatcgtctgtgttgggtttgggggcaggagtcagacccactcaggacacagcatggacatgagggtccccgctcagctcctggggctcctgctgctctggctcccaggtgccagatgtgccatccagatcgaccccagtcctccattcctccctgtctgcatctgtagagacagtagttaccataacgttgccgggacaagtcaaggtatattaagaatgtagtaggctggtatcagacaggacgaccggacggggaccacccccaatcctagtctagtgtctcttaccgaaggttacaaggtcggtaccagtacgtaacggttcgaggtggtcgggtcgggtactgggcacgagtaacttcactcacaccntcacgtccncgtgacgtacgaccgtaagtntttacgacttaatttattacttaggttactaacgtaaattctttaacgtaaccttacccgtggaacctacgttccggaacgaacgggctaaaggtcttaggagttacaacgtaaaacgttcgttggttacggtcctcgaaccctaacgtcttaccgttcgttcctttaacc

SEQ ID NO: 311127 - DNA, 761 bp, Homo sapiens
  misc_feature: GZ8MTXP01BZCTU.45.34.D01.1.454.CMB.2.raw
tcagacgcgatcgacacgaccggtgctcgatttagatcgtctgtgttgggtttggggagagaggagccttagccctggactccaaggcctttccacttggtgaccagcactgagcacagaggactcaccatggaattggggctgagctgggcttttccttgttgcttattttagaaggtgtccaatgtgagatagaaagtggtggagtcgtgggggagtacgttggtccgaggtcccggggggtccctggacgtacctctcctgtacacgcctcgtggactcaccttgagctaatatggatcgaccgtgggtcccgccgaggccgtaccggaagggggaacggggcgtaggggaggtcgggggtacggaacccaaacgaaagttaaaacggcgaaaggtaggtagggggtaaacgttaaccccggaaaaaaggtaacgttaagtgggtacgggtaaaccttcgttgggttaaggggtaaacgggggtttcccgggtttacccaaccccgtattcccgtaacccgaaggaaacgaaaccgtaaagtacgaacccgtaaaaggttaaactttaccgttaacgttttacgttttttaagggaaaagttacggaacgttaggttacggtagtaacggtaacgtaaccggaaagtaacgtacggtacgtaagttaattagttacgtgcgaacgagaccgtagttagtagttagttacgttaagggttggggtaagagtaacgtagttcggttggttgttgtttaag

SEQ ID NO: 311128 - DNA, 544 bp, Homo sapiens
  misc_feature: GZ8MTXP01EUAZB.45.34.D01.1.454.CMB.2.raw
  modified_base (201)..(201): a, c, t, g, unknown or other
  misc_feature (201)..(201): n is a, c, g, or t
  modified_base (223)..(223): a, c, t, g, unknown or other
  misc_feature (223)..(223): n is a, c, g, or t
  modified_base (228)..(228): a, c, t, g, unknown or other
  misc_feature (228)..(228): n is a, c, g, or t
  modified_base (249)..(249): a, c, t, g, unknown or other
  misc_feature (249)..(249): n is a, c, g, or t
  modified_base (274)..(274): a, c, t, g, unknown or other
  misc_feature (274)..(274): n is a, c, g, or t
  modified_base (297)..(297): a, c, t, g, unknown or other
  misc_feature (297)..(297): n is a, c, g, or t
  modified_base (338)..(338): a, c, t, g, unknown or other
  misc_feature (338)..(338): n is a, c, g, or t
  modified_base (513)..(513): a, c, t, g, unknown or other
  misc_feature (513)..(513): n is a, c, g, or t
tcagacgcgatcgacacgaccggtgctcgatttagatcgtctgtgttgggtttgggggcaggagtcagacccactcaggacacagcatggacatgagggtccccgctcagctcctggggctcctgctgctctggctcccaggtgccagatgtgccatccagatgacccagtctccattcctccctgtctgcatctgtaganacagattaccataactgcgganaagtnaggatatagaaatgagtagcnggtatcagcagacgacgaggggacncccccaatcctagtctagtggtncttcgagttacaagtcggccatcaggtcagtggcgtggtcnggcagagtatcgactctcacatcacgccgctgacacggcccgtaaagtacttttgactaaactttagtactggtactaactaaagttacttactaacttacccgtagtaacctagttacggacccgaaagggtaccaagtcttaggacttataacgaaaacgttcgttgttcggntcgaaccaccgtattcctaacgttcttaacc

SEQ ID NO: 311129 - DNA, 611 bp, Homo sapiens
  misc_feature: GZ8MTXP01CC30N.45.34.D01.1.454.CMB.2.raw
  modified_base (227)..(227): a, c, t, g, unknown or other
  misc_feature (227)..(227): n is a, c, g, or t
  modified_base (250)..(250): a, c, t, g, unknown or other
  misc_feature (250)..(250): n is a, c, g, or t
  modified_base (255)..(255): a, c, t, g, unknown or other
  misc_feature (255)..(255): n is a, c, g, or t
tcagacgcgatcgacacgaccggtgctcgatttagatcgtctgtgttgggtttgggggcaggagtcagacccactcaggacacagcatggacatgagggtccccgctcagctcctggggcctcctgctgctctggctcccaggtgccagatgtgccatccagatgacccagtcctccattcctccctgtctgcatctgtagagacagatacatactgcggacaagtnaggatatagaatgagtgctggancaganagacgaccgaggggaccacccccactctagtctagtggtctctacgagttaacaaggttgtactacccataccgtaaggttcgaggtcggtcggtgggtctgggacaacgtagtaactccgtactctacaccatcacgcccgctgaccgacgtaccgaaggttactttacgtacttaaacttcttaacgtacggttacttaaacgtaagttaactttactaaccgttacccgtacgtaactacgttacccggaccgaaacggggaacctaaggttccttaggaacgtaaacgtaacgttaaaaccggttcttacgggtcgtaccgttcgaccctaccgttacttccttcgtttccc

SEQ ID NO: 311130 - DNA, 607 bp, Homo sapiens
  misc_feature: GZ8MTXP01DZMK5.45.34.D01.1.454.CMB.2.raw
  modified_base (223)..(223): a, c, t, g, unknown or other
  misc_feature (223)..(223): n is a, c, g, or t
  modified_base (248)..(248): a, c, t, g, unknown or other
  misc_feature (248)..(248): n is a, c, g, or t
  modified_base (253)..(253): a, c, t, g, unknown or other
  misc_feature (253)..(253): n is a, c, g, or t
tcagacgcgatcgacacgaccggtgctcgatttagatcgtctgtgttgggtttggggaggagtcagacccactcaggacacagcatggacatgagggtccccgctcagctcctggggctcctgctgctctggctcccaggtgccagatgtgccatccagatgacccagtctccattctccctgtctgcatctgtaggagacagagttaccataacttgccggnaagtcaggatattagaatgagtagntggancagcagagaccgagggggacacccccaatcctagtctagtggtgtccttacgaggtttaacaaaggttcggggtacccagtcgtaaaggtttccagggtgggtcgggtgggtcgtagggacaacgaagtaaactttccaacctctacaacctatccacgcccgcgtcgaccacgacccgtaagttactttcgacttaaacttattactgttactaactaaagttactttaccaacttaacccgtcggtaactaacgttccggaaccgaaacgggtaccaagtcgttagaaacgtacttaacgaaaacgtcgttaggttcggactcgacctaactatcttcgttccttcgtaacc

SEQ ID NO: 311131 - DNA, 597 bp, Homo sapiens
  misc_feature: GZ8MTXP01DZNS1.45.34.D01.1.454.CMB.2.raw
  modified_base (226)..(226): a, c, t, g, unknown or other
  misc_feature (226)..(226): n is a, c, g, or t
  modified_base (357)..(357): a, c, t, g, unknown or other
  misc_feature (357)..(357): n is a, c, g, or t
tcagacgcgatcgacacgaccggtgctcgatttagatcgtctgtgttgggtttgggggcaggagtcagacccactcaggacacagcatggacatgagggtccccgctcagctcctggggctcctgctgctctggcctcccaggtgccagatgtgccatccagatgacccagtctccattcctccctgtctgcatctgtaggagacagagttaccataactgccggnaagtcaggatatagaatgagtggctggtatcagcagagaccgaggggacacccccaatcctagtctatggtcgcttccgaggttacgaaaggtcgggtaccatcgaaggttcaggtggcggtgtcgtgcanagtactcactctcactatcgacgcccgtctcgaccgtacgacccgtaaagttactttcgacctaactttattaccgtggttaactactaaagtactttacaacgttaccgtcgaactacgttaccggaccgtaaacggggacctaaaggtccttagggaaacgttactaaaccgaaacgttaaccgttggttacgggtaacctaggtaaccaaccgtcttcccgtttcgttccgttaacc

SEQ ID NO: 311132 - DNA, 558 bp, Homo sapiens
  misc_feature: GZ8MTXP01CCTOY.45.34.D01.1.454.CMB.2.raw
  modified_base (178)..(178): a, c, t, g, unknown or other
  misc_feature (178)..(178): n is a, c, g, or t
  modified_base (368)..(368): a, c, t, g, unknown or other
  misc_feature (368)..(368): n is a, c, g, or t
  modified_base (393)..(393): a, c, t, g, unknown or other
  misc_feature (393)..(393): n is a, c, g, or t
  modified_base (452)..(452): a, c, t, g, unknown or other
  misc_feature (452)..(452): n is a, c, g, or t
tcagacgcgatcgacacgaccggtgctcgatttagatcgtctgtgttgggtttggggaggagtcagacccactcaggacacagcatggacatgagggtccccgctcagctcctggggctcctgctgctctggctcccaggtgccagatgtgccatccagatgacccagtctccattcnccctgtctgcatctgtaggagacagagttaccataacttgccggcaagtcaggatatagaaatgagttaggctggatcagcagagaccgaggggacacccccaatcctagtctagtcggtgtcttaccgaaggttacaaaggttggggtacccagtacaaggttccaggtggcggtggtctgggaccaanagaattcactctacacatcacgccnctgcagacccgatatttcgactaaacttatactgttacaactaatacttcaaatcccgngaacagttcggacaaagggaccaaggcttagaacgtacttacgaaaacgtacgttgttcggcttaacggacctaacctaacgttcgttacgttaaccttccgtaac

SEQ ID NO: 311133 - DNA, 601 bp, Homo sapiens
  misc_feature: GZ8MTXP01CD3DZ.45.34.D01.1.454.CMB.2.raw
  modified_base (250)..(250): a, c, t, g, unknown or other
  misc_feature (250)..(250): n is a, c, g, or t
  modified_base (275)..(275): a, c, t, g, unknown or other
  misc_feature (275)..(275): n is a, c, g, or t
  modified_base (281)..(281): a, c, t, g, unknown or other
  misc_feature (281)..(281): n is a, c, g, or t
  modified_base (286)..(286): a, c, t, g, unknown or other
  misc_feature (286)..(286): n is a, c, g, or t
  modified_base (320)..(320): a, c, t, g, unknown or other
  misc_feature (320)..(320): n is a, c, g, or t
  modified_base (380)..(380): a, c, t, g, unknown or other
  misc_feature (380)..(380): n is a, c, g, or t
  modified_base (575)..(575): a, c, t, g, unknown or other
  misc_feature (575)..(575): n is a, c, g, or t
  modified_base (588)..(588): a, c, t, g, unknown or other
  misc_feature (588)..(588): n is a, c, g, or t
tcagacgcgatcgacacgaccggtgctcgatttagatcgtctgtgttgggtttgggggcaggagtcagacccactcaggacacagcatggacatgacgggtccccgctcagctccgtggggctcctgctgctctggcctcccaggtgccagatgtcgccatccagatcgacccagtcctcctacttcctccctgtctgctatcgtaggtaggagacagtacgttaaccattaacgtcggccggataagtnaaggtatagtaagaatgtacgtagntagtancgagngagacgaccggacgggacccacccctatctagtntagtcgtctctacgtagtaacgaggtcggaccagtacgtacgtgaggtgggcggtggacncgcatacgtactccacttccacacctactcgaccgcccgcgtacgacgtacgtaccgtaagtttacttacaacttaactttctacgttactaacgttaataacttacttaactacccgttccgacgtaacctcgtacccggaacgtaacgactaagtcttaggaacttacgtaaaccgacgttgttgggactcgntaacctaccgttnttcctcgttcctc

SEQ ID NO: 311134 - DNA, 588 bp, Homo sapiens
  misc_feature: GZ8MTXP01BH6FF.45.34.D01.1.454.CMB.2.raw
  modified_base (354)..(354): a, c, t, g, unknown or other
  misc_feature (354)..(354): n is a, c, g, or t
  modified_base (374)..(374): a, c, t, g, unknown or other
  misc_feature (374)..(374): n is a, c, g, or t
  modified_base (505)..(505): a, c, t, g, unknown or other
  misc_feature (505)..(505): n is a, c, g, or t
  modified_base (566)..(566): a, c, t, g, unknown or other
  misc_feature (566)..(566): n is a, c, g, or t
tcagacgcgatcgacacgaccggtgctcgatttagatcgtctgtgttgggtttgggggagacttggtccatccgggggggtccctgagactctcctgtacagcctctggactcaccttgagcaattattggatgacctgggtccgccaggctccgagggaaggggctggagtgggtggccaacataaagcaaagatggggagtcgaaaagaactatgtggactctgtgaagggtcgttcaccatctccagagacaatgccaaagattcagttctttttggaaatggacagtctgagatccgaagatacggcagtatattactgcgcgagagatgatagtcctaagtgggggtanagacatcgtggtttgatcgntttcgagtggtgtcggggccacggggactaaacggtcaccgtctcttcacgccctacccaccgaacgggccccagttccggtcccttcccccgtggccgcccgtgcctccgaggcgccaccgtccgagacnccacgacggccggcccttggggccttcggaccctggttacgaacgggttcctcgttacccncgctccgactcgttggaacggg

SEQ ID NO: 311135 - DNA, 653 bp, Homo sapiens
  misc_feature: GZ8MTXP01BE7TO.45.34.D01.1.454.CMB.2.raw
  modified_base (218)..(218): a, c, t, g, unknown or other
  misc_feature (218)..(218): n is a, c, g, or t
  modified_base (291)..(291): a, c, t, g, unknown or other
  misc_feature (291)..(291): n is a, c, g, or t
  modified_base (368)..(368): a, c, t, g, unknown or other
  misc_feature (368)..(368): n is a, c, g, or t
  modified_base (569)..(569): a, c, t, g, unknown or other
  misc_feature (569)..(569): n is a, c, g, or t
tcagacgcgatcgacacgaccggtgctcgatttagatcgtctgtgttgggtttgaggtctcagagaggagccttagccctggactccaaggcctttccacttggtgaccagcactgagcacagaggactcaccatggaattggggctgagctgggctttccttgttgcttatttagaaggtgtcaatgtgagatgaaagtggtggagtcgtggggganacgttggtccaggtccgggggggtcctggacgactctcctgtacagcctcgtggactcaccttgagctaattntggatgaccgtgggtccgcgaggctacgagggggaagggcgtgggagtgggtcggaccaaacagtaaagcaagaggngggagtacgaaaagtaactagtagtggaactcggtaggttggaaacggggttcggttacaccctatccctacgaaggacaacaagtcggaccaaaggttacttagtacttacgtttttaaggaaagttcgggggaactaggttcctaggggaatacgtaaccggaagtaagtaccgggtactaagtacttaacgttaacgnggacggacgagaaagtgttagttaacgttagttaaccggtaaaggggtaagggggttagacggttacgttaagttcgtttaagg

SEQ ID NO: 311136 - DNA, 585 bp, Homo sapiens
  misc_feature: GZ8MTXP01E0K88.45.34.D01.1.454.CMB.2.raw
  modified_base (201)..(201): a, c, t, g, unknown or other
  misc_feature (201)..(201): n is a, c, g, or t
  modified_base (227)..(227): a, c, t, g, unknown or other
  misc_feature (227)..(227): n is a, c, g, or t
  modified_base (231)..(231): a, c, t, g, unknown or other
  misc_feature (231)..(231): n is a, c, g, or t
  modified_base (254)..(255): a, c, t, g, unknown or other
  misc_feature (254)..(255): n is a, c, g, or t
  modified_base (278)..(278): a, c, t, g, unknown or other
  misc_feature (278)..(278): n is a, c, g, or t
  modified_base (395)..(395): a, c, t, g, unknown or other
  misc_feature (395)..(395): n is a, c, g, or t
  modified_base (528)..(528): a, c, t, g, unknown or other
  misc_feature (528)..(528): n is a, c, g, or t
tcagacgcgatcgacacgaccggtgctcgatttagatcgtctgtgttgggtttgggggagtcagacccactcaggacacagcatggacatgagggtccccgctcagctcctggggctcctgctgctctggctcccaggtgccagatgtgccatccagatcgacccagtcctccattcctccctgtctgcatctagtagganacagtacttaccataactggccgganagtnagattatagaatgagtgctgtannagcagacgaccggaggggacccnccccctatccgtagtctagtgcgtctacgtaggtaactaaggtcgggtacctagtacgtaggtcacgggtcgggtacgggtcggtcgcgaacaacgtaagtactcactctaccgacnctacgacgcgctaagtcgacacgtaccgaaattactttacgactactttactacgtataccttaactaaacgttacttacctaccttacccgttcgaccgtaacgtcccgaacggaaccggacgaacgtctanaacgtacaacgaaacgtccttaggcttcgctccaactactcgttactcttaactccc

SEQ ID NO: 311137 - DNA, 664 bp, Homo sapiens
  misc_feature: GZ8MTXP01DMYYQ.45.34.D01.1.454.CMB.2.raw
  modified_base (121)..(121): a, c, t, g, unknown or other
  misc_feature (121)..(121): n is a, c, g, or t
  modified_base (249)..(249): a, c, t, g, unknown or other
  misc_feature (249)..(249): n is a, c, g, or t
  modified_base (318)..(318): a, c, t, g, unknown or other
  misc_feature (318)..(318): n is a, c, g, or t
  modified_base (349)..(349): a, c, t, g, unknown or other
  misc_feature (349)..(349): n is a, c, g, or t
  modified_base (364)..(364): a, c, t, g, unknown or other
  misc_feature (364)..(364): n is a, c, g, or t
tcagacgcgatcgacacgaccggtgctcgatttagatcgtctgtgttgggtttgggggagacttggtccatccgggggggtccctgagactctcctgtacagcctctggactcaccttgancaattattggatgacctgggtccgccaggctccgagggaaggggctggagtgggtggccaacataaagcaagatggggagtcgaaaagaactatgtggactctgtgaaggtcgttcacatctccaganacatgcaagattcagttcttttaggaaatggacagtctgagataccgaagatacggcagtatacttacngcgagagagatgatacgtctaagtggggtanagacattgtggtttnatcgtctttcgatggtcgggtcggggacccgacgggacgtaaaccggtcctaaccgttcttcttaccgctcccgtacccgaaccggaacggtcccctagttccccggtcccctttcccccgtcgggccccggtccccgtcggacccttacccgagggacccgaccgtaccccgttaccggacgaccgaccgaaccggaccggcccgggtcccgttggggtacccttgggacccgtggggttaccacggttaccctttaaccgttcctccggtacttccgggcgttaacgcggtaaccggg

SEQ ID NO: 311138 - DNA, 593 bp, Homo sapiens
  misc_feature: GZ8MTXP01AXYL1.45.34.D01.1.454.CMB.2.raw
  modified_base (200)..(200): a, c, t, g, unknown or other
  misc_feature (200)..(200): n is a, c, g, or t
  modified_base (224)..(224): a, c, t, g, unknown or other
  misc_feature (224)..(224): n is a, c, g, or t
  modified_base (249)..(249): a, c, t, g, unknown or other
  misc_feature (249)..(249): n is a, c, g, or t
  modified_base (275)..(275): a, c, t, g, unknown or other
  misc_feature (275)..(275): n is a, c, g, or t
  modified_base (418)..(418): a, c, t, g, unknown or other
  misc_feature (418)..(418): n is a, c, g, or t
  modified_base (446)..(446): a, c, t, g, unknown or other
  misc_feature (446)..(446): n is a, c, g, or t
  modified_base (573)..(573): a, c, t, g, unknown or other
  misc_feature (573)..(573): n is a, c, g, or t
tcagacgcgatcgacacgaccggtgctcgatttagatcgtctgtgttgggtttgggggcaggagtcagacccactcaggacacagcatggacatgagggtccccgctcagctcctggggctcctgctgctctggctccaggtgccagatgtgccatccagatgacccagtctccattctccctgtctgcatctgtagganacagagttaccataactgccgganaagtcagatatagaaatgagtagcnggtatcagcagagaccgagggggacncccccaatccagtctatcggtgcttccgagttaacaaagtcgggtaccagtacgaaacggttcaggtcggcgggtggtaccgtgggcaacgagtaatcactctacaaccatcacgccgtcctagacgaacgtacccgaaagtnttttacgactaaacctttaattaccggngttaactacgtaataacttttacaaactttacccgtaccggtaagtacgttaccgggaccaaaggggaccctaaagggcctttaaggaattacgtaacaaaacgttacgttcggttagaacccgtanaaccactacttctcgttctc

SEQ ID NO: 311139 - DNA, 635 bp, Homo sapiens
  misc_feature: GZ8MTXP01BK6ZC.45.34.D01.1.454.CMB.2.raw
  modified_base (263)..(263): a, c, t, g, unknown or other
  misc_feature (263)..(263): n is a, c, g, or t
  modified_base (459)..(459): a, c, t, g, unknown or other
  misc_feature (459)..(459): n is a, c, g, or t
  modified_base (610)..(610): a, c, t, g, unknown or other
  misc_feature (610)..(610): n is a, c, g, or t
tcagacgcgatcgacacgaccggtgctcgatttagatcgtctgtgttgggtttggggagagaggagccttagccctggactccaaggcctttccacttggtgaccagcactgagcacagaggactcaccatggaattggggctgagctgggtcttttccttgttgcttattttagaaggtgtcaatgtgagatgaaagtggtggagtcggtggggagtacgttggtccaggtccggggggtccctgacgtactctcctgtacncgtcctctggactcaccttgagctaaattatggatcgaccgtgggtccgcgaggcctaccgagggggaaggcgtggaggtggggtcggaccaaacgaagtaaacggcaaaggagtgggacgtaacgaaaagtactagtgtacggtaactcgtggtaggtaacgggttcgttacgacctgtcctacagagaaactancgaacaaagtaacttcgagttttacgtttaggaaagtgacgtaacgtgtaggtagtcgttaacggaagtaaggtacgaacgtaagttaattacgttacgtggacggtaacgaagagtagttagtagtacgttacgttagggttggggtaancgaatacgtgttagtgttaagttcg

SEQ ID NO: 311140 - DNA, 521 bp, Homo sapiens
  misc_feature: GZ8MTXP02I007P.45.34.D01.1.454.CMB.2.raw
  modified_base (222)..(222): a, c, t, g, unknown or other
  misc_feature (222)..(222): n is a, c, g, or t
  modified_base (276)..(276): a, c, t, g, unknown or other
  misc_feature (276)..(276): n is a, c, g, or t
  modified_base (353)..(353): a, c, t, g, unknown or other
  misc_feature (353)..(353): n is a, c, g, or t
tcagacgcgatcgacacgaccggtgctcgatttagatcgtctgtgttgggtttgggggagtcagacccactcaggacacagcatggacatgagggtccccgctcagctcctggggctcctgctgctctggctcccaggtgccagatgtgccatccagatgacccagtctccattctccctgtctgcatctgtaggagacagagttaccataacttggccggnaagtcaggatatagaaatgagttaggctggtatcagcagagaccgagggggacncccccaatcctagtctatggtgcttcaggttacaaagtggggtcccatcaaggttcaggtggcggtgggtctggcanagaattcactctcacatcagccgctgcacgcccgaaagtctttgactaacttattactgtactacaagtatttacaacttaccctacgactacgttccggacaacgggaccaagcttacgagatacaaacgtacgtgacggctacgcaccatctgtcttcactttccc

SEQ ID NO: 311141 - DNA, 540 bp, Homo sapiens
  misc_feature: GZ8MTXP02J2GFH.45.34.D01.1.454.CMB.2.raw
  modified_base (214)..(214): a, c, t, g, unknown or other
  misc_feature (214)..(214): n is a, c, g, or t
  modified_base (299)..(299): a, c, t, g, unknown or other
  misc_feature (299)..(299): n is a, c, g, or t
  modified_base (447)..(447): a, c, t, g, unknown or other
  misc_feature (447)..(447): n is a, c, g, or t
  modified_base (465)..(465): a, c, t, g, unknown or other
  misc_feature (465)..(465): n is a, c, g, or t
  modified_base (476)..(476): a, c, t, g, unknown or other
  misc_feature (476)..(476): n is a, c, g, or t
tcagacgcgatcgacacgaccggtgctcgatttagatcgtctgtgttgggtttggggagagaggagccttagccctggactccaaggcctttccacttggtgaccagcactgagcacagaggactcaccatggaattggggctgagctgggctttccttgttgctattttagaaggtgtccaatgtgagatgaaagtggtggagtctggggganacttggtccagtccggggggtccctgagactctcctgtacagcctctggactcaccttgagcaattattggatgacctgggtccnccaggctccgaggggaaggactggagtgggtggccaaacataaaagcaaagatggggatccgaaaagactatgtggactctgtgaagggtcgtcaccatctccagagacaatgaccaaagattcagttcttttaggaaatggacagtngagatacgaagagacganagtatattacngcgacgagagagtagagtacgtacgtaaggtaggggtaagacgacgtatcgttggttagagtcg

SEQ ID NO: 311142 - DNA, 545 bp, Homo sapiens
  misc_feature: GZ8MTXP02F3TJL.45.34.D01.1.454.CMB.2.raw
  modified_base (280)..(280): a, c, t, g, unknown or other
  misc_feature (280)..(280): n is a, c, g, or t
tcagacgcgatcgacacgaccggtgctcgatttagatcgtctgtgttgggtttgggggcaggagtcagacccactcaggacacagcatggacatgagggtccccgctcagctcctggggctcctgctgctctggctcccaggtgccagatgtgccatccagatgacccagtctccattctccctgtctgcatctgtaggagacagagttaccataacttgccgggcaagtcaggatattagaaatgagttaggctggtatcagcagagaccagggggacnccccccaatcctagtctatggtgcttccaggttacaaagtggggtcccatcaaggttcagtggcggtgggtctggcacagaattcactctcaccatcagcccgctgcagcccgaaagtattttgactaacttattacctgtactacaagtactttacaaacttacccctggactagttccggaccaaaggggaccaaagtcttagacgtaactacgaaaacgtaactcggtaggcctaggacctacccattcttcgttctttacc

SEQ ID NO: 311143 - DNA, 557 bp, Homo sapiens
  misc_feature: GZ8MTXP02JLVCI.45.34.D01.1.454.CMB.2.raw
  modified_base (302)..(302): a, c, t, g, unknown or other
  misc_feature (302)..(302): n is a, c, g, or t
  modified_base (377)..(377): a, c, t, g, unknown or other
  misc_feature (377)..(377): n is a, c, g, or t
  modified_base (384)..(384): a, c, t, g, unknown or other
  misc_feature (384)..(384): n is a, c, g, or t
  modified_base (400)..(400): a, c, t, g, unknown or other
  misc_feature (400)..(400): n is a, c, g, or t
tcagacgcgatcgacacgaccggtgctcgatttagatcgtctgtgttgggtttggggaggagtcagacccactcaggacacagcatggacatgagggtccccgctcagctcctggggctcctgctgctctggctcccaggtgccagatgtgccatccagatgacccagtctccattctccctgtctgcatctgtaggagacagagttaccataacttgccgggcaagtcaggatattagaaatgagttaggctggtatcagcagagaccgaggggaccacccccaactcctagtctatggtncttccagggttacaaggtcgggtccatcaaggttccaggtgggcggtgggtctggcacgagaattcactctcacntcagccnctgcagaccctaagtnttttgacttaaacttatttactgttactaaactaagtacttttacaaactttaccccgtacggaactacgttccggaccgaaagggacccaaagtccttagaacgtaactaccaaaacgtacgtggtcggactgaccaacctatctcgttctactac

SEQ ID NO: 311144 - DNA, 549 bp, Homo sapiens
  misc_feature: GZ8MTXP02FPVD9.45.34.D01.1.454.CMB.2.raw
  modified_base (152)..(152): a, c, t, g, unknown or other
  misc_feature (152)..(152): n is a, c, g, or t
  modified_base (334)..(334): a, c, t, g, unknown or other
  misc_feature (334)..(334): n is a, c, g, or t
tcagacgcgatcgacacgaccggtgctcgatttagatcgtctgtgttgggtttggggagagaggagccttagccctggactccaaggcctttccacttggtgaccagcactgagcacagaggactcaccatggaattggggctgagcgtggngttcctagtgctatttagagtgtcaatgtgagatgaaagtggtggagtctgggggagacttggtccatccgggggggtccctgagactctcctgtacagcctctggactcaccttgagcaattattggatgacctgggtccgccaggctccagggaaggggctggagtgggtggcccaaaanataaagcaaagagtagggagtaccgaaaagaactagtgtaggacttgtgtaggaagggtcgttacacatctacagagacaatagacaagaatactagttagttttagtaaagtagtagtagtcgtagagagtacgaagagtacgacgtagtatattagtgcgacgagagagtagagtacgtacgtaagtagggtaagagacgatgtgttgtagtg

SEQ ID NO: 311145 - DNA, 542 bp, Homo sapiens
  misc_feature: GZ8MTXP02IBBV8.45.34.D01.1.454.CMB.2.raw
  modified_base (277)..(277): a, c, t, g, unknown or other
  misc_feature (277)..(277): n is a, c, g, or t
  modified_base (355)..(355): a, c, t, g, unknown or other
  misc_feature (355)..(355): n is a, c, g, or t
  modified_base (372)..(372): a, c, t, g, unknown or other
  misc_feature (372)..(372): n is a, c, g, or t
  modified_base (381)..(381): a, c, t, g, unknown or other
  misc_feature (381)..(381): n is a, c, g, or t
tcagacgcgatcgacacgaccggtgctcgatttagatcgtctgtgttgggtttggggaggagtcagacccactcaggacacagcatggacatgagggtccccgctcagctcctggggctcctgatgctctggctcccaggtgccagatgtgccatccagatgacccagtctccattctccctgtctgcatctgtaggagacagagttaccataacttgccgggcaagtcaggatattagaaatgagttaggctggtatcagcagagaccaggggacncccccaaatcctagtctatggtgcttccaggttacaaagtgggtcccatcaaggttccagtggcgtggggtctggcanagaattcactctcacancagccgtcncgcacgaccgacgtattacgtactacttacttacttagttactactaagtacttactaacttacctacgtactacgtacgtacgaacggaacgaacgtacgtagtagaactaacgaaacgaacgtacgtacgacgtcgacactactactcgttcttactac

SEQ ID NO: 311146 - DNA, 517 bp, Homo sapiens
  misc_feature: GZ8MTXP02H9TO4.45.34.D01.1.454.CMB.2.raw
  modified_base (355)..(355): a, c, t, g, unknown or other
  misc_feature (355)..(355): n is a, c, g, or t
  modified_base (413)..(413): a, c, t, g, unknown or other
  misc_feature (413)..(413): n is a, c, g, or t
  modified_base (445)..(445): a, c, t, g, unknown or other
  misc_feature (445)..(445): n is a, c, g, or t
  modified_base (449)..(449): a, c, t, g, unknown or other
  misc_feature (449)..(449): n is a, c, g, or t
  modified_base (460)..(460): a, c, t, g, unknown or other
  misc_feature (460)..(460): n is a, c, g, or t
  modified_base (465)..(465): a, c, t, g, unknown or other
  misc_feature (465)..(465): n is a, c, g, or t
  modified_base (469)..(469): a, c, t, g, unknown or other
  misc_feature (469)..(469): n is a, c, g, or t
  modified_base (504)..(504): a, c, t, g, unknown or other
  misc_feature (504)..(504): n is a, c, g, or t
tcagacgcgatcgacacgaccggtgctcgatttagatcgtctgtgttgggtttgggggagacttggtccatccgggggggtccctgagactctcctgtacagcctctggactcaccttgagcaattattggatgacctgggtccgccaggctccagggaaggggctggagtgggtggccaaacataaaagcaaagatgggagtcgaaagaactatgtggactctgtgaagggtcggttcaccatctccagagacaatgccaaagaattcagttctttttaggaaatggacagtctgagatccgaagatacggcagtatattactgcgcgagagatgatagtctaaagtggggtanagacatctggtttgatgctttcgattgtggtggggccacggggacaacggtcaccgtntctcagccctcacaaggcccatcgtctccccnggcnccctgctcagngcacncganagcacagcgcctgggctgcctgcaagctaacttcncgatcgctctgcg

SEQ ID NO: 311147 - DNA, 582 bp, Homo sapiens
  misc_feature: GZ8MTXP02HE0F8.45.34.D01.1.454.CMB.2.raw
  modified_base (281)..(281): a, c, t, g, unknown or other
  misc_feature (281)..(281): n is a, c, g, or t
  modified_base (378)..(378): a, c, t, g, unknown or other
  misc_feature (378)..(378): n is a, c, g, or t
tcagacgcgatcgacacgaccggtgctcgatttagatcgtctgtgttgggtttgggggcaggagtcagacccactcaggacacagcatggacatgagggtccccgctcagctcctggggctcctgctgctctggctcccaggtgccagatgtgccatccagatgacccagtctccattctccctgtctgcatctgtaggagacagagttaccataacttgccgggcaagtcaggatattagaaatgagttaggctggtatcagcagagaccgagggggacncccccaatcctagtctatggtgcttcaggttacaaagtggggtcccatcaaggtcagtggcggtggtctggcacagattcactctcaccatcagccnctgcagcccgaagtattttcgactaactttattacttgtacttaacaagtacttttaccaaactttaccctacggtacctaagtttacccgggaccgtaaaacgggggacccaaaaggtccgtttaggaacggtaaacttaccgaaaacggtaaacctggttacgggaaccttggacccaaccctatccttcggttacctttcc

SEQ ID NO: 311148 - DNA, 521 bp, Homo sapiens
  misc_feature: GZ8MTXP02HZF9Y.45.34.D01.1.454.CMB.2.raw
  modified_base (196)..(196): a, c, t, g, unknown or other
  misc_feature (196)..(196): n is a, c, g, or t
  modified_base (221)..(221): a, c, t, g, unknown or other
  misc_feature (221)..(221): n is a, c, g, or t
  modified_base (274)..(274): a, c, t, g, unknown or other
  misc_feature (274)..(274): n is a, c, g, or t
  modified_base (346)..(346): a, c, t, g, unknown or other
  misc_feature (346)..(346): n is a, c, g, or t
tcagacgcgatcgacacgaccggtgctcgatttagatcgtctgtgttgggtttggggagtcagacccactcaggacacagcatggacatgagggtccccgctcagctcctggggctcctgctgctctggctcccaggtgccagatgtgccatccagatgacccagtctccattctccctgtctgcatctgtagganacagagttaccataacttgccgggnaagtcaggatatagaaatgagttaggctggtatcagcagagaccagggggacnccccccaatcctagtctatggtgcttcaggttacaaagtgggtccatcaaggtcagtggcgtggctggcacngaattcactctcaccatccagccgctcgcacgcccgaacgtatttagtacaacttattactatactactaataattactaactacctacgtacactacgtacgaacggaacgaacgacgttacgagactacaaacgaacgtacgtagtacgcgcgacactctctcttctacttcc

SEQ ID NO: 311149 - DNA, 532 bp, Homo sapiens
  misc_feature: GZ8MTXP02IZ8D4.45.34.D01.1.454.CMB.2.raw
  modified_base (200)..(200): a, c, t, g, unknown or other
  misc_feature (200)..(200): n is a, c, g, or t
  modified_base (225)..(225): a, c, t, g, unknown or other
  misc_feature (225)..(225): n is a, c, g, or t
  modified_base (279)..(279): a, c, t, g, unknown or other
  misc_feature (279)..(279): n is a, c, g, or t
  modified_base (526)..(526): a, c, t, g, unknown or other
  misc_feature (526)..(526): n is a, c, g, or t
tcagacgcgatcgacacgaccggtgctcgatttagatcgtctgtgttgggtttggggcaggagtcagacccactcaggacacagcatggacatgagggtccccgctcagctcctggggctcctgctgctctggctcccaggtgccagatgtgccatccagatgacccagtctccattctccctgtctgcatctgtagganacagagttaccataacttgccgggnaagtcaggatattagaaatgagttaggctggtatcagcagagaccgaggggacncccccaatcctagtctatggtgcttcgaggttacaaagtggggtcccagtcaaggttcagtggcggtggtctggcacagaattcactctacaccatcagcccgctgcagcccgaatatttgactaacttattactgtactactaagtatttacaaacttaccctacggactacgttcggaccgaaaaggggaccctaaagtcgttaggaacacttacaaaacgtaactgtacggctgacacatcgtntacttc

SEQ ID NO: 311150 - DNA, 577 bp, Homo sapiens
  misc_feature: GZ8MTXP02F3S2Z.45.34.D01.1.454.CMB.2.raw
  modified_base (301)..(301): a, c, t, g, unknown or other
  misc_feature (301)..(301): n is a, c, g, or t
  modified_base (571)..(571): a, c, t, g, unknown or other
  misc_feature (571)..(571): n is a, c, g, or t
tcagacgcgatcgacacgaccggtgctcgatttagatcgtctgtgttgggtttggggagagaggagccttagccctggactccaaggcctttccacttggtgaccagcactgagcacagaggactcaccatggaattggggctgagcgtgggctttcctgttgctattttagaaggtgtccaatgtgagatgaaagtggtggagtcgtgggggagacttggtccagtccgggggggtccctgagactctcctgtacagcctctggactcaccttgagcaattattggatgacctgggtccnccaggctccgaggggaaggggctgggagtgggtggccaaacataaagcaaagatgggagtaccgaaaagactagtgtggactgtggtggaaggggttcggttcaccgtatctaccagagacaagtcgacaaagtaattcagtttcgttttaggaaattggtaactagtctagagtagtaccgaaagagtacggatagttaatattactgacacggagagtatggaactagttaccgtaaggttaggggaagaggactagtgtttaggtancgtttg

SEQ ID NO: 311151 - DNA, 529 bp, Homo sapiens
  misc_feature: GZ8MTXP02JU9V4.45.34.D01.1.454.CMB.2.raw
  modified_base (280)..(280): a, c, t, g, unknown or other
  misc_feature (280)..(280): n is a, c, g, or t
  modified_base (302)..(302): a, c, t, g, unknown or other
  misc_feature (302)..(302): n is a, c, g, or t
  modified_base (377)..(377): a, c, t, g, unknown or other
  misc_feature (377)..(377): n is a, c, g, or t
tcagacgcgatcgacacgaccggtgctcgatttagatcgtctgtgttgggtttggggcaggagtcagacccactcaggacacagcatggacatgagggtccccgctcagctcctggggctcctgctgctctggctcccaggtgccagatgtgccatccagatgacccagtctccattctccctgtctgcatctgtaggagacagagttaccataacttgccgggcaagtcaggatattagaaatgagttaggctggtatcagcagagaccgagggggacncccccaatcctagtctatggtncttccaggttacaaagtggggtccatcaaggttcagtggcggtggtctggcacagattcactctcacatcagccnctgcacgcccgaagtatttgactaacttatactagtcttacaagtactttacaaacttacccctggactattccgggaccaaaggggacccaagccttagaacgactacaaaacggtaactggtaggcctgacacctatccttgtactttcc

SEQ ID NO: 311152 - DNA, 531 bp, Homo sapiens
  misc_feature: GZ8MTXP02HQ8GM.45.34.D01.1.454.CMB.2.raw
  modified_base (299)..(299): a, c, t, g, unknown or other
  misc_feature (299)..(299): n is a, c, g, or t
tcagacgcgatcgacacgaccggtgctcgatttagatcgtctgtgttgggtttggggagagaggagccttagccctggactccaaggcctttccacttggtgaccagcactgagcacagaggactcaccatggaattggggctgagctgggctttccttgttgctattttagaaggtgtccaatgtgagatgaaagtggtggagtctgggggagacttggtccagtccgggggggtccctgagactctcctgtacagcctctggactcaccttgagcaattatggatgacctgggtccncaggctccaggggaaggggctggagtgggtggccaacataaagcaaagatggggagtcgaaaagactatgtgactctgtgaagggtcggttcaccatctccagagacaatgaccaagaattcagttacttttggaaatggacagtctgagatacgaagatacggcagtatattactgcgacgagagatagatagtacgtaagtgggggtaagagactatcgtggtttgattg

SEQ ID NO: 311153 - DNA, 516 bp, Homo sapiens
  misc_feature: GZ8MTXP02JCUMQ.45.34.D01.1.454.CMB.2.raw
  modified_base (277)..(277): a, c, t, g, unknown or other
  misc_feature (277)..(277): n is a, c, g, or t
  modified_base (301)..(301): a, c, t, g, unknown or other
  misc_feature (301)..(301): n is a, c, g, or t
  modified_base (351)..(351): a, c, t, g, unknown or other
  misc_feature (351)..(351): n is a, c, g, or t
  modified_base (435)..(435): a, c, t, g, unknown or other
  misc_feature (435)..(435): n is a, c, g, or t
  modified_base (471)..(471): a, c, t, g, unknown or other
  misc_feature (471)..(471): n is a, c, g, or t
tcagacgcgatcgacacgaccggtgctcgatttagatcgtctgtgttgggtttgggggagtcagacccactcaggacacagcatggacatgagggtccccgctcagctcctggggctcctgctgctctggctcccaggtgccagatgtgccatccagatgacccagtctccattctccctgtctgcatctgtaggagacagagttaccataacttgccgggcaagtcaggatattagaaatgagttaggctggtatcagcagagaccgagggggacnccccccaatccctagtctatggtncttccagttacaagtgggtcccatcaggttcagtggcgtggtctggcacngaattcactctcaccatcacgccgcctgcagcccgaagcttttgctaacttatactgtctacaagtatttacaactttacccgngactagttacggaccaaggggtaccaaggcttaganagtacaaaacgactgtacggctagcactactctgtctcatttccc

SEQ ID NO: 311154 - DNA, 527 bp, Homo sapiens
  misc_feature: GZ8MTXP02J16Z1.45.34.D01.1.454.CMB.2.raw
  modified_base (222)..(222): a, c, t, g, unknown or other
  misc_feature (222)..(222): n is a, c, g, or t
  modified_base (275)..(275): a, c, t, g, unknown or other
  misc_feature (275)..(275): n is a, c, g, or t
  modified_base (354)..(354): a, c, t, g, unknown or other
  misc_feature (354)..(354): n is a, c, g, or t
  modified_base (394)..(394): a, c, t, g, unknown or other
  misc_feature (394)..(394): n is a, c, g, or t
  modified_base (423)..(423): a, c, t, g, unknown or other
  misc_feature (423)..(423): n is a, c, g, or t
  modified_base (518)..(518): a, c, t, g, unknown or other
  misc_feature (518)..(518): n is a, c, g, or t
tcagacgcgatcgacacgaccggtgctcgatttagatcgtctgtgttgggtttgggggagtcagacccactcaggacacagcatggacatgagggtccccgctcagctcctggggctcctgctgctctggctcccaggtgccagatgtgccatccagatgacccagtctccattctccctgtctgcatctgtaggagacagagttaccataacttgccgggnaagtcaggatattagaaatgagttagctggtatcagcagagaccagggggacnccccccaatcctagtctatggtgcttcaggttacaaagtcggggtcccatcaaggttcagtggcggtgggtctggcacngaattcactctcaccatcagcccgctgcacgcccgaagtntttgactaacttatactgtactacaagtntttacaactttaccctggactagttccggaccaaggggacccaaaggcttaggaagactacgaaaacgtactgtacggctagccaccatccgttntctcactcc

SEQ ID NO: 311155 - DNA, 543 bp, Homo sapiens
  misc_feature: GZ8MTXP02GCXR9.45.34.D01.1.454.CMB.2.raw
  modified_base (224)..(224): a, c, t, g, unknown or other
  misc_feature (224)..(224): n is a, c, g, or t
  modified_base (277)..(277): a, c, t, g, unknown or other
  misc_feature (277)..(277): n is a, c, g, or t
  modified_base (300)..(300): a, c, t, g, unknown or other
  misc_feature (300)..(300): n is a, c, g, or t
  modified_base (380)..(380): a, c, t, g, unknown or other
  misc_feature (380)..(380): n is a, c, g, or t
tcagacgcgatcgacacgaccggtgctcgatttagatcgtctgtgttgggtttggggaggagtcagacccactcaggacacagcatggacatgagggtccccgctcagctcctggggctcctgctgctctggctcccaggtgccagatgtgccatccagatgacccagtctccattcctccctgtctgcatctgtaggagacagagttaccataacttgccggnaagtcaggatatagaaatgagttaggctggtatcagcagagaccgaggggacnccccccaatcctagtctatggtncttccaggttacaaaggtcggggtaccatcgtaaggtccaggtgggcggtgggtctggcacgagtaattcactctcaccntcagcccgctgcacgcccgaagtattttacgactaaactttattactcgtactactaagtatttaccaacttacccgaggtactagttccggaccaagggaccaagtcttaggagtactacaaacgtactgtagctggactaccattcgtacttccttatacc

SEQ ID NO: 311156 - DNA, 667 bp, Homo sapiens
  misc_feature: GZ8MTXP02IAQLT.45.34.D01.1.454.CMB.2.raw
  modified_base (282)..(282): a, c, t, g, unknown or other
  misc_feature (282)..(282): n is a, c, g, or t
tcagacgcgatcgacacgaccggtgctcgatttagatcgtctgtgttgggtttgggggcaggagtcagacccactcaggacacagcatggacatgagggtccccgctcagctcctggggctcctgctgctctggctcccaggtgccagatgtgccatccagatgacccagtctccattctcctgtctgcatctgtaggagacagtagttaccaattaacgttggccgggacaagtcaggatattagaaatgagtgctggtatcagcagagaccgaggggacncccccaatccagtctatggtgtccttaccgaggttaacaaaggtcggggtaccccagtacgaaggttcaggttgggccgggttggggtccgttgggccaacgtaagtaactttccaactcctacaacccactcgacgcccgtacctcggaccaacggacccgtaaagttacgtttcgaccttaaactttaacttactttacggtactttaaactaaacgttactttaactaaccgtttaacccgtacggtactaacgtttaccgggaaccgtaaaacgggggaaccctaacggtacgtttaggaaagtaaacgtaacgtaaaaacgaaccgtttagggacgtccgtacgaaccgtaccctaagttcctaacggtttcctttaccg

SEQ ID NO: 311157 - DNA, 518 bp, Homo sapiens
  misc_feature: GZ8MTXP02HBXKH.45.34.D01.1.454.CMB.2.raw
  modified_base (224)..(224): a, c, t, g, unknown or other
  misc_feature (224)..(224): n is a, c, g, or t
  modified_base (272)..(272): a, c, t, g, unknown or other
  misc_feature (272)..(272): n is a, c, g, or t
  modified_base (293)..(293): a, c, t, g, unknown or other
  misc_feature (293)..(293): n is a, c, g, or t
  modified_base (347)..(347): a, c, t, g, unknown or other
  misc_feature (347)..(347): n is a, c, g, or t
  modified_base (415)..(415): a, c, t, g, unknown or other
  misc_feature (415)..(415): n is a, c, g, or t
  modified_base (439)..(439): a, c, t, g, unknown or other
  misc_feature (439)..(439): n is a, c, g, or t
  modified_base (508)..(508): a, c, t, g, unknown or other
  misc_feature (508)..(508): n is a, c, g, or t
tcagacgcgatcgacacgaccggtgctcgatttagatcgtctgtgttgggtttgggggcaggagtcagacccactcaggacacagcatggacatgagggtccccactcagctcctggggctcctgctgctctggctcccaggtgccagatgtgccatccagatgacccagtctccattctcctgtctgcatctgtaggagacagagttaccataacttgccggnaagtcagatatagaatgagtagctggtatcagcagagacgaggggacncccccaatccagtctatggtncttcaggttacaaaggtgggtccatcaacggttcagtggcggtgggtctggcanagattcactctcacatcacgccgctgcagcccgaagtatttcgactaaactttattactgtacttaanaagttactttacaaactttacccnggaactacgttaccggaccaaacggggacctaaagcttaggaacatacaaacgactgagctagccaacntctcgtactc

SEQ ID NO: 311158 - DNA, 569 bp, Homo sapiens
  misc_feature: GZ8MTXP02FWTND.45.34.D01.1.454.CMB.2.raw
  modified_base (273)..(273): a, c, t, g, unknown or other
  misc_feature (273)..(273): n is a, c, g, or t
  modified_base (292)..(292): a, c, t, g, unknown or other
  misc_feature (292)..(292): n is a, c, g, or t
  modified_base (297)..(297): a, c, t, g, unknown or other
  misc_feature (297)..(297): n is a, c, g, or t
  modified_base (307)..(308): a, c, t, g, unknown or other
  misc_feature (307)..(308): n is a, c, g, or t
  modified_base (316)..(316): a, c, t, g, unknown or other
  misc_feature (316)..(316): n is a, c, g, or t
  modified_base (322)..(322): a, c, t, g, unknown or other
  misc_feature (322)..(322): n is a, c, g, or t
  modified_base (329)..(329): a, c, t, g, unknown or other
  misc_feature (329)..(329): n is a, c, g, or t
  modified_base (397)..(397): a, c, t, g, unknown or other
  misc_feature (397)..(397): n is a, c, g, or t
  modified_base (410)..(410): a, c, t, g, unknown or other
  misc_feature (410)..(410): n is a, c, g, or t
tcagacgcgatcgacacgaccggtgctcgatttagatcgtctgtgttgggtttggggagagaggagccttagccctggactccaaggcctttccacttggtgaccagcactgagcacagaggactcaccatggaattggggctgagcgtgggctttcctgttgctattttagaagtgtccaatgtgagatgaaagtggtggagtctgggggagacttggtccatccgggggggtcctgagactctcctgtacagcctctggactcaccttgancaatatgatgacgtggccncagcncgagggaggnnggagtggngacaanataaagnaagagtagggagtaacgaaaagaactagtgtagactcgtggtagaagggtcgtacaccatctacaganaacaatagacaanaatactagttacgtttagtaaagtagtacgtagtactagtagagtacgaagaagtacggacgtagtaagttaattacgtacgacgacggagaagagtagtaagtaacgtacgtaaggtaggggtaaggtaagaacgtagtacgttacggttagtagtag

SEQ ID NO: 311159 - DNA, 616 bp, Homo sapiens
  misc_feature: GZ8MTXP02IGFH3.45.34.D01.1.454.CMB.2.raw
  modified_base (225)..(225): a, c, t, g, unknown or other
  misc_feature (225)..(225): n is a, c, g, or t
  modified_base (279)..(279): a, c, t, g, unknown or other
  misc_feature (279)..(279): n is a, c, g, or t
  modified_base (424)..(424): a, c, t, g, unknown or other
  misc_feature (424)..(424): n is a, c, g, or t
tcagacgcgatcgacacgaccggtgctcgatttagatcgtctgtgttgggtttggggaggagtcagacccactcaggacacagcatggacatgagggtccccgctcagctcctggggctcctgctgctctggctcccaggtgccagatgtgccatccagatgacccagtctccattcctccctgtctgcatctgtaggagacagattaccattaacttgccgggnaagtcaggatatagaaatgagttaggctggtatcagcagagaccgaggggaccnccccccaatcctagtctatggtgcttccaggttacaaagtgggtcccatcgaaggttccagtggcggtgggtctggcacgagaattcactctcaccatcagcccgctgacacgacccgaagtattttcgactaacttattacgtnttactaactaagtatttacaaactttaccccgtacggtaactagtttaccggaccgaaacgggggaccctaaaagggtcctttaggaacggtaacttaaaccgaaaaaccggtaaacctttaggggtcgtaaccgttcggtaccccgaaaccgttaacgttcccgtttacgttccctttttaacccgtaccg

SEQ ID NO: 311160 - DNA, 529 bp, Homo sapiens
  misc_feature: GZ8MTXP02FFZS3.45.34.D01.1.454.CMB.2.raw
  modified_base (445)..(445): a, c, t, g, unknown or other
  misc_feature (445)..(445): n is a, c, g, or t
  modified_base (464)..(464): a, c, t, g, unknown or other
  misc_feature (464)..(464): n is a, c, g, or t
tcagacgcgatcgacacgaccggtgctcgatttagatcgtctgtgttgggtttggggagagaggagccttagccctggactccaaggcctttccacttggtgaccagcactgagcacagaggactcaccatggaattggggctgagcgtggcgtttcctgtgctattttagaaggtgtccaatgtgagatgaaagtggtggagtctgggggagacttggtccatccgggggggtcctgagactctcctgtacagcctctggactcaccttgagcaattattggatgacctgggtccgccaggctccaggggaaggggctggagtgggtggccaaacataaaagcaaagatggggatccgaaaagaactatgtggactctgtgaagggtcgttcaccatctccagagacaatgccaaagaatcagtctttttggaaatggacagtntgagatacgagagtacganagtatatatgcgacgagagagtagatacgtacgtaagtagggtaaggagacgatgtgttgtagtg

SEQ ID NO: 311161 - DNA, 579 bp, Homo sapiens
  misc_feature: GZ8MTXP02I26I3.45.34.D01.1.454.CMB.2.raw
  modified_base (225)..(225): a, c, t, g, unknown or other
  misc_feature (225)..(225): n is a, c, g, or t
  modified_base (279)..(279): a, c, t, g, unknown or other
  misc_feature (279)..(279): n is a, c, g, or t
tcagacgcgatcgacacgaccggtgctcgatttagatcgtctgtgttgggtttgggggcaggagtcagacccactcaggacacagcatggacatgagggtccccgctcagctcctggggctcctgctgctctggctcccaggtgccagatgtgccatccagatgacccagtctccattctccctgtctgcatctgtaggagacagagttaccataacttgccggnaagtcaggatattagaaatgagttaggctggtatcagcagagaccgaggggacncccccaatcctagtctatggtgcttccaggttacaaaggtgggtcccatcaaggttcagtggcggtggtctggcacagaattcactcacaccatcagccgctgcagcccgtaagtatttgactaactttattactgttactaacaagtatttaccaaactttaccctcggtaactaactttccgggaaccaaaacggggaccctaaaggtcctttaaggaacgaacttaacgaaaacgtaacgttcggttaggaaccttcggacctaaccgtaacttccgtttacgttaccgtttaaccg

SEQ ID NO: 311162 - DNA, 538 bp, Homo sapiens
  misc_feature: GZ8MTXP02G0YCQ.45.34.D01.1.454.CMB.2.raw
  modified_base (202)..(202): a, c, t, g, unknown or other
  misc_feature (202)..(202): n is a, c, g, or t
  modified_base (229)..(229): a, c, t, g, unknown or other
  misc_feature (229)..(229): n is a, c, g, or t
  modified_base (234)..(234): a, c, t, g, unknown or other
  misc_feature (234)..(234): n is a, c, g, or t
  modified_base (282)..(282): a, c, t, g, unknown or other
  misc_feature (282)..(282): n is a, c, g, or t
  modified_base (304)..(304): a, c, t, g, unknown or other
  misc_feature (304)..(304): n is a, c, g, or t
  modified_base (389)..(389): a, c, t, g, unknown or other
  misc_feature (389)..(389): n is a, c, g, or t
  modified_base (391)..(391): a, c, t, g, unknown or other
  misc_feature (391)..(391): n is a, c, g, or t
  modified_base (429)..(429): a, c, t, g, unknown or other
  misc_feature (429)..(429): n is a, c, g, or t
tcagacgcgatcgacacgaccggtgctcgatttagatcgtctgtgttgggtttgggggcaggagtcagacccactcaggacacagcatggacatgagggtccccgctcagctcctggggctcctgctgctctggctcccaggtgccagatgtgccatccagatgacccagtctccattcctccctgtctgcatctgtagganacagtagttaccataacttggccgganaagtnaggatataagaaatgagtaggctggtatcagcagagaccgaggggacncccccaatcctagtctatggtncttaccaggttacaaaggtcggggtacccagtcgaaggttcagtggcggtggtctgggcacagaattcactctcaccatcagccncngcacgcccgaatatttcactaacttatactgtactaanaagtatttacaacttacccgtagactacttcggaccaagggaccaagtcttagaacgtactacgaaaacgtactggtacgctagacctaaacctatctacgttactacg

SEQ ID NO: 311163 - DNA, 584 bp, Homo sapiens
  misc_feature: GZ8MTXP02HL8Q5.45.34.D01.1.454.CMB.2.raw
  modified_base (201)..(201): a, c, t, g, unknown or other
  misc_feature (201)..(201): n is a, c, g, or t
  modified_base (277)..(277): a, c, t, g, unknown or other
  misc_feature (277)..(277): n is a, c, g, or t
  modified_base (431)..(431): a, c, t, g, unknown or other
  misc_feature (431)..(431): n is a, c, g, or t
tcagacgcgatcgacacgaccggtgctcgatttagatcgtctgtgttgggtttgggggcaggagtcagacccactcaggacacagcatggacatgagggtccccgctcagctcctggggctcctgctgctctggctcccaggtgccagatgtgccatccagatgacccagtctccattctccctgtctgcatctgtagganacagagttaccataacttgcggcaagtcagatattagaaatgagttaggctggtatcagcagagaccagggggacnccccccaaatcctagtctagtggtgcttcaaggttacaaaggtcggggtcccagtcaaggttcaggtggcggtggtctggcacgagaattcactctacaccatcacgccgctgacacgcccgaagtctttgactaactttatactgtacttaanaagtatttaccaaacttacccgtacggactaacgttccggaccgaaaacggggacctaaaaggtcctttaggaaacgtaacttaaccgaaaacgtaacgttcggtacgggtaacttcggaaccaaccctagttccgttcgtttaaccctttcg

SEQ ID NO: 311164 - DNA, 620 bp, Homo sapiens
  misc_feature: GZ8MTXP02GWU07.45.34.D01.1.454.CMB.2.raw
  modified_base (201)..(201): a, c, t, g, unknown or other
  misc_feature (201)..(201): n is a, c, g, or t
  modified_base (276)..(276): a, c, t, g, unknown or other
  misc_feature (276)..(276): n is a, c, g, or t
  modified_base (360)..(360): a, c, t, g, unknown or other
  misc_feature (360)..(360): n is a, c, g, or t
tcagacgcgatcgacacgaccggtgctcgatttagatcgtctgtgttgggtttgggggcaggagtcagacccactcaggacacagcatggacatgagggtccccgctcagctcctggggctcctgctgctctggctcccaggtgccagatgtgccatccagatgacccagtctccattctccctgtctgcatctgtagganacagagttaccataacttgccgggcaagtcaggatatagaatgagtaggctgtatcagcagagaccgaggggacncccccaatcctagtctatggtcgcttaccgaggttacaaaggtcggggtccatcgaacggttcaggtggcggtgggtctggcanagtatcactctcacatcacgccgctgactacgacccgtaatacttttcgactaaactttacttacgtacgtactaacgtaacgttaactttactaaacctttaccctgggtaaccttaacggttccggaacccgaaaacgggggtacccctaaaaggtccgtttaagggaaactaacgtaaaccgtaaaaccgtaaaccgttggtaacgggtcttacggaaccctaacctacgtttccttaccggtttaccttttacccg

SEQ ID NO: 311165 - DNA, 590 bp, Homo sapiens
  misc_feature: GZ8MTXP02H27DU.45.34.D01.1.454.CMB.2.raw
  modified_base (201)..(201): a, c, t, g, unknown or other
  misc_feature (201)..(201): n is a, c, g, or t
  modified_base (279)..(279): a, c, t, g, unknown or other
  misc_feature (279)..(279): n is a, c, g, or t
tcagacgcgatcgacacgaccggtgctcgatttagatcgtctgtgttgggtttgggggcaggagtcagacccactcaggacacagcatggacatgagggtccccgctcagctcctggggctcctgctgctctggctcccaggtgccagatgtgccatccagatgacccagtctccattctccctgtctgcatctgtagganacagagttaccataacttgccggcaagtcaggatattagaaatgagttaggctggtatcagcagagaccgaggggacnccccccaatcctagtctatggtgctttaccgaggttacaaaggtggggtacccatcaaggtcaggtggcgggtggtctgggcacagaacttcactctacaccactcgagcccgcctcgcaacggaccccgtaaagttacttttcgaccttaaactttaacgtttactacgttactttaacaaagttactttacctaaactttaccccgacggtaacctagtttaccggaccgtaaaaggggaaccctaagtcgttagacgtaactaacaaaaccggaattggcggaactcggacactactcttctctttac

SEQ ID NO: 311166 - DNA, 545 bp, Homo sapiens
  misc_feature: GZ8MTXP02FZHNE.45.34.D01.1.454.CMB.2.raw
  modified_base (197)..(197): a, c, t, g, unknown or other
  misc_feature (197)..(197): n is a, c, g, or t
  modified_base (222)..(222): a, c, t, g, unknown or other
  misc_feature (222)..(222): n is a, c, g, or t
  modified_base (275)..(275): a, c, t, g, unknown or other
  misc_feature (275)..(275): n is a, c, g, or t
  modified_base (358)..(358): a, c, t, g, unknown or other
  misc_feature (358)..(358): n is a, c, g, or t
  modified_base (426)..(426): a, c, t, g, unknown or other
  misc_feature (426)..(426): n is a, c, g, or t
tcagacgcgatcgacacgaccggtgctcgatttagatcgtctgtgttgggtttgggggagtcagacccactcaggacacagcatggacatgagggtccccgctcagctcctggggctcctgctgctctggctcccaggtgccagatgtgccatccagatgacccagtctccattctccctgtctgcatctgtagganacagagttaccataacttgccgggnaagtcaggatattagaatgagttaggctggtatcagcagagaccgaggggacncccccaatcctagtctatggtgcttccgaggttacaaaggtcggggtaccagtacaaggttcaggtggcgtgggtctggcacngaattcactctcacatcagccgctgcacgcccgaaagtcttttgactaactttattactgtacctaanaagtatttacaaactttacccaggaactacgttcggaccaaagggaccaagtcttagaagattaacaaaacgtacttgtacggcttggaacctacctattctgtccttacactttcccg

SEQ ID NO: 311167 - DNA, 586 bp, Homo sapiens
  misc_feature: GZ8MTXP02IC3GV.45.34.D01.1.454.CMB.2.raw
  modified_base (373)..(373): a, c, t, g, unknown or other
  misc_feature (373)..(373): n is a, c, g, or t
tcagacgcgatcgacacgaccggtgctcgatttagatcgtctgtgttgggtttggggagagaggagccttagccctggactccaaggcctttccacttggtgaccagcactgagcacagaggactcaccatggaattggggctgagctgggctttccttgttgctattttagaaggtgtccaatgtgagatgaaagtggtggagtcgtgggggagacttggtccagtccggggggtccctgagactctcctgtacagcctctggactcaccttgagcaattatggatgaccgtgggtccgccaggctccgaggggagggctgggagtgggtggcaaacgataaagcaaagagtgggagtccgaaaagaactangtggactcgtgtggaaggtcggttcaaccgtatctcccaagtagacaaagtcggacccaaagtattccgagtttcttttaagggaaatggacagttcagagatacgaaagtagtacggctaaggtattatacgtgacggtacgagagattggaaactagtaccgtaaaggtcgggggtaagaagtacgtaagttcgttagggtttacattcgg

SEQ ID NO: 311168 - DNA, 515 bp, Homo sapiens
  misc_feature: GZ8MTXP02FM36A.45.34.D01.1.454.CMB.2.raw
  modified_base (226)..(226): a, c, t, g, unknown or other
  misc_feature (226)..(226): n is a, c, g, or t
  modified_base (280)..(280): a, c, t, g, unknown or other
  misc_feature (280)..(280): n is a, c, g, or t
  modified_base (444)..(444): a, c, t, g, unknown or other
  misc_feature (444)..(444): n is a, c, g, or t
tcagacgcgatcgacacgaccggtgctcgatttagatcgtctgtgttgggtttgggggcaggagtcagacccactcaggacacagcatggacatgagggtccccgctcagctcctggggctcctgctgctctggctcccaggtgccagatgtgccatccagatgacccagtctccattctccctgtctgcatctgtaggagacagagttaccataacttgccgggnaagtcaggatattagaaatgagttaggctggtatcagcagagaccagggggacnccccccaatcctagtctatggtgcttccaggttacaaagtggggtccatcaaggttcagtggcggtgggtctgggcacagaattcactctcaccatcagccgctgcagcccgaagtattttgactaacttattactgtactaacaagtatttcaaacttacccnggtactagttcgaccaaagggaccaaagcttgagatacaaaacgaactgtggctgacaccatctgtcttac

SEQ ID NO: 311169 - DNA, 554 bp, Homo sapiens
  misc_feature: GZ8MTXP02GNZYL.45.34.D01.1.454.CMB.2.raw
  modified_base (303)..(303): a, c, t, g, unknown or other
  misc_feature (303)..(303): n is a, c, g, or t
  modified_base (538)..(538): a, c, t, g, unknown or other
  misc_feature (538)..(538): n is a, c, g, or t
tcagacgcgatcgacacgaccggtgctcgatttagatcgtctgtgttgggtttgaggtctcagagaggagccttagccctggactccaaggcctttccacttggtgaccagcactgagcacagaggactcaccatggaattggggctgagctgggctttccttgttgctattttagaaggtgtccaatgtgagatgaaagtggtggagtcgtgggggagacttggtccagtccggggggtccctggagactctcctgtacagcctctggactcaccttgagcaattatggatgacctggtccnccaggctccgagggaggggctgggagtgggtggccaacataaagcaagatggggatacggaaagaactatgtgggactcgtagtggaaggggtcggttcaaccgatcctaccagacgacaatgaccaagaattcagttcttttaggaaatggactagtcgtgagataccggaagacgtacggcaagtatattacgtgccgacgagagatagatacgtaacgtaagtagggggtanaggacacgtagtttgg

SEQ ID NO: 311170 - DNA, 561 bp, Homo sapiens
  misc_feature: GZ8MTXP02IYBU6.45.34.D01.1.454.CMB.2.raw
  modified_base (201)..(201): a, c, t, g, unknown or other
  misc_feature (201)..(201): n is a, c, g, or t
  modified_base (226)..(226): a, c, t, g, unknown or other
  misc_feature (226)..(226): n is a, c, g, or t
  modified_base (279)..(279): a, c, t, g, unknown or other
  misc_feature (279)..(279): n is a, c, g, or t
  modified_base (300)..(300): a, c, t, g, unknown or other
  misc_feature (300)..(300): n is a, c, g, or t
tcagacgcgatcgacacgaccggtgctcgatttagatcgtctgtgttgggtttgggggcaggagtcagacccactcaggacacagcatggacatgagggtccccgctcagctcctggggctcctgctgctctggctcccaggtgccagatgtgccatccagatgacccagtctccattctccctgtctgcatctgtagganacagagttaccataacttgccgggnaagtcaggatatagaaatgagttaggctggtatcagcagagaccgaggggacncccccaatctagtctatggtncttcaggttacaagtgggtaccatcaaggttcagtggcggtggtctggcacagattcactcacacatcacgccgctgcacgcccgaagtactttagactaatttatactgtactacaagtatttacaacttaccgtcggactacgttccggacctaaaggggaccctaaagtccttaggaaacgtaactaaccgtaaaacgtaaaccgtggttaacggccttacggacctaaccctaacttccgtttacgttcctttaacc

SEQ ID NO: 311171 - DNA, 583 bp, Homo sapiens
  misc_feature: GZ8MTXP02GOC8F.45.34.D01.1.454.CMB.2.raw
  modified_base (298)..(298): a, c, t, g, unknown or other
  misc_feature (298)..(298): n is a, c, g, or t
  modified_base (353)..(353): a, c, t, g, unknown or other
  misc_feature (353)..(353): n is a, c, g, or t
  modified_base (368)..(368): a, c, t, g, unknown or other
  misc_feature (368)..(368): n is a, c, g, or t
  modified_base (372)..(372): a, c, t, g, unknown or other
  misc_feature (372)..(372): n is a, c, g, or t
tcagacgcgatcgacacgaccggtgctcgatttagatcgtctgtgttgggtttgggggagtcagacccactcaggacacagcatggacatgagggtccccgctcagctcctggggctcctgctgctctggctcccaggtgccagatgtgccatccagatgacccagtctccattctccctgtctgcatctgtaggagacagagttaccataacttgccggcaagtcaggatattagaaatgagttaggctggtatcagcagagaccagggggacccccccgaatcctagtctatggtncttccaggtttacaaaggtgggtcccatcaaggttcagtggcgtggtctggcacngaattcactctcacntcanccgctgcagcccgaagtctttgactaacttattactgtactaacgtaatactttacaactttaccccgtaggaacctagtttcccggaaccgtaaacgggggtacccaaaagtccgtttaggaacggtaattaccgaaaaacgtaacgttggtacgggaccttggaaccgtaaccctaagttccttaggtttaccttctaactttcccccg

SEQ ID NO: 311172 - DNA, 567 bp, Homo sapiens
  misc_feature: GZ8MTXP02JVWEP.45.34.D01.1.454.CMB.2.raw
  modified_base (201)..(201): a, c, t, g, unknown or other
  misc_feature (201)..(201): n is a, c, g, or t
  modified_base (302)..(302): a, c, t, g, unknown or other
  misc_feature (302)..(302): n is a, c, g, or t
tcagacgcgatcgacacgaccggtgctcgatttagatcgtctgtgttgggtttgggggcaggagtcagacccactcaggacacagcatggacatgagggtccccgctcagctcctggggctcctgctgctctggctcccaggtgccagatgtgccatccagatgacccagtctccattctccctgtctgcatctgtagganacagagttaccataacttgccgggcaagtcaggatattagaaatgagttaggctggtatcagcagagaccgaggggacgcccccaatcctagtctatggtncttcgaggttacaaaggtggggtcccagtcaaggttcagtggcggtgggtctggcacagacttcactctacaccatcacgcccgacctgccacggacccgaagtattttcgactaaacctttattactgtctaacagtatttacaactttaccccgtacggaactacgtttaccggaccgtaaaacggggaccctaaaaggtcctttgaaacggtactacgaaaaccgacttggtacggctgaccactagttcctacgtttcttc

SEQ ID NO: 311173 - DNA, 570 bp, Homo sapiens
  misc_feature: GZ8MTXP02H9FZ8.45.34.D01.1.454.CMB.2.raw
  modified_base (225)..(225): a, c, t, g, unknown or other
  misc_feature (225)..(225): n is a, c, g, or t
  modified_base (251)..(251): a, c, t, g, unknown or other
  misc_feature (251)..(251): n is a, c, g, or t
  modified_base (258)..(258): a, c, t, g, unknown or other
  misc_feature (258)..(258): n is a, c, g, or t
  modified_base (278)..(278): a, c, t, g, unknown or other
  misc_feature (278)..(278): n is a, c, g, or t
tcagacgcgatcgacacgaccggtgctcgatttagatcgtctgtgttgggtttggggaggagtcagacccactcaggacacagcatggacatgagggtccccgctcagctcctggggctcctgctgctctggctcccaggtgccagatgtgccatccagatgacccagtctccattctccctgtctgcatctgtaggagacagagttaccattaacttggccggnaagtcaggatatagaatgagttaggntggtatnagcagagaccgaggggaccnccccccaatctagtctagtggtgcttccaggttacaaaggtcgggtccatcgaaggttccaggtggcggtgggtctggcacgagtaacttcacctctcacactcagcccgctgacaccgacccgaagttcttttcgacctaaactttattacttgttactaactagtacttttaccaaactttccccgtacggactacgttaccggaccgtaaacggggaccaaaggtcttaggagtactaaccgaaaacgtacgtggtggacctgaccaactactctcgttaccttactcc

SEQ ID NO: 311174 - DNA, 515 bp, Homo sapiens
  misc_feature: GZ8MTXP02HN98A.45.34.D01.1.454.CMB.2.raw
  modified_base (221)..(221): a, c, t, g, unknown or other
  misc_feature (221)..(221): n is a, c, g, or t
  modified_base (271)..(271): a, c, t, g, unknown or other
  misc_feature (271)..(271): n is a, c, g, or t
  modified_base (353)..(353): a, c, t, g, unknown or other
  misc_feature (353)..(353): n is a, c, g, or t
  modified_base (433)..(433): a, c, t, g, unknown or other
  misc_feature (433)..(433): n is a, c, g, or t
  modified_base (504)..(504): a, c, t, g, unknown or other
  misc_feature (504)..(504): n is a, c, g, or t
tcagacgcgatcgacacgaccggtgctcgatttagatcgtctgtgttgggtttgggggagtcagacccactcaggacacagcatggacatgagggtccccgctcagctcctggggctcctgctgctctggctcccaggtgccagatgtgccatccagatgacccagtctccattctccctgtctgcatctgtaggagacagagttaccataacttgccggnaagtcaggatatagaatgagtaggctggtatcagcagagacgaggggacncccccaatcctagtctatggtgcttccaggttacaaaggtggggtacccatcaaaggttcagtgggcggtgggtctggcacngaattcactctcacatcagccgctgcagcccgaagtattttgactaattatactgtactacgaatatttcaaacttaccncgactagtcggacgaaggaccaaggtcttagaagtataacaaaacgactagtcgactgaaccaactctctntctactactcg

SEQ ID NO: 311175 - DNA, 570 bp, Homo sapiens
  misc_feature: GZ8MTXP02GT16V.45.34.D01.1.454.CMB.2.raw
  modified_base (336)..(336): a, c, t, g, unknown or other
  misc_feature (336)..(336): n is a, c, g, or t
tcagacgcgatcgacacgaccggtgctcgatttagatcgtctgtgttgggtttggggagagaggagccttagccctggactccaaggcctttccacttggtgaccagcactgagcacagaggactcaccatggaattggggctgagctgggctttccttgttgctattttagaaggtgtccaatgtgagatgaaagtggtggagtcgtgggggagacttggtccagtccggggggtccctggagactctcctgtacagcctctggactcaccttgagcaattattggatgacctggtccgcaggctccgaggggagggctgggagtgggtgccaanataaagcaaagagtgggagtaccgaaaagactagtggtaggactcgtgtagaaggggtcggttacaccatctccagagacaatcgacaagattcagttcgttttaggaaattggactagtctagagacgtaccgaaagtagtacggactaggtaattattacgtagcgacgagagatagaattacgtaccgtaaggtagggggaagagaacgtagtcgttggtttacgagtttg

SEQ ID NO: 311176 - DNA, 591 bp, Homo sapiens
  misc_feature: GZ8MTXP02FI0VG.45.34.D01.1.454.CMB.2.raw
  modified_base (211)..(211): a, c, t, g, unknown or other
  misc_feature (211)..(211): n is a, c, g, or t
  modified_base (354)..(354): a, c, t, g, unknown or other
  misc_feature (354)..(354): n is a, c, g, or t
  modified_base (422)..(422): a, c, t, g, unknown or other
  misc_feature (422)..(422): n is a, c, g, or t
tcagacgcgatcgacacgaccggtgctcgatttagatcgtctgtgttgggtttggggagagaggagccttagccctggactccaaggcctttccacttggtgaccagcactgagcacagaggactcaccatggaattggggctgagctgggctttcctgttgctattttagaaggtgtccaatgtgagatgaaagtggtgagtctgggganacttggtccagtccggggggtcctgagactctcctgtacagcctctggactcaccttgagcaattattggatgacctggggtcccgccgaggcctccgaggggaaggggctggaggtggggtggccaacataaaacgcaaagntggggagtaccgaaagactatgtggactcgtgtgaaagggtcgttacacctatctccagagacaaacncgaccaaagtactactagtttacgtttaaggaaagtcggactagtcgtagaagacgtacgaagtacgtacggactaagttaatagttacgtgacggacgaagagtagtagtacgtaacgtaccgtaaggtagggggtaagacgtacgtacgttcgttaggttacgtatg

SEQ ID NO: 311177 - DNA, 543 bp, Homo sapiens
  misc_feature: GZ8MTXP02FS7FS.45.34.D01.1.454.CMB.2.raw
tcagacgcgatcgacacgaccggtgctcgatttagatcgtctgtgttgggtttgaggtctcagagaggagccttagccctggactccaaggcctttccacttggtgaccagcactgagcacagaggactcaccatggaattggggctgagctgggctttcctgttgctattttagaaggtgtccaatgtgagatgaaagtggtggagtctgggggagacttggtccagtccgggggggtccctgagactctcctgtacagcctctggactcaccttgagcaattattggatgacctggtccgcaggctccgaggggaggggctggagtgggtggccaacataaagcaaagagtgggatacgaaagaactatgtgggactctggtgaaggggttcgttcaccgatctaccagagacaatgaccaaagaattcagtcttttaggaaatggacagtctgagatccgaaagagtacggctaagtattattactgcgacgagagtatgagtagtaaccgtaagtgggggtagaggactactgtttagg

SEQ ID NO: 311178 - DNA, 543 bp, Homo sapiens
  misc_feature: GZ8MTXP02HSWYJ.45.34.D01.1.454.CMB.2.raw
  modified_base (253)..(253): a, c, t, g, unknown or other
  misc_feature (253)..(253): n is a, c, g, or t
  modified_base (295)..(295): a, c, t, g, unknown or other
  misc_feature (295)..(295): n is a, c, g, or t
  modified_base (325)..(325): a, c, t, g, unknown or other
  misc_feature (325)..(325): n is a, c, g, or t
  modified_base (330)..(330): a, c, t, g, unknown or other
  misc_feature (330)..(330): n is a, c, g, or t
  modified_base (384)..(384): a, c, t, g, unknown or other
  misc_feature (384)..(384): n is a, c, g, or t
  modified_base (387)..(387): a, c, t, g, unknown or other
  misc_feature (387)..(387): n is a, c, g, or t
  modified_base (468)..(468): a, c, t, g, unknown or other
  misc_feature (468)..(468): n is a, c, g, or t
tcagacgcgatcgacacgaccggtgctcgatttagatcgtctgtgttgggtttggggagagaggagccttagccctggactccaaggcctttccacttggtgaccagcactgagcacagaggactcaccatggaattggggctgagcgtgggctttcctgttgctatttagaagtgtcaatgtgagatgaaagtggtggagtcgtgggggagacttggtccaggtccggggggtcctgagactctcctgtacngcctctggactcaccttgagcaattatggatgacctggtccncaggctccgaggggagggcgtggagtgggngcaanataaagcaagagtgggataccgaaagactatgtgactgtgtgaaggtcgtcacntcncagagacatgacaagtattcagtttcgtttagaactgactagtctaggagactacgaagagtacgactaagtatattacgngcgacgagagagtagtagttacgtacgtaaggtagggggtaacacgtatacgttagttaggtttacgtagtttcg

SEQ ID NO: 311179 - DNA, 614 bp, Homo sapiens
  misc_feature: GZ8MTXP02HD40I.45.34.D01.1.454.CMB.2.raw
  modified_base (202)..(202): a, c, t, g, unknown or other
  misc_feature (202)..(202): n is a, c, g, or t
  modified_base (275)..(275): a, c, t, g, unknown or other
  misc_feature (275)..(275): n is a, c, g, or t
  modified_base (297)..(297): a, c, t, g, unknown or other
  misc_feature (297)..(297): n is a, c, g, or t
tcagacgcgatcgacacgaccggtgctcgatttagatcgtctgtgttgggtttgggggcaggagtcagacccactcaggacacagcatggacatgagggtccccgctcagctcctggggctcctgctgctctggctcccaggtgccagatgtgccatccagatgacccagtctccattcctccctgtctgcatctgtagganacagagttaccataactgccggcaagtcagatatagaaatgagtagctggtatcagcagagaccgaggggacncccccaatcctagtctatggtntcttcgaggttacaaaggtcgggtacccagtcgaaggtcaggtggcgggtggtcgtggcacagtactcactctacaccatcacgccgctgcacgcccgaagtatttgactaactttattactgtacttaacaagttatttactaaacttacccgtacggaaccttacggttacccggaaccgtaaaacggggaaccctaaacggtccgtttaagggaacgtaaacgtaaaccgtaaaaccggtaacgttacgggtacggtaacccttacggaccctaacccgttaagtttcccgtttacgtttacccttttaacccg

SEQ ID NO: 311180 - DNA, 528 bp, Homo sapiens
  misc_feature: GZ8MTXP02I5W4S.45.34.D01.1.454.CMB.2.raw
  modified_base (214)..(214): a, c, t, g, unknown or other
  misc_feature (214)..(214): n is a, c, g, or t
  modified_base (300)..(300): a, c, t, g, unknown or other
  misc_feature (300)..(300): n is a, c, g, or t
  modified_base (351)..(351): a, c, t, g, unknown or other
  misc_feature (351)..(351): n is a, c, g, or t
tcagacgcgatcgacacgaccggtgctcgatttagatcgtctgtgttgggtttggggagagaggagccttagccctggactccaaggcctttccacttggtgaccagcactgagcacagaggactcaccatggaattggggctgagctgggctttccttgttgctattttagaaggtgtccaatgtgagatgaaagtggtggagtctggggganacttggtccagtccgggggggtccctgagactctcctgtacagcctctggactcaccttgagcaattattggatgacctgggtccnccaggctccaggggaagggctgggagtgggtggccaaacataaagcaaagntggggatccgaaagactatgtggactctggtgaaggggtcgttacaccgatctccagagacaatgaccaagattcagttcttttagaaatgacagtctgagatcgaagatacggcagtatatactgcgcgagagatagatagtacctaagtggggtaagagacatcgtggttgattg

SEQ ID NO: 311181 - DNA, 575 bp, Homo sapiens
  misc_feature: GZ8MTXP02IF6PM.45.34.D01.1.454.CMB.2.raw
  modified_base (299)..(299): a, c, t, g, unknown or other
  misc_feature (299)..(299): n is a, c, g, or t
  modified_base (327)..(327): a, c, t, g, unknown or other
  misc_feature (327)..(327): n is a, c, g, or t
tcagacgcgatcgacacgaccggtgctcgatttagatcgtctgtgttgggtttggggagagaggagccttagccctggactccaaggcctttccacttggtgaccagcactgagcacagaggactcaccatggaattggggctgagctgggctttcctgttgctattttagaaggtgtccaatgtgagatgaaagtggtggagtcgtgggggagacttggtccagtccggggggtccctgagactctcctgtacagcctctggactcaccttgagcaattattggatgacctgggtccnccaggctcgagggaagggctggagtggngcaacagtaaagcaaagagtggagtccgaaaagaactatggtggtaactcgtgggtggtaaaggggttccggttacaacccgtatacctaccgaagacgacaaatcgaccgaaaagtattactagtttacttttaggaaattggactaagtctaggtagacgtacgaaagacgtaacggctagtattatactgcgagagagatagaatacgtactaaggtaggggaagagactatgtggtttagattg

SEQ ID NO: 311182 - DNA, 531 bp, Homo sapiens
  misc_feature: GZ8MTXP02FWQYW.45.34.D01.1.454.CMB.2.raw
  modified_base (201)..(201): a, c, t, g, unknown or other
  misc_feature (201)..(201): n is a, c, g, or t
  modified_base (225)..(225): a, c, t, g, unknown or other
  misc_feature (225)..(225): n is a, c, g, or t
  modified_base (249)..(249): a, c, t, g, unknown or other
  misc_feature (249)..(249): n is a, c, g, or t
  modified_base (393)..(393): a, c, t, g, unknown or other
  misc_feature (393)..(393): n is a, c, g, or t
  modified_base (522)..(522): a, c, t, g, unknown or other
  misc_feature (522)..(522): n is a, c, g, or t
tcagacgcgatcgacacgaccggtgctcgatttagatcgtctgtgttgggtttgggggcaggagtcagacccactcaggacacagcatggacatgagggtccccgctcagctcctggggctcctgctgctctggctcccaggtgccagatgtgccatccagatgacccagtctccattctccctgtctgcatctgtagganacagagttaccataacttgccggnaagtcaggatatagaatgagtagntggtatcagcagagaccgaggggacacccccaatcctagtctatggtgcttacaggttacaaaggtcgggtaccagtcaaggttcagtggcggtggtctggcacagtattcactctcaccatcagccgctgcacgccgtaagtntttgactaagtttatactgttactaactaagttactttacaaacttaccgtacggtactacgttccggaacctaagggaacccaagtcgttagacgactaacaaaacgtactgtagctgaccaaccgtntctactctc

SEQ ID NO: 311183 - DNA, 545 bp, Homo sapiens
  misc_feature: GZ8MTXP02IK7AC.45.34.D01.1.454.CMB.2.raw
  modified_base (254)..(254): a, c, t, g, unknown or other
  misc_feature (254)..(254): n is a, c, g, or t
  modified_base (259)..(259): a, c, t, g, unknown or other
  misc_feature (259)..(259): n is a, c, g, or t
  modified_base (475)..(475): a, c, t, g, unknown or other
  misc_feature (475)..(475): n is a, c, g, or t
  modified_base (496)..(496): a, c, t, g, unknown or other
  misc_feature (496)..(496): n is a, c, g, or t
tcagacgcgatcgacacgaccggtgctcgatttagatcgtctgtgttgggtttggggagagaggagccttagccctggactccaaggcctttccacttggtgaccagcactgagcacagaggactcaccatggaattggggctgagctgggctttcctgttgctattttagaaggtgtccaatgtgagatgaaagtggtggagtctgggggagacttggtccagtccggggggtccctgagactctcctgtacngcctntggactcaccttgagcaattattggatgacctgggtccgcaggctccgaggggaaggggctggagtgggtggccaaacagtaaagcaaagagtagggagtccgaaaagactagtgtgactctggtgaagggtcgttcaccgatctacagagacaatgacaaagaattctagttacttttagaaatggactagtacagagatacgaaagatacgganagtatattactgcgacgaganagtgatacgtactaaggtaggggtaagagactatagtggtttagattgg

SEQ ID NO: 311184 - DNA, 498 bp, Homo sapiens
  misc_feature: GZ8MTXP02IZQGO.45.34.D01.1.454.CMB.2.raw
  modified_base (150)..(150): a, c, t, g, unknown or other
  misc_feature (150)..(150): n is a, c, g, or t
  modified_base (246)..(246): a, c, t, g, unknown or other
  misc_feature (246)..(246): n is a, c, g, or t
  modified_base (263)..(263): a, c, t, g, unknown or other
  misc_feature (263)..(263): n is a, c, g, or t
  modified_base (269)..(270): a, c, t, g, unknown or other
  misc_feature (269)..(270): n is a, c, g, or t
  modified_base (279)..(279): a, c, t, g, unknown or other
  misc_feature (279)..(279): n is a, c, g, or t
  modified_base (282)..(282): a, c, t, g, unknown or other
  misc_feature (282)..(282): n is a, c, g, or t
  modified_base (291)..(291): a, c, t, g, unknown or other
  misc_feature (291)..(291): n is a, c, g, or t
  modified_base (293)..(293): a, c, t, g, unknown or other
  misc_feature (293)..(293): n is a, c, g, or t
  modified_base (295)..(295): a, c, t, g, unknown or other
  misc_feature (295)..(295): n is a, c, g, or t
  modified_base (300)..(300): a, c, t, g, unknown or other
  misc_feature (300)..(300): n is a, c, g, or t
  modified_base (304)..(304): a, c, t, g, unknown or other
  misc_feature (304)..(304): n is a, c, g, or t
  modified_base (306)..(306): a, c, t, g, unknown or other
  misc_feature (306)..(306): n is a, c, g, or t
  modified_base (309)..(309): a, c, t, g, unknown or other
  misc_feature (309)..(309): n is a, c, g, or t
  modified_base (311)..(311): a, c, t, g, unknown or other
  misc_feature (311)..(311): n is a, c, g, or t
  modified_base (369)..(369): a, c, t, g, unknown or other
  misc_feature (369)..(369): n is a, c, g, or t
  modified_base (371)..(371): a, c, t, g, unknown or other
  misc_feature (371)..(371): n is a, c, g, or t
  modified_base (373)..(373): a, c, t, g, unknown or other
  misc_feature (373)..(373): n is a, c, g, or t
tcagacgcgatcgacacgaccggtgctcgatttagatcgtctgtgttgggtttgggagagaggagccttagccctggactccaaggcctttccacttggtgaccagcactgagcacagaggactcaccatggaattgggctgagcgtggngttcctagtgctatttagagtgtcaatgtgagatgaaagtggtggagtctggggagacttggtccatccggggggtccctgagactctcctgtacngctctgctcactgaganatatgnngactgcgcngcncgaggaggngngngtggngcananaananagagaggagacgaagaatatagtgacgtctgtagaggtacgtctacatctcacgaganananacaagtatatagttagtttagtaagtagtagagtagtagtagatacgaagagtacgagtagtatatatgcgacgagagagtagtagtacgtacgtagtaggtaagagacgtagtagtgttgtatg

SEQ ID NO: 311185 - DNA, 551 bp, Homo sapiens
  misc_feature: GZ8MTXP02I6YNE.45.34.D01.1.454.CMB.2.raw
  modified_base (222)..(222): a, c, t, g, unknown or other
  misc_feature (222)..(222): n is a, c, g, or t
  modified_base (277)..(277): a, c, t, g, unknown or other
  misc_feature (277)..(277): n is a, c, g, or t
  modified_base (357)..(357): a, c, t, g, unknown or other
  misc_feature (357)..(357): n is a, c, g, or t
  modified_base (433)..(433): a, c, t, g, unknown or other
  misc_feature (433)..(433): n is a, c, g, or t
  modified_base (526)..(526): a, c, t, g, unknown or other
  misc_feature (526)..(526): n is a, c, g, or t
  modified_base (533)..(533): a, c, t, g, unknown or other
  misc_feature (533)..(533): n is a, c, g, or t
tcagacgcgatcgacacgaccggtgctcgatttagatcgtctgtgttgggtttgggggagtcagacccactcaggacacagcatggacatgagggtccccgctcagctcctggggctcctgctgctctggctcccaggtgccagatgtgccatccagatgacccagtctccattctccctgtctgcatctgtaggagacagagttaccataacttgccgggnaagtcaggatattagaaatgagttaggctggtatcagcagagaccgagggggacnccccccaatcctagtctatggtgcttcaggttacaaaggtcgggtcccatcgaaggttcaggtggcggtggtctggcacngtattcactctcacatcacgccgcctgacacggcccgaagtcttttgactaatttatacttagtcttaacaagttntttacaactttacccctggaacctagttaccggacaacggggaccaagtcgttacgagaactacaaaaacgtactggtcgctaggcctaaacncgttctnttcctttacactttcccg

SEQ ID NO: 311186 - DNA, 536 bp, Homo sapiens
  misc_feature: GZ8MTXP02H0NVK.45.34.D01.1.454.CMB.2.raw
  modified_base (463)..(463): a, c, t, g, unknown or other
  misc_feature (463)..(463): n is a, c, g, or t
  modified_base (470)..(470): a, c, t, g, unknown or other
  misc_feature (470)..(470): n is a, c, g, or t
  modified_base (484)..(484): a, c, t, g, unknown or other
  misc_feature (484)..(484): n is a, c, g, or t
  modified_base (531)..(531): a, c, t, g, unknown or other
  misc_feature (531)..(531): n is a, c, g, or t
tcagacgcgatcgacacgaccggtgctcgatttagatcgtctgtgttgggtttggggagagaggagccttagccctggactccaaggcctttccacttggtgaccagcactgagcacagaggactcaccatggaattggggctgagctgggctttccttgttgctattttagaaggtgtccaatgtgagatgaaagtggtggagtctgggggagacttggtccagtccgggggggtcctgagactctcctgtacagcctctggactcaccttgagcaattattggatgacctgggtccgcaggctccgaggggagggctggagtgggttgccaaacataaaagcaaagatggggagtccgaaaagaactatgtggacttctgtgaaagggtcggttcaccatctccagagacaatgaccaaagattcagttcttttaggaaatggacagtctgagatccgaanatacggnagtatatactgcgngagagatgatacgtctaaagtgggggtaagcgaacagtgtaggtttnattcg

SEQ ID NO: 311187 - DNA, 588 bp, Homo sapiens
  misc_feature: GZ8MTXP02FLBZK.45.34.D01.1.454.CMB.2.raw
  modified_base (199)..(199): a, c, t, g, unknown or other
  misc_feature (199)..(199): n is a, c, g, or t
  modified_base (222)..(222): a, c, t, g, unknown or other
  misc_feature (222)..(222): n is a, c, g, or t
  modified_base (433)..(433): a, c, t, g, unknown or other
  misc_feature (433)..(433): n is a, c, g, or t
tcagacgcgatcgacacgaccggtgctcgatttagatcgtctgtgttgggtttgggggcaggagtcagacccactcaggacacagcatggacatgagggtccccgctcagctcctggggctcctgctgctctggctcccaggtgccagatgtgccatccagatgacccagtctcattctccctgtctgcatctgtaganacagattaccataacttgccggnaagtcaggatatagaaatgagtagctgtatcagcagagaccgaggggacacccccaactcctagtctagtggtgcttccgagttacgaaaggtcggggtaccagtacgtaacgttcaggtgggcggtgggtctggcacagtaacttcactcacaccatcacgccgactgccgacgcccgaaagttacgtttcgaactaactttaatacgtnttaacgtaataaagtactttacaaaccgtttaccctacggtaacctacgttaccggaaccgtaaaacggggaccctaaaaggtcttaaggaacgtaactaaccaaaaacgtactaggtcggaacttcgacctaactcgttactcgttcctttacg

SEQ ID NO: 311188 - DNA, 572 bp, Homo sapiens
  misc_feature: GZ8MTXP02H6W0G.45.34.D01.1.454.CMB.2.raw
  modified_base (198)..(198): a, c, t, g, unknown or other
  misc_feature (198)..(198): n is a, c, g, or t
  modified_base (220)..(220): a, c, t, g, unknown or other
  misc_feature (220)..(220): n is a, c, g, or t
  modified_base (225)..(225): a, c, t, g, unknown or other
  misc_feature (225)..(225): n is a, c, g, or t
  modified_base (250)..(250): a, c, t, g, unknown or other
  misc_feature (250)..(250): n is a, c, g, or t
tcagacgcgatcgacacgaccggtgctcgatttagatcgtctgtgttgggtttggggaggagtcagacccactcaggacacagcatggacatgagggtccccgctcagctcctggggctcctgctgctctggctcccaggtgccagatgtgccatccagatgacccagtctccattctcctgtctgcatctgtagganacagagttacataactgccggnaagtnagatatagaatgagttagctggtancagcagagaccgaggggaccgccccaactcctagtctagtggtctcttacgtaaggttaaacaaggtcggggtacccaagtacgtaaggttccagggttgggtcggtgggtctggacacgagtaactccactctacacatcacgccgctcgcacgaccgtaagtactttacgacttacttattactgtacctaataagttacttactaactttacccgacggtactacgttccggaacctaacgggaaccaaagtcgtagagaactaccgaaacgtaacgtcgtacgtcgaacgacaactactcgttacttccttacgtacc

SEQ ID NO: 311189 - DNA, 552 bp, Homo sapiens
  misc_feature: GZ8MTXP02HW3QB.45.34.D01.1.454.CMB.2.raw
  modified_base (215)..(215): a, c, t, g, unknown or other
  misc_feature (215)..(215): n is a, c, g, or t
  modified_base (497)..(497): a, c, t, g, unknown or other
  misc_feature (497)..(497): n is a, c, g, or t
  modified_base (503)..(503): a, c, t, g, unknown or other
  misc_feature (503)..(503): n is a, c, g, or t
tcagacgcgatcgacacgaccggtgctcgatttagatcgtctgtgttgggtttggggagagaggagccttagccctggactccaaggcctttccacttggtgaccagcactgagcacagaggactcaccatggaattggggcttagctgggctttccttgttgctattttagaaggtgtccaatgtgagatgaaagtggtggagtcgtggggganacttggtccagtccggggggtccctggagactctcctgtacagcctctggactcaccttgagcaattattggatgacctggtccgccaggctccgagggaggggctggagtgggtggccaaacataaagcaaagatggggagtacgaaaagaactatgtaggacttcgtgtggaagggtcggttcaccctatctaccagacgacaaatgaccaaagaattcgagtttcttttaggaaattgatagtctgagatccgaagatacggacagtatattactgcgngagagntagatacgtacgtaagtgggggtagaagacagttcgtggttgattgtcg

SEQ ID NO: 311190 - DNA, 522 bp, Homo sapiens
  misc_feature: GZ8MTXP02JJL8X.45.34.D01.1.454.CMB.2.raw
tcagacgcgatcgacacgaccggtgctcgatttagatcgtctgtgttgggtttgaggtctcagagaggagccttagccctggactccaaggcctttccacttggtgaccagcactgagcacagaggactcaccatggaattggggctgagctgggctttccttgttgctattttagaaggtgtccaatgtgagatgaaagtggtggagtcgtgggggagacttggtccagtccggggggtcctgagactctcctgtacagcctctggactcaccttgagcaattatggatgacctggtccgccaggctccgagggaaggggctgggagtgggtggccaaacataaagcaagatgggatcgaaaagactatgtggactctgtgaagggtcgtcacatctccagagacaatgaccaagaatcagttcttttaggaaatggacagtctgagatacgaagatacgcagtatatactgcgcgagagatgatagtaacgtaagtaggggtacgagactagtgtttagg

SEQ ID NO: 311191 - DNA, 677 bp, Homo sapiens
  misc_feature: GZ8MTXP02HG7ZN.45.34.D01.1.454.CMB.2.raw
  modified_base (163)..(163): a, c, t, g, unknown or other
  misc_feature (163)..(163): n is a, c, g, or t
  modified_base (213)..(213): a, c, t, g, unknown or other
  misc_feature (213)..(213): n is a, c, g, or t
  modified_base (254)..(254): a, c, t, g, unknown or other
  misc_feature (254)..(254): n is a, c, g, or t
  modified_base (575)..(575): a, c, t, g, unknown or other
  misc_feature (575)..(575): n is a, c, g, or t
tcagacgcgatcgacacgaccggtgctcgatttagatcgtctgtgttgggtttggggagagaggagccttagccctggactccaaggcctttccacttggtgaccagcactgagcacagaggactcaccatggaattggggctgagctgggctttcttgttgntattttagaagtgtcaatgtgagatagaaagtggtggagtcgtggggganacgttggtccaggtccggggggtcctgagactctctgtacngctctgctcacttgagcaattattggatgaccgtgggtccgccgaggctccggaggggaagggctgggaggtgggtacgaccaaacgaaagtaaagcaaaggtacgtaggggagtaacccgaaaaagtaacttagtaggtaggaaccttcgtgggtacgggtaaaggggttaccggttccaaccgtatcctaccgaaagacgaacaaagtacgacctaaagtattccgtaagtttcgttttaaggaaagttggaaccaggttacgagtaagaacgtaccggtaaaagacgttacggacgtaagttaaacgttatttaacgngggaccgtaacggaagtaagacgttagtaacgttaacgtaccggttaaggttagggggtaaagaacgtaacgttacgttggtttacggtttagtaagtttcg

SEQ ID NO: 311192 - DNA, 572 bp, Homo sapiens
  misc_feature: GZ8MTXP02GZ5PJ.45.34.D01.1.454.CMB.2.raw
  modified_base (197)..(197): a, c, t, g, unknown or other
  misc_feature (197)..(197): n is a, c, g, or t
  modified_base (219)..(219): a, c, t, g, unknown or other
  misc_feature (219)..(219): n is a, c, g, or t
  modified_base (249)..(249): a, c, t, g, unknown or other
  misc_feature (249)..(249): n is a, c, g, or t
  modified_base (386)..(386): a, c, t, g, unknown or other
  misc_feature (386)..(386): n is a, c, g, or t
  modified_base (401)..(401): a, c, t, g, unknown or other
  misc_feature (401)..(401): n is a, c, g, or t
  modified_base (421)..(421): a, c, t, g, unknown or other
  misc_feature (421)..(421): n is a, c, g, or t
tcagacgcgatcgacacgaccggtgctcgatttagatcgtctgtgttgggtttgggggagtcagacccactcaggacacagcatggacatgagggtccccgctcagctcctggggctcctgctgctctggctcccaggtgccagatgtgccatccagatgacccagtctccattctccctgtctgcatctgtagganacagagttaccataactgcggnaagtcaggatatagaatgagtagctggtancagcagagaccgaggggacacccccgaatcctagtctatggtgcttcgagttacgaaaggtcgggtaccaagtcgaaaggttcaggtgggacggttgggtctggcaacagtaaatcaactctacacatcagcccgcngcacgacccgaagtntttgactaacttattacgtntactaacaaagttactttacaaactttccctaacggtactacgttacggaaccaaaggggtacccaaaggtcttagaacgtataaaccgaaaacgtaactcggtacgtcacgaaccaaccctaagtccttgttaccttacacgtttccccg

SEQ ID NO: 311193 - DNA, 633 bp, Homo sapiens
  misc_feature: GZ8MTXP02JG8AX.45.34.D01.1.454.CMB.2.raw
  modified_base (444)..(444): a, c, t, g, unknown or other
  misc_feature (444)..(444): n is a, c, g, or t
  modified_base (594)..(594): a, c, t, g, unknown or other
  misc_feature (594)..(594): n is a, c, g, or t
tcagacgcgatcgacacgaccggtgctcgatttagatcgtctgtgttgggtttggggagagaggagccttagccctggactccaaggcctttccacttggtgaccagcactgagcacagaggactcaccatggaattggggctgagctgggctttccttgttgctattttagaaggtgtccaatgtgagatgaaagtggtggagtcgtgggggagacttggtccagtccgggggggtccctgagactctcctgtacagcctctggactcaccttgagcaattatggatgacctgggtcccgccaggctccgaggggaaggggctgggaggtggggtggaccaaacataaaagcaaagagtaggggagtacccggaaaagtaactatggtaggacttcgtgggtagaacgggggttcggttaccaccgtatctacccaagacganaaagtgaccaaagtaattcagtttcgtttttaaggaaattgggataagttcgtagtaagtacgtaccggaaagagtacggactaagtaacttaattacgtagacgacggagaaggataggaattacgtaccgttaaggtaggggggtaanaaggtaacgtagttcgtttagggtttacgtaagtttcgg

SEQ ID NO: 311194 - DNA, 674 bp, Homo sapiens
  misc_feature: GZ8MTXP02FUKMM.45.34.D01.1.454.CMB.2.raw
  modified_base (199)..(199): a, c, t, g, unknown or other
  misc_feature (199)..(199): n is a, c, g, or t
  modified_base (229)..(229): a, c, t, g, unknown or other
  misc_feature (229)..(229): n is a, c, g, or t
  modified_base (263)..(263): a, c, t, g, unknown or other
  misc_feature (263)..(263): n is a, c, g, or t
  modified_base (267)..(267): a, c, t, g, unknown or other
  misc_feature (267)..(267): n is a, c, g, or t
tcagacgcgatcgacacgaccggtgctcgatttagatcgtctgtgttgggtttgggggagtcagacccactcaggacacagcatggacatgagggtccccgctcagctcctggggctcctgctgctctggctcccaggtgccagatgtgccatccagatgacccagtctccattcctccctgtctgcatctggtagganacagtacgttaccataacgttggccggganaagtcaggtatattagaatgagttaggctggtancagnagacgacggaggggaccacccccaatcctagtctagtggtcgcttaccgaggttaaccgaaaggtcgggtaccctatacgtaaaggttcgaggtcgggcgggtgggtcgtcggacaacgagtaacttcacttccaccaacctataccgacgcccgtacccgtgaccgacggtaacccgtaaagttacgtttttacgaacctttaaactttacttacgttacgttaaccttaaacgttaaacgttacttttacccgaaaacctttaccccggtaccggtaactacggtttacccggggaaacctaaacggggtaaccctaagtccgttaagaacgtaaactaaccgaaaacgtacgtgggttacgcgtacgaacctaccgtacttctacgttccttaccacgtttccc

SEQ ID NO: 311195 - DNA, 609 bp, Homo sapiens
  misc_feature: GZ8MTXP02HFYJE.45.34.D01.1.454.CMB.2.raw
  modified_base (220)..(220): a, c, t, g, unknown or other
  misc_feature (220)..(220): n is a, c, g, or t
  modified_base (307)..(307): a, c, t, g, unknown or other
  misc_feature (307)..(307): n is a, c, g, or t
tcagacgcgatcgacacgaccggtgctcgatttagatcgtctgtgttgggtttgaggtctcagagaggagccttagccctggactccaaggcctttccacttggtgaccagcactgagcacagaggactcaccatggaattggggctgagctgggctttccttgttgcttattttagaaggtgtccaatgtgagatgaaagtggtggagtcgtggggganacttggtccaggtcccggggggtcctggagactctcctgtacagcctctggactcaccttgagcaattatggatgaccgtgggtccncgaggctaccgaaggggaaggggctgggaggtggggtcgaccaaacaataaagcaaagagtaggggagtacgaaaagaactagtgtggactcgtaggtaggaaagggttcgttacaccatctaccgagacgacaaagtacgaccaaagtaattactagttacttttaaggaaagttaggactagtctagagtagtaccgaaagaagtacggataagtaataatttacgagcgacgagaagacgtagtaagttacgtaaccgttaaaggtacgggggtaagagtaactacgttacgtttaggg

SEQ ID NO: 311196 - DNA, 603 bp, Homo sapiens
  misc_feature: GZ8MTXP02FT7ER.45.34.D01.1.454.CMB.2.raw
  modified_base (256)..(256): a, c, t, g, unknown or other
  misc_feature (256)..(256): n is a, c, g, or t
  modified_base (298)..(298): a, c, t, g, unknown or other
  misc_feature (298)..(298): n is a, c, g, or t
tcagacgcgatcgacacgaccggtgctcgatttagatcgtctgtgttgggtttgggggcaggagtcagacccactcaggacacagcatggacatgagggtccccgctcagctcctggggctcctgctgctctggctcccaggtgccagatgtgccatccagatgacccagtctccattcctccctgtctgcatctgtaggagacagagttaccataacttgccgggcaagtcaggatatagaaatgagtgctgtancagcagacgacgaggggacacccccatcctagtctagtggtntctaccgagtacgaaagtcgggtccatcgaagttcgagtggcggtggtctggcacgagtacttcactcgtacacctatcgacgtcccgcctagccacgaccccgtaaagttagttttcaactaactttaacgttacttagttacctaaataataactttaactaaaccttacccgtacggaactacggttaccggaacgaaacggggacctaagtcgttaaggacgtaaactaaacgtaaaacgtaacgttcggacggtaacgttaccgaacctaaccgtacgtacctttgttaccctttaaccg

SEQ ID NO: 311197 - DNA, 569 bp, Homo sapiens
  misc_feature: GZ8MTXP02F79NN.45.34.D01.1.454.CMB.2.raw
  modified_base (275)..(275): a, c, t, g, unknown or other
  misc_feature (275)..(275): n is a, c, g, or t
  modified_base (355)..(355): a, c, t, g, unknown or other
  misc_feature (355)..(355): n is a, c, g, or t
  modified_base (368)..(368): a, c, t, g, unknown or other
  misc_feature (368)..(368): n is a, c, g, or t
  modified_base (380)..(380): a, c, t, g, unknown or other
  misc_feature (380)..(380): n is a, c, g, or t
tcagacgcgatcgacacgaccggtgctcgatttagatcgtctgtgttgggtttgggggagtcagacccactcaggacacagcatggacatgagggtccccgctcagctcctggggctcctgctgctctggctcccaggtgccagatgtgccatccagatgacccagtctccattctccctgtctgcatctgtaggagacagagttaccataacttgccggcaagtcaggatattagaaatgagttggctggtatcagcagagaccgagggggacnccccccaatcctagtctagtggtgtcttcaaggttacaaaggtgggtacccagtcaaggtcagtggcgtggtctggcacngatcactctcacntcacgccgtccngacacgacccgtaatactttagactaactttatactgtacttaacaagtatttaccaatttaccccgaggactagttccggacaaacgggacctaagtccttaggaacaattaaaccgaaaacgtaacgttggtaacgtcgtaacgaacccgtacctacgttacttcgttacctttaccactttccccg

SEQ ID NO: 311198 - DNA, 588 bp, Homo sapiens
  misc_feature: GZ8MTXP02HDPGZ.45.34.D01.1.454.CMB.2.raw
  modified_base (198)..(198): a, c, t, g, unknown or other
  misc_feature (198)..(198): n is a, c, g, or t
  modified_base (222)..(222): a, c, t, g, unknown or other
  misc_feature (222)..(222): n is a, c, g, or t
  modified_base (275)..(275): a, c, t, g, unknown or other
  misc_feature (275)..(275): n is a, c, g, or t
  modified_base (297)..(297): a, c, t, g, unknown or other
  misc_feature (297)..(297): n is a, c, g, or t
tcagacgcgatcgacacgaccggtgctcgatttagatcgtctgtgttgggtttgggggagtcagacccactcaggacacagcatggacatgagggtccccgctcagctcctggggctcctgctgctctggctcccaggtgccagatgtgccatccagatgacccagtcctccattctccctgtctgcatctgtagganacagagttaccataacttgccggnaagtcaggatatagaatgagttaggctggtatcagcagagaccgagggggacnccccccaatccagtctatggtncttcaggttacaaaggtcgggtcccatcaaggttcaggtggcggtggtctggacacagaattcactctcacatcacgccgcctgcacgcccgtaaagtctttgactaacttactaactgtactaacaagttatttacaacttacccgtcggtacaacgtttcgggacccgtaaaggggaacccaaggtacctttaggaacggtaacttaaccaaaaccggtaaacgtcggtacggtacctacggaaccgtaccctaacgttcttaccggttcctttactaacctttccccg

SEQ ID NO: 311199 - DNA, 555 bp, Homo sapiens
  misc_feature: GZ8MTXP02FOC9O.45.34.D01.1.454.CMB.2.raw
  modified_base (201)..(201): a, c, t, g, unknown or other
  misc_feature (201)..(201): n is a, c, g, or t
  modified_base (276)..(276): a, c, t, g, unknown or other
  misc_feature (276)..(276): n is a, c, g, or t
  modified_base (389)..(389): a, c, t, g, unknown or other
  misc_feature (389)..(389): n is a, c, g, or t
tcagacgcgatcgacacgaccggtgctcgatttagatcgtctgtgttgggtttgggggcaggagtcagacccactcaggacacagcatggacatgagggtccccgctcagctcctggggctcctgctgctctggctcccaggtgccagatgtgccatccagatgacccagtctccattctccctgtctgcatctgtagganacagagttaccataacttgccggcaagtcaggatatagaatgagtagctggtatcagcagagaccgagggggacnccccccaactcctagtctagtggtgcttccaggttacaaaggtcggggtaccagtacaaggtttcaggtggcggtgggtctggcacagaattcactctacaccatcacgcccnctcgcacgcccgtaagtctttgactaacttattacctgtactataagtactttacaacttacccgtgtacctagttccggaccgaaaggggaccctaaagtcttaggacgtaactaccaaaacgtaactggtacgcgttcgactaccacttcgtcgtactttaccg

SEQ ID NO: 311200 - DNA, 604 bp, Homo sapiens
  misc_feature: GZ8MTXP02IS2E2.45.34.D01.1.454.CMB.2.raw
  modified_base (209)..(209): a, c, t, g, unknown or other
  misc_feature (209)..(209): n is a, c, g, or t
  modified_base (293)..(293): a, c, t, g, unknown or other
  misc_feature (293)..(293): n is a, c, g, or t
  modified_base (348)..(348): a, c, t, g, unknown or other
  misc_feature (348)..(348): n is a, c, g, or t
tcagacgcgatcgacacgaccggtgctcgatttagatcgtctgtgttgggtttggggagagaggagccttagccctggactccaaggcctttccacttggtgaccagcactgagcacagaggactcaccatggaattggggctgagcgtggcttcctgttgctatttagaagtgtcaatgtgagatgaaagtggtggagtctggggganacttggtccagtccggggggtccctgagactctcctgtacagcctctggactcaccttgagcaattattggatgacctggtccncaggcctccgaggggaagggctgggagtggggtggccaaacgagtaaagcaaagngtagggataccgaaaagaactatggtggcttcgtgtaggaagggtcggttcacccatctacagaagaacaagtagaccaagtaaattactagttacgttttaggtaaagtagtacgtagttacgtagtagtactacggaacgaagtacggtaacgtaaggtaattaattaacgttagcgacggagagaatagagtaacgttaccgttaaggtaggggttaaggaggactaacgttgttaggtttcgtaacgtttgg

SEQ ID NO: 311201 - DNA, 710 bp, Homo sapiens
  misc_feature: GZ8MTXP02H0ONN.45.34.D01.1.454.CMB.2.raw
  modified_base (214)..(214): a, c, t, g, unknown or other
  misc_feature (214)..(214): n is a, c, g, or t
tcagacgcgatcgacacgaccggtgctcgatttagatcgtctgtgttgggtttggggagagaggagccttagccctggactccaaggcctttccacttggtgaccagcactgagcacagaggactcaccatggaattggggctgagctgggctttccttgttgcttattttagaaggtgtcaatgtgagatgaaagtggtggagtcgtgggganacgttggtccaggtccggggggtcctgagactctctgtacagcctcgtggacctcaccgttgagctaattagtggatcgaccgtgggtccgcgacggctccggaaggggtacgggcgtaggggaggtggggtacggaccaaacgaaagtaaaagcgaaaagtaggtaggggaacgtaaccggaaaagtaaacttagtaggtaggtacttcgttggtacggggtaaagggttccggttacaccactctaccaaagacgaacaaagtcgaaacctaaagtaactttcgtaacggttttacgtttttaaagggaaacttcgggaaacttaggttacgtaggtaaacgtacgtaacccgggaaagtaacgtaaccgggtataaggttaattaacgtttacgacggaccgtaggaagtagaaacttggaaacttacgtaaccgttaaggggttagggggtaaagaacgtacgttaggttcggttaggtttacgtacgtcgg

SEQ ID NO: 311202 - DNA, 712 bp, Homo sapiens
  misc_feature: GZ8MTXP02JOST6.45.34.D01.1.454.CMB.2.raw
  modified_base (248)..(248): a, c, t, g, unknown or other
  misc_feature (248)..(248): n is a, c, g, or t
  modified_base (253)..(254): a, c, t, g, unknown or other
  misc_feature (253)..(254): n is a, c, g, or t
  modified_base (257)..(257): a, c, t, g, unknown or other
  misc_feature (257)..(257): n is a, c, g, or t
  modified_base (273)..(273): a, c, t, g, unknown or other
  misc_feature (273)..(273): n is a, c, g, or t
  modified_base (295)..(295): a, c, t, g, unknown or other
  misc_feature (295)..(295): n is a, c, g, or t
tcagacgcgatcgacacgaccggtgctcgatttagatcgtctgtgttgggtttgggggagtcagacccactcaggacacagcatggacatgagggtccccgctcagctcctggggctcctgctgctctggctcccaggtgccagatgtgccatccagatcgacccagtctccattcctccctgtctgcatctgtaggagacagtagttaccataacgttgcggcaagtcaggatatagaatgagtagntgtannagnagagacgacgggaccncccccatcctagtctagtggtntccgttaccgaggttaacgaaacggtcggggtaccaagtacgtaaggttcgacgggtacggggcgggttcgggtcgtgggaccacgtacgtaaacttccgtaaccttcaccgtacctacgtccgaccgcccgtccgtcgaccaccgggtacccgtaagtttactttacgaacccttaaactttacgttaccgttacggttacctaaacgtaaagtttaactttaaccgtaaaccgtttaccccgtaccggtaaacttaccggttacccgggaaaccgtaaacggggaacccctaaggttaccgttaagaaccggttaaactaaacccgtaaaacggtaacgttcggtaccggtacctacggtaacccaaaccgttacgtttccttaccgtttacccgtaacgtacccgtttcccccg

SEQ ID NO: 311203 - DNA, 709 bp, Homo sapiens
  misc_feature: GZ8MTXP02GYT5F.45.34.D01.1.454.CMB.2.raw
  modified_base (216)..(216): a, c, t, g, unknown or other
  misc_feature (216)..(216): n is a, c, g, or t
  modified_base (703)..(703): a, c, t, g, unknown or other
  misc_feature (703)..(703): n is a, c, g, or t
tcagacgcgatcgacacgaccggtgctcgatttagatcgtctgtgttgggtttggggagagaggagccttagccctggactccaaggcctttccacttggtgaccagcactgagcacagaggactcaccatggaattggggctgagctgggctttccttgttgctattttagaaggtgtccaatgtgagatagaaagtggtggagtcgtggggganacgttggtccgaggtccggggggtcctgagactctcctgtacagcctctggactcaccttgagctaattagtggatcgaccgtgggtcccgccgaggcctaccgaagggggaacggggcgtggggagggtcggggtacggaccctaaaacgaaagtaaaacggacgaaaaggaggtagggggaaagtaacccggaaaaagtaactagtagggtaggaccttgttgggtagggaaacggggtttccggttaccaacctacgttcctacgaacgaagtaaacaaagtcgaaccctaaaaggtaaacttaccgttaagtttacgtttttaaagggaaaacgttagggtaaacgtacggttacgttaggaaacggtacgtaaccggaaaggtaacgtacgggacgtaaagttattaacgttacgtcggacgacggaagagtagtagaagtacgttacgaaggttgggggtaaagagtaactgtgttaggtntagtcg

SEQ ID NO: 311204 - DNA, 771 bp, Homo sapiens
  misc_feature: GZ8MTXP02GK307.45.34.D01.1.454.CMB.2.raw
  modified_base (226)..(226): a, c, t, g, unknown or other
  misc_feature (226)..(226): n is a, c, g, or t
  modified_base (251)..(251): a, c, t, g, unknown or other
  misc_feature (251)..(251): n is a, c, g, or t
  modified_base (261)..(261): a, c, t, g, unknown or other
  misc_feature (261)..(261): n is a, c, g, or t
  modified_base (278)..(278): a, c, t, g, unknown or other
  misc_feature (278)..(278): n is a, c, g, or t
tcagacgcgatcgacacgaccggtgctcgatttagatcgtctgtgttgggtttgggggcaggagtcagacccactcaggacacagcatggacatgagggtccccgctcagctcctggggctcctgctgctctggctcccaggtgccagatgtgccatccagatgacccagtctccattctccctgtctgcatctgtaggagacagagttaccataacttgccgggnaagtcaggatatagaatgagttagntggtatcagnagagacgagggggaccncccccaactcctagtcctagtggtcgtccttaccgtaaggttaacgaaacgggttccgggggtaccccaagttacggtaaacgggtttaccgagggttggggccggggttgggggttaccgttggggcctaaccgtaaggtaaaacgtttcctaaacccttcgttacccaaccctaacttacccgaaccggccccggtcccgttcggacccgaaccggtaacccccgggtaaagttaacgtttttacggaacccttaaacgtttaaactttaccttacggttaacttaaacgtaaacgttacttttaaaccgtaaacctttaaccccgtacggtaaaccgttacggtttccggaaaccgtaaaacgggggtaacccctaaaaggggtcctttagggaaaccgtaaacgttaacgaaaaaccggtaccgttaacggtgggtaacctacggtacctaaaccgtactttaccggtttacgtttacccttttacccg

SEQ ID NO: 311205 - DNA, 651 bp, Homo sapiens
  misc_feature: GZ8MTXP02HOF2H.45.34.D01.1.454.CMB.2.raw
  modified_base (203)..(203): a, c, t, g, unknown or other
  misc_feature (203)..(203): n is a, c, g, or t
  modified_base (460)..(460): a, c, t, g, unknown or other
  misc_feature (460)..(460): n is a, c, g, or t
tcagacgcgatcgacacgaccggtgctcgatttagatcgtctgtgttggggtttggggaggagtcagacccactcaggacacagcatggacatgagggtcccccgctcagctcctggggctcctgctgctctggctcccaggtgccagatgtgccatccagatcgacccagtctccattcctccctgtctgcatctgtagganacagtattaccataacgttggccgggacaagtcaggtataagttaagaaatggtaggttaggcgtggtatgagcaggacgaccggaacggggacccaccccccaactccgtagtctagtggtcgtcttacgtaggttaaacgaagggttccgggtaccaagtacgtaaggttcccgagggtcgggtcggggtcgggtcgtcgggacacgtaagtaacttccaccttcctaccaacctactacgaccgtcccgtcccnggacccgaacggtacccgtaagttactttacaacctttaaactttattaccgtattacttaaactaagttacttacgtaaacctttacccgacggtactaacgttccggaaccgtaacgggtacaaggttctagaagactaacgtaaacgacgtggtacgctaacgacctactcgtctcttacttcctacc

SEQ ID NO: 311206 - DNA, 631 bp, Homo sapiens
  misc_feature: GZ8MTXP02GBPOF.45.34.D01.1.454.CMB.2.raw
tcagacgcgatcgacacgaccggtgctcgatttagatcgtctgtgttgggtttggggagagaggagccttagccctggactccaaggcctttccacttggtgaccagcactgagcacagaggactcaccatggaattggggctgagctgggctttccttgttgctattttagaaggtgtccaatgtgagatgaaagtggtggagtcgtgggggagacttggtccagtccgggggggtccctgagactctcctgtacagcctctggactcaccttgagcaattattggatgaccgtgggtccgccgaggctccggaggggaaggggcgtgggaggtggggtcggaccaaacgaagtaaaagcgaaagagtaggggaagtacgaaaagactagtggtgactgtggtaggaagggtcggttacacctatcctaccagacgaacaagtcgaccaaagtatcgtaagtttcttttaggaaagttggactagtacgtagagtataccggaaagtacgtacggactaagtattacttacgtgtccggacgagagtagtagaacgttacggtaaccgtaaggggttagggggtaaagtaacggtaacttagttccggtttaggtttagtaacgtttcgg

SEQ ID NO: 311207 - DNA, 649 bp, Homo sapiens
  misc_feature: GZ8MTXP02GIDNS.45.34.D01.1.454.CMB.2.raw
  modified_base (197)..(197): a, c, t, g, unknown or other
  misc_feature (197)..(197): n is a, c, g, or t
  modified_base (224)..(224): a, c, t, g, unknown or other
  misc_feature (224)..(224): n is a, c, g, or t
  modified_base (361)..(361): a, c, t, g, unknown or other
  misc_feature (361)..(361): n is a, c, g, or t
tcagacgcgatcgacacgaccggtgctcgatttagatcgtctgtgttgggtttgggggagtcagacccactcaggacacagcatggacatgagggtccccgctcagctcctggggctcctgctgctctggctcccaggtgccagatgtgccatccagatgacccagtctccattctccctgtctgcatctgtagganacagagttaccattaacttgccggganaagtcaggatatagaaatgagttaggctggtatcagcagagaccgaggggacacccccgaatcctagtctagtggtgcttccgaggttacaaaggtcggggtcccatacgaaggttcacggtgggacggtgggtcgnggcgacagtaacttctaccttctcaaccgattccgacgtcccgtccgtcgaccgaacgaccccgggtaaagttactttttacggaaccttaaactttactttaaaccttcggttaaccttaaacctaaagtttaacctttacctaaaactttacccccgtacgggtaactacggtttaccggaacccgtaaaggggtaccaaaaggtccgttagaacgtacgttaacgaaaacgtaacttggacggtactgaacctacctacttcgtagttccttcgaactttccccg

SEQ ID NO: 311208 - DNA, 698 bp, Homo sapiens
  misc_feature: GZ8MTXP02G4CMA.45.34.D01.1.454.CMB.2.raw
tcagacgcgatcgacacgaccggtgctcgatttagatcgtctgtgttgggtttggggagagaggagccttagccctggactccaaggcctttccacttggtgaccagcactgagcacagaggactcaccatggaattggggctgagctgggctttccttgttgctattttagaaggtgtccaatgtgagatgaaagtggtggagtcgtgggggagacttgggtccagtccggggggtccctgagactctcctgtacagcctctggactcaccttgagcaattatggatcgaccgtgggtcccgcaggctccgaggggaagggctggagtgggtcggaccaacagtaaagcaaagagtaggggaataccggaaaagactagtaggtggaaccttcgtgggtaggtaaacgggggttccggttacaacctattaccgtaccgaaagacgaaactaaagtcgaacccaaaagtaactttaccgaagttttacgtttttaagggaaaattgggaaactaggtacgtagggaagtagtacccggaaagtaaacgtacgggtactaaaggttaacttaagttacgtacggacggtacggtaaggacggtaagtaggtaaacttacggttaaccgttaaagggttaaggggggtaacgaaaccgtacgttaaagttccggtttagggtttttacggagtttacgg

SEQ ID NO: 311209 - DNA, 708 bp, Homo sapiens
  misc_feature: GZ8MTXP02JWUU0.45.34.D01.1.454.CMB.2.raw
  modified_base (199)..(199): a, c, t, g, unknown or other
  misc_feature (199)..(199): n is a, c, g, or t
  modified_base (417)..(417): a, c, t, g, unknown or other
  misc_feature (417)..(417): n is a, c, g, or t
tcagacgcgatcgacacgaccggtgctcgatttagatcgtctgtgttgggtttgggggagtcagacccactcaggacacagcatggacatgagggtccccgctcagctcctggggctcctgctgctctggctcccaggtgccagatgtgccatccagatgacccagtcctccattcctccctgtctgcatctgtagganacagtacgttaccaattaacgttggccgggacaagtcgaggtattaattaagaaatggagttaggcgtggtatcagcaaggacgaccggaggggacccaccccccgtaatcctagtctagtggtcgtacttccgtaaggttaccgtaaacgggttcgggtacccaagttaccgtaaggttacgtagggttcggggcgggttgggtcgtggaccttaanacggtactactccttacaccgtaaccactacgacgtcccgtactacgccgacgggtaacccgtaagttacttttacgaacctttaatttaccgttaagtactacgttaaactaacgtacctttaactaccgtttaacccgtacgtaaccgttaccgttaccgggaaaccgtaacggggtaaccctaaagtccgtttaagaaccggtaaataaccggtaaaacgtcgttacggtacgaccgttacgaacgtaccgttacttccgttacgtttaccttaccgtacttaccccg

SEQ ID NO: 311210 - DNA, 535 bp, Homo sapiens
  misc_feature: GZ8MTXP02F9FFE.45.34.D01.1.454.CMB.2.raw
  modified_base (219)..(219): a, c, t, g, unknown or other
  misc_feature (219)..(219): n is a, c, g, or t
  modified_base (260)..(260): a, c, t, g, unknown or other
  misc_feature (260)..(260): n is a, c, g, or t
  modified_base (286)..(286): a, c, t, g, unknown or other
  misc_feature (286)..(286): n is a, c, g, or t
  modified_base (416)..(416): a, c, t, g, unknown or other
  misc_feature (416)..(416): n is a, c, g, or t
  modified_base (451)..(451): a, c, t, g, unknown or other
  misc_feature (451)..(451): n is a, c, g, or t
  modified_base (467)..(467): a, c, t, g, unknown or other
  misc_feature (467)..(467): n is a, c, g, or t
  modified_base (474)..(474): a, c, t, g, unknown or other
  misc_feature (474)..(474): n is a, c, g, or t
  modified_base (487)..(487): a, c, t, g, unknown or other
  misc_feature (487)..(487): n is a, c, g, or t
  modified_base (490)..(490): a, c, t, g, unknown or other
  misc_feature (490)..(490): n is a, c, g, or t
  modified_base (520)..(520): a, c, t, g, unknown or other
  misc_feature (520)..(520): n is a, c, g, or t
tcagacgcgatcgacacgaccggtgctcgatttagatcgtctgtgttgggtttgaggtctcagagaggagccttagccctggactccaaggcctttccacttggtgaccagcactgagcacagaggactcaccatggaattggggctgagctgggctttccttgttgctattttagaaggtgtccaatgtgagatgaaagtggtggagtcgtggggganacttggtccagtccgggggggtcctgagactctcctgtacngcctctggactcaccttgagcaattntggatgacctgggtccgcaggctcgaggggagggctgggagtgggtggccaaacagtaaagcaaagagtggggagtacgaaaagactagtgtggactcgtgtaggaagggttcggtacacatctccaganacatgaccaagattcagttcgtttaggaatggacngtctagagatacgaangtacggnagtatatctgcgnganagatgatacgtaacgtaaggtgggggtaanagtacgtagtgttgg

SEQ ID NO: 311211 - DNA, 538 bp, Homo sapiens
  misc_feature: GZ8MTXP02JNHC4.45.34.D01.1.454.CMB.2.raw
  modified_base (277)..(277): a, c, t, g, unknown or other
  misc_feature (277)..(277): n is a, c, g, or t
  modified_base (390)..(390): a, c, t, g, unknown or other
  misc_feature (390)..(390): n is a, c, g, or t
  modified_base (493)..(493): a, c, t, g, unknown or other
  misc_feature (493)..(493): n is a, c, g, or t
  modified_base (527)..(527): a, c, t, g, unknown or other
  misc_feature (527)..(527): n is a, c, g, or t
tcagacgcgatcgacacgaccggtgctcgatttagatcgtctgtgttgggtttgggggcaggagtcagacccactcaggacacagcatggacatgagggtccccgctcagctcctggggctcctgctgctctggctcccaggtgccagatgtgccatccagatgacccagtctccattctcctgtctgcatctgtaggagacagagttaccataacttgccggtcaagtcaggatattagaatgagttagctggtatcagcagagacgtaggggacncccccaaatcctagctatggcgtcttccgaggttacaaaggtggggtccctatcgaacgttcagtggcggtggtactgggcacacgtattcgactcacaccatcacgccgccncgcacgaccgtaagtacgtttcgactactttactactagtactaactattactttacaacgttacccgacgtactacgtaccgacgaacggactacgtcgtanacgtactaacgaacgtactgacgctacgacactntctcgtactcg

SEQ ID NO: 311212 - DNA, 702 bp, Homo sapiens
  misc_feature: GZ8MTXP02F3P9A.45.34.D01.1.454.CMB.2.raw
  modified_base (206)..(206): a, c, t, g, unknown or other
  misc_feature (206)..(206): n is a, c, g, or t
  modified_base (240)..(240): a, c, t, g, unknown or other
  misc_feature (240)..(240): n is a, c, g, or t
  modified_base (259)..(259): a, c, t, g, unknown or other
  misc_feature (259)..(259): n is a, c, g, or t
  modified_base (264)..(265): a, c, t, g, unknown or other
  misc_feature (264)..(265): n is a, c, g, or t
  modified_base (267)..(268): a, c, t, g, unknown or other
  misc_feature (267)..(268): n is a, c, g, or t
tcagacgcgatcgacacgaccggtgctcgatttagatcgtctgtgttgggtttgggggcaggagtcagacccactcaggacacagcatggacatgagggtccccgctcagctcctggggctcctgctgctctggctcccaggtgccagatgtgccatccagatcgacccagtcctccattcctccctgtctgcatctaggtagganacagtacgttaccaatacttggccgggacaagtnaggattatagaatgagtgntgtannannagagaccgaggggaccacccccatctagtctagtgtcgcttaccgaggttaacgtaaacggtccgggtaccagtcgtaacggttcagggtggtcgggttggtcctgggctaacaagtacttaccactctaccgaactactccgaccgcccgacctcggacccgtaccggtacccgtaaagtttactttacgaaaccttaactttacttacggttcttaacgtaactaacggtttactttaccctaaacccgtttacccgtaccggtaaacgttacccggttaccgggaaccgtaaaacggggtaccccgtaaggttaccgtttacgggaaacgtaaacgttaaacccgaaaacgttacccggttaggtaacccggtcttaacccggacccgtaaacccgttacgtttaccctttcggttaacccctttacccgg

SEQ ID NO: 311213 - DNA, 720 bp, Homo sapiens
  misc_feature: GZ8MTXP02HO6RC.45.34.D01.1.454.CMB.2.raw
tcagacgcgatcgacacgaccggtgctcgatttagatcgtctgtgttgggtttgaggtctcagagaggagccttagccctggactccaaggcctttccacttggtgacccagcactgagcacagaggactcaccatggaattggggctgagctgggctttccttgttgctattttagaaggtgtccaatgtgagatgaaagtggtggagtcgtgggggagacgtttggtccagtccgggggggtccctggagactctctgtacagcctctggactcaccttgagctaattagtggatcgaccgtcgggtccgccgaggtcctaccggaaggggaaggggtcgtggggaggttcggggtcggaaccaaacgtaaagtaaaaggacgaaaggaaggtaggggaagtacggaaaaagtacttagtggtcggtacttgtagtagggtaacgggttcggtacaccgtattaccgaaaccgaaagactaaagacgtaaccaaaggttaacttacgtaaacgttttacgtttttaaaggaaaagttacggaaacgtagttacgttaggaaggtaaccttaaccgggaaaagtaacgtaaccgggtactaaaggttaataacgtttaacccgaggaaccggtggaaagtaggaacgtaagtaacgttaacgttaacggtaaggggttgggggtaaatacgaacgttacgttacggttttaggtttacg

SEQ ID NO: 311214 - DNA, 592 bp, Homo sapiens
  misc_feature: GZ8MTXP02JVC4R.45.34.D01.1.454.CMB.2.raw
  modified_base (318)..(318): a, c, t, g, unknown or other
  misc_feature (318)..(318): n is a, c, g, or t
  modified_base (391)..(391): a, c, t, g, unknown or other
  misc_feature (391)..(391): n is a, c, g, or t
  modified_base (396)..(396): a, c, t, g, unknown or other
  misc_feature (396)..(396): n is a, c, g, or t
  modified_base (402)..(402): a, c, t, g, unknown or other
  misc_feature (402)..(402): n is a, c, g, or t
tcagacgcgatcgacacgaccggtgctcgatttagatcgtctgtgttgggtttgggggcaggagtcagacccactcaggacacagcatggacatgagggtccccgctcagctcctggggctcctgctgctctggctcccaggtgccagatgtgccatccagatgacccagtctccattcctccctgtctgcatctgtaggagtaccaggtacgttaccaataacttggccgggacaagtcaaggtatataagaaatgagttagctaggatcagcaggacgaccgaggggaccacccccaaagtctagtctagtggtcncttcgaaggttaacgaagtcgggtaccagtacgaagttcgaggtggcgtggctgcacgagtatcgatctcacntcacnccgctnacacgaccgtatacgtttcacttaacttataactgttacctaagaattactttccaacttacccgtaggaacttgtacccgggacgtaaacggaacctagtcgttaagaacgtaaactaacggtaaaaccgtgtaaggtccggaaccgtactaacccggtataaccctttggtaccgttactttaccccg

SEQ ID NO: 311215 - DNA, 666 bp, Homo sapiens
  misc_feature: GZ8MTXP02IE98U.45.34.D01.1.454.CMB.2.raw
  modified_base (351)..(351): a, c, t, g, unknown or other
  misc_feature (351)..(351): n is a, c, g, or t
  modified_base (588)..(588): a, c, t, g, unknown or other
  misc_feature (588)..(588): n is a, c, g, or t
  modified_base (638)..(638): a, c, t, g, unknown or other
  misc_feature (638)..(638): n is a, c, g, or t
tcagacgcgatcgacacgaccggtgctcgatttagatcgtctgtgttgggtttggggagagaggagccttagccctggactccaaggcctttccacttggtgaccagcactgagcacagaggactcaccatggaattgggctgagctgggctttccttgttgctatttagaaggtgtcaatgtgagatgaaagtggtggagtcgtgggggagacttggtccgaggtccggggggtcctgagactctcctgtacagtcctctcggactcaccttgagactaattagtggatcgaccgtggtccgccgaggcctaccggaggggagggcgtgggaggtggggtcggaccaaanaagtaaagacaaagagtggggaataaccggaaaagtaacgtaagtggtacggacttcgtgggtagggtaaacggggttccggttacaccgtaacgtcctaaccgagacgaactaaactcggaacctaaagtaactttcgtaagttttacgtttaagggaaaacttggaaccgttagtaccgtaggtaaagtacgtaccggaaatacggttaccggattaagttaacttaattaccgnggaccgtagaagagtataggtaacgttacgtacgtaaggtggggtaaacngtaactgtacgttaggttagtacttcgg

SEQ ID NO: 311216 - DNA, 625 bp, Homo sapiens
  misc_feature: GZ8MTXP02IESI2.45.34.D01.1.454.CMB.2.raw
  modified_base (438)..(438): a, c, t, g, unknown or other
  misc_feature (438)..(438): n is a, c, g, or t
tcagacgcgatcgacacgaccggtgctcgatttagatcgtctgtgttgggtttggggagagaggagccttagccctggactccaaggcctttccacttggtgaccagcactgagcacagaggactcaccatggaattggggctgagctgggcttttccttgttgctattttagaaggtgtccaatgtgagatgaaagtggtggagtcgtgggggagacgttggtccaggtcccgggggggtccctgagactctcctgtacagcctctgactcaccttgagcaattatggatgaccgtgggtccgcaggctccgaggggaagggctgggagtgggtggaccaaacgataaagcaaaggagtaggggagtaacgaaaagactatgtggacttcgtggtaggaaggggtccgttaccaccgtatcctaccagagaactaancgaccaaagtaacttcgtagtttacgttttaggaaagtggaactagtcgtagaagtacgtacggaaagagtaacgactaagttactacttaagtcgacgacgaaggagtactggaaacttacgtaaccgttaaaggtagggggtaagtaacgtaacgtagttacggttaggtttacgtaagtttcgg

SEQ ID NO: 311217 - DNA, 582 bp, Homo sapiens
  misc_feature: GZ8MTXP02FYDFF.45.34.D01.1.454.CMB.2.raw
  modified_base (300)..(300): a, c, t, g, unknown or other
  misc_feature (300)..(300): n is a, c, g, or t
  modified_base (336)..(336): a, c, t, g, unknown or other
  misc_feature (336)..(336): n is a, c, g, or t
tcagacgcgatcgacacgaccggtgctcgatttagatcgtctgtgttgggtttggggagagaggagccttagccctggactccaaggcctttccacttggtgaccagcactgagcacagaggactcaccatggaattggggctgagctgggctttccttgttgctattttagaaggtgtccaatgtgagatgaaagtggtggagtcgtgggggagacttggtccagtccgggggggtccctgagactctcctgtacagcctctggactcaccttgagcaattatggatgacctgggtccncaggctccgaggggagggctggagtgggtggccaanataaagcaaagatggggataccgaaagactagtgtggacttcgtggtagaaaggggttcggttacacctatcctccagagacaatagaccaaagattctagtttctttttaggaaactggaactagtactgagataccggaaagacgtacggctaagttatattactgacgtcggaagagtatagaagttacgtaccgtaaggttggggggtaagaaggactagttacgttggtttagagtttcgg

SEQ ID NO: 311218 - DNA, 610 bp, Homo sapiens
  misc_feature: GZ8MTXP02JHN3T.45.34.D01.1.454.CMB.2.raw
  modified_base (219)..(219): a, c, t, g, unknown or other
  misc_feature (219)..(219): n is a, c, g, or t
  modified_base (266)..(266): a, c, t, g, unknown or other
  misc_feature (266)..(266): n is a, c, g, or t
  modified_base (310)..(310): a, c, t, g, unknown or other
  misc_feature (310)..(310): n is a, c, g, or t
  modified_base (353)..(353): a, c, t, g, unknown or other
  misc_feature (353)..(353): n is a, c, g, or t
  modified_base (384)..(384): a, c, t, g, unknown or other
  misc_feature (384)..(384): n is a, c, g, or t
  modified_base (547)..(547): a, c, t, g, unknown or other
  misc_feature (547)..(547): n is a, c, g, or t
tcagacgcgatcgacacgaccggtgctcgatttagatcgtctgtgttgggtttgaggtctcagagaggagccttagccctggactccaaggcctttccacttggtgaccagcactgagcacagaggactcaccatggaattggggctgagctgggctttccttgttgctattttagaaggtgtccaatgtgagatgaaagtggtggagtcgtggggganacgttggtccgaggtcccgggggggtccctggagactctcctgtacngcctctggactcaccttgagcaattattggatgacctggtcccncaggctccgaggggaagggctgggagtggggtggccaaacganaaagcaaagagtgggagtacgaaaagactangtgggactcgtagtaggaaggggtcgtttacaccgtatctaccagacgaacaaagtcgacccaaagtaacgttactaagtttcgtttttaaggaaacgttaggtaactagtcgtaggagtacgttaccgaaagtacgtacggactagtaagtatttaaccggngacggacgagtagtacgtagagtacgtaacgtaaggtagggtacgtagtacgtagtacgttgg

SEQ ID NO: 311219 - DNA, 598 bp, Homo sapiens
  misc_feature: GZ8MTXP02FOPBB.45.34.D01.1.454.CMB.2.raw
tcagacgcgatcgacacgaccggtgctcgatttagatcgtctgtgttgggtttggggagagaggagccttagccctggactccaaggcctttccacttggtgaccagcactgagcacagaggactcaccatggaattggggctgagctgggctttccttgttgctattttagaaggtgtccaatgtgagatgaaagtggtggagtcgtgggggatacttgggtccaggtcccgggggggtccctggacgactctcctgtacagcctctggactcaccttgagcaattatggatgaccgtggtccgcaggctccgaggggaagggctggaggtggggtgacccaaacagtaaagcgaaagagtaggggagtaccgaaaagtactagtgtgactgtggagaaggggtcgtacacgtatctaccagagacaagtacgaccaaagtaactctaagtttcgtttttaggaaataggaactagtacgtagaacgtacgtaccggaaagacgtaccggatagttaataattacgtgacgacgaagagtatagtaactacgtacgtaaggtaggggtaagacgatacgttgttaggttgagtttcg

SEQ ID NO: 311220 - DNA, 736 bp, Homo sapiens
  misc_feature: GZ8MTXP02HVIYQ.45.34.D01.1.454.CMB.2.raw
  modified_base (227)..(227): a, c, t, g, unknown or other
  misc_feature (227)..(227): n is a, c, g, or t
  modified_base (306)..(306): a, c, t, g, unknown or other
  misc_feature (306)..(306): n is a, c, g, or t
tcagacgcgatcgacacgaccggtgctcgatttagatcgtctgtgttgggtttgggggcaggagtcagacccactcaggacacagcatggacatgagggtccccgctcagctcctggggctcctgctgctctggctcccaggtgccagatgtgccatccagatgacccagtctccattctccctgtctgcatctgtaggagacagtagttaccataacttgccgganaagtcaggatattaagaatgtagttagctgtatcagacagacgaccgaggggaccacccccaatcctagtctagtggtnccttacgaggttaacaaaggtcgggtacccaagtacgtaacggtcgaggtcgggacgggttgggtccgtggcctaagtaagtaaacttccgaaccttcacctaaccactaccgaacggtcccgtccgtacggacccgtaacggacccccgttaaaagttacgttttaccgaaccttaaactttaaacgtttacccgtttaagttaacctttaaaacgtaacgtttaaacttttaacccttaaaaccgtttaccccgtacggtaaaccttacggttacccgggaaaccgtaaaacgggggtaaaccctaaagggtaccgtttaaggaaacgtaaaccgttaaaaccgaaaacggttaaccgtttagggtaacggtccgttacggaacccgttaaccgtacgtttaccctttacgtttacccgtttaacccg

SEQ ID NO: 311221 - DNA, 621 bp, Homo sapiens
  misc_feature: GZ8MTXP02F1JVV.45.34.D01.1.454.CMB.2.raw
  modified_base (227)..(227): a, c, t, g, unknown or other
  misc_feature (227)..(227): n is a, c, g, or t
  modified_base (232)..(232): a, c, t, g, unknown or other
  misc_feature (232)..(232): n is a, c, g, or t
  modified_base (249)..(249): a, c, t, g, unknown or other
  misc_feature (249)..(249): n is a, c, g, or t
  modified_base (255)..(255): a, c, t, g, unknown or other
  misc_feature (255)..(255): n is a, c, g, or t
  modified_base (276)..(276): a, c, t, g, unknown or other
  misc_feature (276)..(276): n is a, c, g, or t
tcagacgcgatcgacacgaccggtgctcgatttagatcgtctgtgttgggtttgggggcaggagtcagacccactcaggacacagcatggacatgagggtccccgctcagctcctggggcctcctgctgctctggctcccaggtgccagatgtgccatccagatgacccagtctccattcctccctgtctgcatctgtaggagacagacgttaccataactgccggnaagtnagatatagaatgagtgntgtatnagcagacgacggaggggaccncccccactcctagtctagtggtctcgttaccgaaggttaacgaaggtcgggtaccagtacgacggttcgtaggtcgggtacggttggcgtggtccacaacggtaattccactctacacccactcgacgcccgtactcgacgacgacccgtaagttactttacgaccttaactttaatacttacgtactaactaaagttactttaactaaccgttacccgtacggtaacttaccgtaccgggaaccgaaacgggtaacctaacggtacttacgaacgtaactaaaccgtaaaacgtacgtgttacggaaccttacggacctacgtattcctacgttacctttaccg

SEQ ID NO: 311222 - DNA, 550 bp, Homo sapiens
  misc_feature: GZ8MTXP02GOALC.45.34.D01.1.454.CMB.2.raw
  modified_base (215)..(215): a, c, t, g, unknown or other
  misc_feature (215)..(215): n is a, c, g, or t
  modified_base (285)..(285): a, c, t, g, unknown or other
  misc_feature (285)..(285): n is a, c, g, or t
  modified_base (352)..(352): a, c, t, g, unknown or other
  misc_feature (352)..(352): n is a, c, g, or t
  modified_base (462)..(462): a, c, t, g, unknown or other
  misc_feature (462)..(462): n is a, c, g, or t
  modified_base (472)..(472): a, c, t, g, unknown or other
  misc_feature (472)..(472): n is a, c, g, or t
  modified_base (482)..(482): a, c, t, g, unknown or other
  misc_feature (482)..(482): n is a, c, g, or t
  modified_base (494)..(494): a, c, t, g, unknown or other
  misc_feature (494)..(494): n is a, c, g, or t
  modified_base (532)..(532): a, c, t, g, unknown or other
  misc_feature (532)..(532): n is a, c, g, or t
tcagacgcgatcgacacgaccggtgctcgatttagatcgtctgtgttgggtttggggagagaggagccttagccctggactccaaggcctttccacttggtgaccagcactgagcacagaggactcaccatggaattggggctgagctgggctttccttgttgctattttagaaggtgtccaatgtgagatgaaagtggtggagtcgtggggganacttggtccagtccgggggggtccctggagactctcctgtacagcctctggactcaccttgagctaattntggatgaccgtggccgcagctccgaggggaagggctggaggtgggtcgaccaaacataaagcaaagngagggataccgaaaagactatgtgactcgtgtggaagggtcgtacacatctcagacgacatagacaaagtacttctagtttacgttttagaaagtggaactagtctaganacgtacgaanacgtacgganagtatattacgngcgacgagagagtagactacgtacgtaggtagggtaanagactcgtgtgtagtctg

SEQ ID NO: 311223 - DNA, 823 bp, Homo sapiens
  misc_feature: GZ8MTXP02J0BCU.45.34.D01.1.454.CMB.2.raw
  modified_base (272)..(272): a, c, t, g, unknown or other
  misc_feature (272)..(272): n is a, c, g, or t
  modified_base (325)..(325): a, c, t, g, unknown or other
  misc_feature (325)..(325): n is a, c, g, or t
  modified_base (353)..(353): a, c, t, g, unknown or other
  misc_feature (353)..(353): n is a, c, g, or t
  modified_base (371)..(371): a, c, t, g, unknown or other
  misc_feature (371)..(371): n is a, c, g, or t
tcagacgcgatcgacacgaccggtgctcgatttagatcgtctgtgttgggtttggggagagaggagccttagccctggactccaaggcctttccacttggtgaccagcactgagcacagaggactcaccatggaattggggctgagctgggtcttttccttgttgcttattttagaaggtgtccaatgtgagatagaaagtggtggagtcgtgggggagtacgttgggtccgacggtcccgggggggtccctggacgtactcctcctgtacncgtcctcgtggacctctaccttgagctaattattggatcgaccgtgggtcccncgaggcctccgaggggagggcgtagggnggtggggtcgacccaaanaagtaaacgcaaagagtaggggataccggaaaagtactagtggtcggactcgtggtaggtaacggggttccgttacaccctatcccgtaccgaagaacgtaacccaaagttacggaacccaaaagggttaactttaccgtaaaggtttttaccggttttttaaaaggggaaaacgtttacggggtaaacccgttaaggtttacccgttaaggggaaccgttaaccggttaacccgggaaaaggtaaccgttaaccggggaccgttaaaaggtttacttaaaccgttttaacgcggggtaccggtaacgggaaacggtaaaggtaacggtaaggttaaacggttaacccgggttaaaccgtttaaaaggggggttaagggggggttaaaacgtaaaacgggttaacgttaacgggttttacgggtttacggggtttaacggttacgtttacgg

SEQ ID NO: 311224 - DNA, 568 bp, Homo sapiens
  misc_feature: GZ8MTXP02GH8RT.45.34.D01.1.454.CMB.2.raw
  modified_base (202)..(202): a, c, t, g, unknown or other
  misc_feature (202)..(202): n is a, c, g, or t
  modified_base (225)..(225): a, c, t, g, unknown or other
  misc_feature (225)..(225): n is a, c, g, or t
  modified_base (258)..(258): a, c, t, g, unknown or other
  misc_feature (258)..(258): n is a, c, g, or t
  modified_base (276)..(276): a, c, t, g, unknown or other
  misc_feature (276)..(276): n is a, c, g, or t
  modified_base (389)..(389): a, c, t, g, unknown or other
  misc_feature (389)..(389): n is a, c, g, or t
  modified_base (557)..(557): a, c, t, g, unknown or other
  misc_feature (557)..(557): n is a, c, g, or t
tcagacgcgatcgacacgaccggtgctcgatttagatcgtctgtgttgggtttgggggcaggagtcagacccactcaggacacagcatggacatgagggtccccgctcagctcctggggctcctgctgctctggctcccaggtgccagatgtgccatccagatgacccagtctccattcctccctgtctgcatctgtagganacagacgttacataactgccggnagtcaggatataagaatgagtagctgtatcgancagagaccgaggggaccncccccaatcctatctagtggtcgtcttaccgaaggttacgaaagggtcgggacctaagtctaacggttcaggtgggcgggttggtctgggcacgagtaacttcactctacacntcacggcccacgtgcaacgcccgtaaagttcgtttcaaccttaatttaacttacgtcgttaactaacgtaattactttacgaaacttccgacgtactactccggaacgaacggtacaagtcgttaagacgtaactaacaaaacgtactgtacgcgtacaccaaacctnttctactctac

SEQ ID NO: 311225 - DNA, 749 bp, Homo sapiens
  misc_feature: GZ8MTXP02HS83L.45.34.D01.1.454.CMB.2.raw
tcagacgcgatcgacacgaccggtgctcgatttagatcgtctgtgttgggtttggggagagaggagccttagccctggactccaaggcctttccacttggtgaccagcactgagcacagaggactcaccatggaattggggctgagctgggcttttccttgttgctattttagaaggtgtcaatgtgagatgaaagtggtggagtcgtggggagacttggtccagtccggggggtcctgagactctcctgtacacgcctctggacctcaaccttgagactaattagttggatcgaccgtcgggtcccgccgaggcctaccggagggggtaaggggcgtagggtaggtggggtacggacccaaaagaaagtaaaacggacgaaaaggtaggtaggggtaacgttaaccggaaaaacggtaacttagtagggtacgggaaccttgttggggtaggtaaacggggttcggtttacccaaccgtagtacctaccgaaaggaactaaaccaagtacgaaccgtaaagtaaattacgttaacgtttacgttttaaggttaaagtaacggtaacgtaagttagttagtaagtacgtaccgtaaagtaagtaacggtacgtaaggttaagttaattaacgttaacgggtacggtacggtaaggtaagtaacgtaagttaacggttacggttaacggttaaggtaaggggtaaggtaacgtaacgtacgttacggtttacggtttacggttacgttcg

SEQ ID NO: 311226 - DNA, 644 bp, Homo sapiens
  misc_feature: GZ8MTXP02ISD0T.45.34.D01.1.454.CMB.2.raw
tcagacgcgatcgacacgaccggtgctcgatttagatcgtctgtgttgggtttgggggaggagtcagacccactcaggacacagcatggacatgagggtccccgctcagctcctggggctcctgctgctctggcctcccaggtgccagatgtgccatccagatgacccagtctccattcctccctgtctgcatctgtaggagacagtaacgttaaccaattaacttcggccgggactaagtcaaggattaattagaaatgagttaggctggtatcagcagacgacgaggggaccaccccctaatccgtacgtctagtcggtcgtccttaccgaacgggtttaacgaaaggttccggggtacccagtacgtaaggttccgaggtggtcggtggtctcggacacgtaagtaacttccgaaccttccacgaacctactaccgacggtccccgtcacgactaaccggacccgtaaagttacttttacgacctaaactttattacttcgtactaaacgtagttactttacaaccttacccgtcggactacgttacggaccgtaaagggaccctaaggtcgttagacgtacgtaaaccaaacgtacgtacgtcggtactcgacacttaactcttacgttccttactaccg

SEQ ID NO: 311227 - DNA, 537 bp, Homo sapiens
  misc_feature: GZ8MTXP02JMN7X.45.34.D01.1.454.CMB.2.raw
  modified_base (210)..(210): a, c, t, g, unknown or other
  misc_feature (210)..(210): n is a, c, g, or t
  modified_base (295)..(295): a, c, t, g, unknown or other
  misc_feature (295)..(295): n is a, c, g, or t
  modified_base (347)..(347): a, c, t, g, unknown or other
  misc_feature (347)..(347): n is a, c, g, or t
  modified_base (368)..(368): a, c, t, g, unknown or other
  misc_feature (368)..(368): n is a, c, g, or t
  modified_base (437)..(437): a, c, t, g, unknown or other
  misc_feature (437)..(437): n is a, c, g, or t
  modified_base (441)..(441): a, c, t, g, unknown or other
  misc_feature (441)..(441): n is a, c, g, or t
  modified_base (444)..(444): a, c, t, g, unknown or other
  misc_feature (444)..(444): n is a, c, g, or t
  modified_base (449)..(449): a, c, t, g, unknown or other
  misc_feature (449)..(449): n is a, c, g, or t
  modified_base (478)..(478): a, c, t, g, unknown or other
  misc_feature (478)..(478): n is a, c, g, or t
  modified_base (488)..(488): a, c, t, g, unknown or other
  misc_feature (488)..(488): n is a, c, g, or t
  modified_base (533)..(533): a, c, t, g, unknown or other
  misc_feature (533)..(533): n is a, c, g, or t
tcagacgcgatcgacacgaccggtgctcgatttagatcgtctgtgttgggtttggggagagaggagccttagccctggactccaaggcctttccacttggtgaccagcactgagcacagaggactcaccatggaattggggctgagctgggctttcctgtgctattttagaaggtgtccaatgtgagatgaaagtggtgagtctgggganacttggtccagtccggggggtcctgagactctcctgtacagcctctggactcgaccttgagcaattattggatgacctgggtccncaggctccgaggggaagggctgggagtgggtggccaacgataaacgcaaagngtgggataccgaaagaactangtaggactctggtagaaggtcggttcaccgatctacagagacatgccaagtaatcagttctttagaaangacngtntgaantaccgaatcgtaacgctagtatattacgngagtcgagangtagacgtacgtacgtaggtagggaatagactacgtgtggttacngtcg

SEQ ID NO: 311228 - DNA, 550 bp, Homo sapiens
  misc_feature: GZ8MTXP02G378X.45.34.D01.1.454.CMB.2.raw
  modified_base (226)..(226): a, c, t, g, unknown or other
  misc_feature (226)..(226): n is a, c, g, or t
  modified_base (276)..(276): a, c, t, g, unknown or other
  misc_feature (276)..(276): n is a, c, g, or t
  modified_base (392)..(392): a, c, t, g, unknown or other
  misc_feature (392)..(392): n is a, c, g, or t
  modified_base (407)..(407): a, c, t, g, unknown or other
  misc_feature (407)..(407): n is a, c, g, or t
  modified_base (428)..(428): a, c, t, g, unknown or other
  misc_feature (428)..(428): n is a, c, g, or t
  modified_base (460)..(460): a, c, t, g, unknown or other
  misc_feature (460)..(460): n is a, c, g, or t
  modified_base (500)..(500): a, c, t, g, unknown or other
  misc_feature (500)..(500): n is a, c, g, or t
tcagacgcgatcgacacgaccggtgctcgatttagatcgtctgtgttgggtttgggggcaggagtcagacccactcaggacacagcatggacatgagggtccccgctcagctcctggggctcctgctgctctggctcccaggtgccagatgtgccatccagatgacccagtctccattctccctgtctgcatctgtaggagacagagttaccataacttgccgggnaagtcaggatatagaaatgagtaggctgtatcagcagagaccaggggganccccccaaatcctagtctaatggtagctttccaggtttacaaaaggtcggggtacccatcaaaggttcagtggcggtggggtctgggcacgaagaattcactctcaccatcagccnctgcacgaccaagtnttttgactaatttatacgttntacttaacaaagtatttacaaatttaccccgnggtaacatttcggaccaaaaggggacccaaaggcttaagngttaaacacaaacgaaacgtagtaggcgtcgacacctaatcttcgtactc

SEQ ID NO: 311229 - DNA, 596 bp, Homo sapiens
  misc_feature: GZ8MTXP02HO1IE.45.34.D01.1.454.CMB.2.raw
  modified_base (300)..(300): a, c, t, g, unknown or other
  misc_feature (300)..(300): n is a, c, g, or t
  modified_base (339)..(339): a, c, t, g, unknown or other
  misc_feature (339)..(339): n is a, c, g, or t
  modified_base (415)..(415): a, c, t, g, unknown or other
  misc_feature (415)..(415): n is a, c, g, or t
tcagacgcgatcgacacgaccggtgctcgatttagatcgtctgtgttgggtttggggagagaggagccttagccctggactccaaggcctttccacttggtgaccagcactgagcacagaggactcaccatggaattggggctgagctgggctttccttgttgctattttagaaggtgtccaatgtgagatgaaagtggtggagtcgtgggggagacttggtccagtccggggggtccctgagactctcctgtacagcctctggactcaccttgagctaattatggatgacctgggtccncacggctccgaggggagggctggaggtgggtggccaaanagtaaagcgaaagagtagggagtaccgaaaagaactagtaggtgtaactgtggtagaaggggttcgttccaaccgntccgtccagagacaatagaccaaagtaattctaagttcgtttttaggaaattggactagttctaggtagtacgtacggaaagaacgtacggacagttaattagttaactcgacgacggagaagatagattaacgtaccgtaaggtaggggtaagacgatacgtagttggtttgtagtttcg

SEQ ID NO: 311230 - DNA, 549 bp, Homo sapiens
  misc_feature: GZ8MTXP02FPKYA.45.34.D01.1.454.CMB.2.raw
  modified_base (214)..(214): a, c, t, g, unknown or other
  misc_feature (214)..(214): n is a, c, g, or t
  modified_base (300)..(300): a, c, t, g, unknown or other
  misc_feature (300)..(300): n is a, c, g, or t
tcagacgcgatcgacacgaccggtgctcgatttagatcgtctgtgttgggtttggggagagaggagccttagccctggactccaaggcctttccacttggtgaccagcactgagcacagaggactcaccatggaattggggctgagctgggctttccttgttgctattttagaaggtgtccaatgtgagatgaaagtggtggagtctggggganacttggtccagtccgggggggtccctgagactctcctgtacagcctctggactcaccttgagcaattattggatgacctgggtccncaggctccgagggaagggctggagtgggtggccaacataaagcaaagatgggataccgaaaagactatgtaggactcgtgtgaagggtcgttcacatctccagagacaatgaccaaagatctagttacttttaggaaatggatagtctagagataccgaaagacgtacggacagtataattaactggcgacgaagaggattagatacgtacctaagtgggggtaaagagactagtcgtggttagacgtg

SEQ ID NO: 311231 - DNA, 594 bp, Homo sapiens
  misc_feature: GZ8MTXP02HOW95.45.34.D01.1.454.CMB.2.raw
  modified_base (223)..(223): a, c, t, g, unknown or other
  misc_feature (223)..(223): n is a, c, g, or t
  modified_base (299)..(299): a, c, t, g, unknown or other
  misc_feature (299)..(299): n is a, c, g, or t
  modified_base (385)..(385): a, c, t, g, unknown or other
  misc_feature (385)..(385): n is a, c, g, or t
tcagacgcgatcgacacgaccggtgctcgatttagatcgtctgtgttgggtttgggggagtcagacccactcaggacacagcatggacatgagggtccccgctcagctcctggggctcctgctgctctggctcccaggtgccagatgtgccatccagatgacccagtctccattctccctgtctgcatctgtaggagacagagttaccataacgttgccgggnaagtcaggatatagaatgagtaggctggtatcagcagagacgagggggacaccccccaatcctaagtctatcggtnccgtttacagggttaacaaaggttcggggtaccccagtaccgtaaaggtttcaaggtggggtccgggtggggtccttgggaccaanacggtaaatttcaaccttctaccaccatccacgcccgctcgcacggcccgaagtactttgactaactttatactgtactaacaagttatttacaaactttacccacggtactagtttaccggacaaaggggtaacccaagtcttagacgtaatacaaaacgtaactcgtaggtcctaggaaccactacttctgttcctactacttcccg

SEQ ID NO: 311232 - DNA, 784 bp, Homo sapiens
  misc_feature: GZ8MTXP02GCFXH.45.34.D01.1.454.CMB.2.raw
  modified_base (224)..(224): a, c, t, g, unknown or other
  misc_feature (224)..(224): n is a, c, g, or t
  modified_base (248)..(248): a, c, t, g, unknown or other
  misc_feature (248)..(248): n is a, c, g, or t
  modified_base (275)..(275): a, c, t, g, unknown or other
  misc_feature (275)..(275): n is a, c, g, or t
tcagacgcgatcgacacgaccggtgctcgatttagatcgtctgtgttggggtttggggaggagtcagacccactcaggacacagcatggacatgagggtccccgctcagctcctggggctcctgctgctctggctcccaggtgccagatgtgccatccagatgacccagtctccattcctccctgtctgcatctgtaggagacagagttaccataactgccggnaagtcagatatagaatgagttagntggtatcagcagagaccgaggggaccncccccaactcctagtctagtggtcgtcttaccgaaggtttaacgaaacggttcggggttaccccaagttaccgaagggtttcccgaggttcggggtcggggttacggggttcgttaggggacacgtaagtaaactttccctaaccgttcctaccgtaaccaacgtcccgaacggcccccgtaccgttacggcccgaacgggtacccccggtaaagtttaaacgtttttcggtaacctaaaaacccttttaacgtttaaaccgttacggttaacccttaaaacgtaaaacgtttactttttacccgtaaaacctttacccccggttaacgggtaaccttaacggtttaacccggggaaccccggtaaaacggggtaccccgaaaaggttacccgtttaaaggacgttaaaacgttaaacgaaaaaccccggtaaacgttacgggtcggttacccaaggttaccccaaaacggtactttcccgtttaacggttccctttacctttaacccg

SEQ ID NO: 311233 - DNA, 735 bp, Homo sapiens
  misc_feature: GZ8MTXP02FRYDB.45.34.D01.1.454.CMB.2.raw
  modified_base (215)..(215): a, c, t, g, unknown or other
  misc_feature (215)..(215): n is a, c, g, or t
tcagacgcgatcgacacgaccggtgctcgatttagatcgtctgtgttgggtttggggagagaggagccttagccctggactccaaggcctttccacttggtgaccagcactgagcacagaggactcaccatggaattggggctgagcgtgggctttccttgtgctattttagaaggtgtccaatgtgagatgaaagtggtggagtcgtggggganacgttggtccaggtcccggggggtccctgagactctctgtacagcctctggactcaccttgagctaattattggatgaccgtgggtcccgccgaggctaccgaggggaacggggtctggggaggtggggtcggacccaaaacgaagtaaaaggcgaaaggagtaggggtaacgtaaccgaaaagaacttagtaggtacggaccttgtgggtagggaacgggggtttccggtttaccaacctagttaccgtacccgaaaggacgaaaccgtaatacggaacccgtaaaagtaaacttaccgttaaggttttacgttttttaaggggaaaattcgggttaaacgtaacgttccgtaaggtaacgtaacgttaccggaaaagtacgttaaccgggataagttaaactatttacgtagaccgaacggagtaagtagtaagacgtttacggttacgtaagggtttagggggtaaaacgacgggttaaactacggtttacggtttagggtttacgtagttttcggg

SEQ ID NO: 311234 - DNA, 783 bp, Homo sapiens
  misc_feature: GZ8MTXP02FPAF3.45.34.D01.1.454.CMB.2.raw
tcagacgcgatcgacacgaccggtgctcgatttagatcgtctgtgttgggtttggggagagaggagccttagccctggactccaaggcctttccacttggtgaccagcactgagcacagaggactcaccatggaattggggctgagctgggctttccttgttgctattttagaaggtgtccaatgtgagatagaaagtggtggagtcgtgggggagacgttggtccaggtccggggggtccctggagactctcctgtacagcctctggactcaccttgagctaattatggatgaccgtggccgcaggcctaccgaggggaacgggcgtggaggtgggtggacccaaacgataaaacggcaaaggagtaggggaacgtaccgaaaaacgtaacgtatagggtacggaacgttcgtgggtagggaacgggggttcggttaccacctatccgtaccgaagaacgaacaagtcgaacctaaaggtaacttaccgtaaggtttacgtttttaaggaaaagttcggtaaacgtagtacgttaggaacgtacgttaaccggaaagtaacgtaacccggggtactaagggtttaaacgttattttaaaccggtaggtaaccccgggtaacggtaaaagggaaacggttaacgttaaacgggtttaaagttaaacccggggtttaaacccggttaaaagggggttttaacggggggtaaaacggaaagggtaaacccgtttaacggtttacgggttttacgggtttaaaacgggttgtttttaaacccgggg

SEQ ID NO: 311235 - DNA, 586 bp, Homo sapiens
  misc_feature: GZ8MTXP02JN0W4.45.34.D01.1.454.CMB.2.raw
  modified_base (197)..(197): a, c, t, g, unknown or other
  misc_feature (197)..(197): n is a, c, g, or t
  modified_base (222)..(222): a, c, t, g, unknown or other
  misc_feature (222)..(222): n is a, c, g, or t
  modified_base (227)..(227): a, c, t, g, unknown or other
  misc_feature (227)..(227): n is a, c, g, or t
  modified_base (272)..(272): a, c, t, g, unknown or other
  misc_feature (272)..(272): n is a, c, g, or t
  modified_base (289)..(289): a, c, t, g, unknown or other
  misc_feature (289)..(289): n is a, c, g, or t
  modified_base (312)..(312): a, c, t, g, unknown or other
  misc_feature (312)..(312): n is a, c, g, or t
  modified_base (339)..(339): a, c, t, g, unknown or other
  misc_feature (339)..(339): n is a, c, g, or t
  modified_base (362)..(362): a, c, t, g, unknown or other
  misc_feature (362)..(362): n is a, c, g, or t
tcagacgcgatcgacacgaccggtgctcgatttagatcgtctgtgttgggtttgggggagtcagacccactcaggacacagcatggacatgagggtccccgctcagctcctggggctcctgctgctctggctcccaggtgccagatgtgccatccagatgacccagtctccattctccctgtctgcatctgtagganacagagttaccataacttgccgganaagtnagatatagaaatgagtagctggtatcagcagagaccgaggggacncccccaatctagtctangtgctcagtacaaagtgggccancaaggtcagtggcgtggtctggacacngaattcactctacacatacgacnccgactgacgacgacccgaagtactttagactaaaattacgttacctagtacctaagtaaagattttaccaaactttaacccacggtaacctagttacccggaactaaacggggtaaccaaaacgtacttacggaaggtaaactacccgaaaaaaggaccgttactaagggtctacggaacgttaaccccaattaccttaggtcccttttacgaactttccccg

SEQ ID NO: 311236 - DNA, 553 bp, Homo sapiens
  misc_feature: GZ8MTXP02ICDTC.45.34.D01.1.454.CMB.2.raw
  modified_base (197)..(197): a, c, t, g, unknown or other
  misc_feature (197)..(197): n is a, c, g, or t
  modified_base (219)..(219): a, c, t, g, unknown or other
  misc_feature (219)..(219): n is a, c, g, or t
  modified_base (270)..(270): a, c, t, g, unknown or other
  misc_feature (270)..(270): n is a, c, g, or t
  modified_base (383)..(383): a, c, t, g, unknown or other
  misc_feature (383)..(383): n is a, c, g, or t
  modified_base (385)..(385): a, c, t, g, unknown or other
  misc_feature (385)..(385): n is a, c, g, or t
  modified_base (393)..(393): a, c, t, g, unknown or other
  misc_feature (393)..(393): n is a, c, g, or t
tcagacgcgatcgacacgaccggtgctcgatttagatcgtctgtgttggggtttgggggagtcagacccactcaggacacagcatggacatgagggtccccgctcagctcctggggctcctgctgctctggctccaggtgccagatgtgccatccagatgacccagtctccattctccctgtctgcatctgtagganacagagttacataactgcgganaagtcagatattagaaatgagtaggctggatcagcagagaccgaggggacnccccccgaatcctagtctatggtcgcttaccgagttacaaaggtgggtacccagtctaaaggttcaggtcggcgggtggtctgggcaacgtagaactttcactctcgaccaancncgcgctcncgacgaccgtacgtattagtactaacttacttacttattactactaatacttactactacctacgtacgtacgtacgacgacggacgtagacgtacgagactaacgaaacgtaacgtacgtacgtacgacgtaacgactactctcgtcttactactaccg

SEQ ID NO: 311237 - DNA, 518 bp, Homo sapiens
  misc_feature: GZ8MTXP01EVGKP.25.36.D03.1.454.CMB.2.raw
  modified_base (228)..(228): a, c, t, g, unknown or other
  misc_feature (228)..(228): n is a, c, g, or t
  modified_base (243)..(243): a, c, t, g, unknown or other
  misc_feature (243)..(243): n is a, c, g, or t
  modified_base (305)..(305): a, c, t, g, unknown or other
  misc_feature (305)..(305): n is a, c, g, or t
tcagactgtacagtcacgaccggtgctcgatttagctgcgtcacgatctctcttgggggggtctcaggaggcagcgctctcgggacgtctccaccatggcctgggctctgctgttcctcaccctcctcactcagggcacagggtcctgggcccagtctgccctgactcagcctgcctccgtgtctgggactcctggacagtcggtcaccatctcctgcactggaaccngccgtgacattggtncttataactatgtctcctggtcccaacaacacccaggccaaggcccccaaatcatcatttangatgtcagtcatcggccctctggagtttcctggtcgcttctctggctccaagtctggcaactcggcctccctgaccatcgtcggggctccgaggctgacggacgaggctacttattattgtctatttcatacagagacacaacagtctggtgttcggcggagggaccaagttcgaccgttcttcggtcagccaaggcttcgccccgttggtcc

SEQ ID NO: 311238 - DNA, 537 bp, Homo sapiens
  misc_feature: GZ8MTXP01DC8KY.25.36.D03.1.454.CMB.2.raw
  modified_base (499)..(499): a, c, t, g, unknown or other
  misc_feature (499)..(499): n is a, c, g, or t
  modified_base (529)..(529): a, c, t, g, unknown or other
  misc_feature (529)..(529): n is a, c, g, or t
tcagactgtacagtcacgaccggtgctcgatttagctgcgtcacgatctctcttgggagatgggtcctgtcccagatgcacctgcaggagtcgggcccaggactggtgaagccttcggagaccctgtccctcacctgcagtgtctctggtggctccgtcagtgcttattactggagctggatccgccagtccgccgggagggactggagtggattgggcgtatatatacgaatggattaaccacctacaaccccctcctcaagagtcgagtcaccatatcagcggacacgtccagggatcaggtgtcctgcatctgacttctgcgactgccgcggacacggccctatacctaactgtgccagagattcgggactgcgacgtattttcggagtaattattatctttgtgtcttttgactagtgtgggccgaaggggacgacggtcaccgtctcgttcacgcctccaccaacgggcccaatcggttccttccccttggccncccttccttccagcgcaacctcgtggggcncgcgccgg

SEQ ID NO: 311239 - DNA, 529 bp, Homo sapiens
  misc_feature: GZ8MTXP01EXMVZ.25.36.D03.1.454.CMB.2.raw
  modified_base (235)..(235): a, c, t, g, unknown or other
  misc_feature (235)..(235): n is a, c, g, or t
  modified_base (330)..(330): a, c, t, g, unknown or other
  misc_feature (330)..(330): n is a, c, g, or t
  modified_base (340)..(340): a, c, t, g, unknown or other
  misc_feature (340)..(340): n is a, c, g, or t
  modified_base (371)..(371): a, c, t, g, unknown or other
  misc_feature (371)..(371): n is a, c, g, or t
  modified_base (482)..(482): a, c, t, g, unknown or other
  misc_feature (482)..(482): n is a, c, g, or t
  modified_base (517)..(517): a, c, t, g, unknown or other
  misc_feature (517)..(517): n is a, c, g, or t
tcagactgtacagtcacgaccggtgctcgatttagctgcgtcacgatctctcttggggagcttcagctgtggtagagaagacaggattcaggacaatctccagcatggccggcctccctctcctcctcaccctcctcactcactgtgcagggtcctgggcccagtctgtgctgactcagccaccctcagtgtctgggacccccgggcagagggtctccatctcttgttctgggancagctccgacgtcggaaatagttgtctactggtaccagcagctcccagaaaccggcccccaagctcctcatctataggaatgatcagcggccctnacgggatacngaccgattctctggctcgaagtctggctccncggccctcctggccatcagtcggctccggtcgaggatgaggctgggaattgttactgtgcgtagtttgggatggcctagtctggaagttcgggttccgaggttgttcgggngggaggccgaagctaggaacccgtcgtaggttccnggcccgaacggg

SEQ ID NO: 311240 - DNA, 500 bp, Homo sapiens
  misc_feature: GZ8MTXP01AVEDL.25.36.D03.1.454.CMB.2.raw
  modified_base (206)..(206): a, c, t, g, unknown or other
  misc_feature (206)..(206): n is a, c, g, or t
  modified_base (233)..(233): a, c, t, g, unknown or other
  misc_feature (233)..(233): n is a, c, g, or t
  modified_base (345)..(345): a, c, t, g, unknown or other
  misc_feature (345)..(345): n is a, c, g, or t
  modified_base (465)..(465): a, c, t, g, unknown or other
  misc_feature (465)..(465): n is a, c, g, or t
tcagactgtacagtcacgaccggtgctcgatttagctgcgtcacgatctctcttggggagcttcagctgtggtagagaagacaggattcaggacaatctccagcatggccggcctccctctcctcctcaccttcctcactcactgtgcagggtcctgggcccagtctgtgctgactcagccaccctcagtgtctgggacccccggnagagggtctccatctcttgtctgggancagctccgacgtcggaaataagttgtctactggtaccagcagctcccagaacggccccaagctcctcatctataggatgatcagcgccctcacgggatacctgaccgattcnctggctcgaagtctggctctcggccctcctggccatcagtggctcggtccgagatgagctggaatatactgtgcagtttgggatgcctagtctgaagtggttccgacggttgtcggcggngggccagctgaaccgtctaggttcaagcccgaagg

SEQ ID NO: 311241 - DNA, 583 bp, Homo sapiens
  misc_feature: GZ8MTXP01BDM17.25.36.D03.1.454.CMB.2.raw
  modified_base (208)..(208): a, c, t, g, unknown or other
  misc_feature (208)..(208): n is a, c, g, or t
  modified_base (234)..(234): a, c, t, g, unknown or other
  misc_feature (234)..(234): n is a, c, g, or t
  modified_base (345)..(345): a, c, t, g, unknown or other
  misc_feature (345)..(345): n is a, c, g, or t
  modified_base (349)..(349): a, c, t, g, unknown or other
  misc_feature (349)..(349): n is a, c, g, or t
tcagactgtacagtcacgaccggtgctcgatttagctgcgtcacgatctctcttggggagcttcagctgtggtagagaagacaggattcaggacaatctccagcatggccggcctccctctcctcctcaccctcctcactcactgtgcagggtcctgggcccagtctgtgctgactcagcccaccctcagtgtctcgggacccccggnagaggtctccatctcttgtctgggancagctccgacgtcgaaatagttgtctactggtaccagcagcctccccaagaaaccggcccccaagcctcctcatctataggatgatcagcgcctgacggactactgaccgnttcnctcggctacgaagtctggcctccgtcggccctccgtggcccagtcgaggttcgggcctccgggtccgaggatggagtctaggaattagttactgtgcgtagtttgggatcgtccgtagtccgtgaacgggttcggttaccggtcgggttggttccgggggacggacggggacccaaggtccgtacgggtaacccgttcccgttagggttacccgaacggttccccgtaaccggg

SEQ ID NO: 311242 - DNA, 513 bp, Homo sapiens
  misc_feature: GZ8MTXP01CHBGI.25.36.D03.1.454.CMB.2.raw
  modified_base (228)..(228): a, c, t, g, unknown or other
  misc_feature (228)..(228): n is a, c, g, or t
  modified_base (243)..(243): a, c, t, g, unknown or other
  misc_feature (243)..(243): n is a, c, g, or t
  modified_base (261)..(261): a, c, t, g, unknown or other
  misc_feature (261)..(261): n is a, c, g, or t
  modified_base (332)..(332): a, c, t, g, unknown or other
  misc_feature (332)..(332): n is a, c, g, or t
  modified_base (418)..(418): a, c, t, g, unknown or other
  misc_feature (418)..(418): n is a, c, g, or t
  modified_base (420)..(420): a, c, t, g, unknown or other
  misc_feature (420)..(420): n is a, c, g, or t
  modified_base (430)..(430): a, c, t, g, unknown or other
  misc_feature (430)..(430): n is a, c, g, or t
tcagactgtacagtcacgaccggtgctcgatttagctgcgtcacgatctctcttggggggggtctcaggaggcagcgctctcgggacgtctccaccatggcctgggctctgctgttcctcaccctcctcactcagggcacagggtcctgggcccagtctgccctgactcagcctgcctccgtgtctgggactcctggacagtcgtcaccatctcctgcactggaaccngccgtgacattggtncttataactatgtctccnggtcccaacaacacccaggcaaggcccccaaactcatcatttatgatgtcagtcatcgcctctgatttccnggtcgcttctctggctccaaagtctggcaactcggcctccctgaccatctcggggctcgagctgaggacaggctacttattagttntntatactatanagacacacacagtcgtgtgtcggcggacggacgtacgtacgcgttcgttcgtcgacgccgacgcgttccgtcccgttccgtcg

SEQ ID NO: 311243 - DNA, 577 bp, Homo sapiens
  misc_feature: GZ8MTXP01C4ZPR.25.36.D03.1.454.CMB.2.raw
  modified_base (235)..(235): a, c, t, g, unknown or other
  misc_feature (235)..(235): n is a, c, g, or t
  modified_base (348)..(348): a, c, t, g, unknown or other
  misc_feature (348)..(348): n is a, c, g, or t
  modified_base (361)..(361): a, c, t, g, unknown or other
  misc_feature (361)..(361): n is a, c, g, or t
  modified_base (411)..(411): a, c, t, g, unknown or other
  misc_feature (411)..(411): n is a, c, g, or t
  modified_base (427)..(427): a, c, t, g, unknown or other
  misc_feature (427)..(427): n is a, c, g, or t
tcagactgtacagtcacgaccggtgctcgatttagctgcgtcacgatctctcttggggagcttcagctgtggtagagaagacaggattcaggacaatctccagcatggccggcctccctctcctcctcaccctcctcactcactgtgcagggtcctgggcccagtctgtgctgactcagcccaccctcagtgtctcgggacccccggcagagggtctccatctcttgtctgggancagcctccgacgtcggaaatagttgtctactggtaccagcagctcccagaacgcccccaagctcctcatctataggatgatcagcgccctcgacggactactgaccgattccnctggctcgagtcnggctcctcggcctcctcggccatccaggtgggcctaccgggtccgaaggntgaggctagggaattnttactgtgcgtaggtttgggattcgccgagtctggaaggttcgggttcccggtacgggttggttccggggcggggaacggggcccaaaggtcccgttacgggaaccccggttcccgttaaggggttccctaaacggcccccgtaaacggg

SEQ ID NO: 311244 - DNA, 658 bp, Homo sapiens
  misc_feature: GZ8MTXP01CIYTC.25.36.D03.1.454.CMB.2.raw
  modified_base (229)..(229): a, c, t, g, unknown or other
  misc_feature (229)..(229): n is a, c, g, or t
  modified_base (246)..(246): a, c, t, g, unknown or other
  misc_feature (246)..(246): n is a, c, g, or t
tcagactgtacagtcacgaccggtgctcgatttagctgcgtcacgatctctcttggggggtctcaggaggcagcgctctcgggacgtctccaccatggcctgggctctgctgttcctcaccctcctcactcagggcacagggtcctgggcccagtctgccctgactcagcctgcctccgtgtctgggactcctggacagtcggtcaccatctcctgcactggaaacccngccgtgactagttggtntacttaataactatcgtctcctcgtaccaacaaccaccacgacaacgaccccaactcatctattatgatgtcagtcacgtccgtccctcgtggtacgtttccgtggtcgtcttctcgtcgtcctcctaagtcgtcggactaaccgtccgtccctcccgtacgacctacgtccggtccgggtcctaccgacggtcgtaggacggaacggtacgtacgttaacgtttaatttaacgttacgtactactttactaactaacgtaacgaacgaaccaaacctaaacctacgtacgttcggttcgggttacgggttacggggtaacgggaaccggtaaacggttacggttacccggttcccgttccggtaaccgtaccgaacccgaccggtaccgttcccgtccccgttcccgtccg

SEQ ID NO: 311245 - DNA, 552 bp, Homo sapiens
  misc_feature: GZ8MTXP01C8JJC.25.36.D03.1.454.CMB.2.raw
  modified_base (265)..(265): a, c, t, g, unknown or other
  misc_feature (265)..(265): n is a, c, g, or t
  modified_base (306)..(306): a, c, t, g, unknown or other
  misc_feature (306)..(306): n is a, c, g, or t
  modified_base (346)..(346): a, c, t, g, unknown or other
  misc_feature (346)..(346): n is a, c, g, or t
  modified_base (348)..(348): a, c, t, g, unknown or other
  misc_feature (348)..(348): n is a, c, g, or t
  modified_base (350)..(350): a, c, t, g, unknown or other
  misc_feature (350)..(350): n is a, c, g, or t
  modified_base (362)..(362): a, c, t, g, unknown or other
  misc_feature (362)..(362): n is a, c, g, or t
  modified_base (370)..(370): a, c, t, g, unknown or other
  misc_feature (370)..(370): n is a, c, g, or t
  modified_base (374)..(374): a, c, t, g, unknown or other
  misc_feature (374)..(374): n is a, c, g, or t
  modified_base (410)..(410): a, c, t, g, unknown or other
  misc_feature (410)..(410): n is a, c, g, or t
tcagactgtacagtcacgaccggtgctcgatttagctgcgtcacgatctctcttggggagctctgggagaggagcccagcactagaagtcggcggtgtttccattcggtgatcagcactgaacacagaggactcaccatggagtttgggctgagctgggttttcctcgttgctcttttaagaggtgtccactgtcaggtgcacctggtggagtcgtgggggagcgtggtccagcctgggagtccctgagctctctgtgaagcctntggatttagttcagtggttctggcatgcacgtggggtcccnccaggctccgagggcgaagggggccgagtggtgcagttangnantagatggtaatntagtaatntagngacagactcggagaacggcctatacacatcacaganactaacttaccgggaatgttgtagtactagaagtggtacagtctaggagtaggtaacggaggttaccgtcggcttacgtagttaacgttcgttggtcgacggtaaggacgggtacgggggttaggttgggttaaggttaacg

SEQ ID NO: 311246 - DNA, 525 bp, Homo sapiens
  misc_feature: GZ8MTXP01DR5US.25.36.D03.1.454.CMB.2.raw
  modified_base (227)..(227): a, c, t, g, unknown or other
  misc_feature (227)..(227): n is a, c, g, or t
  modified_base (243)..(243): a, c, t, g, unknown or other
  misc_feature (243)..(243): n is a, c, g, or t
  modified_base (446)..(446): a, c, t, g, unknown or other
  misc_feature (446)..(446): n is a, c, g, or t
tcagactgtacagtcacgaccggtgctcgatttagctgcgtcacgatctctcttgggggggtctcaggaggcagcgctctccggacgtctccaccatggcctgggctctgctgttcctcaccctcctcactcagggcacagggtcctgggcccagtctgccctgactcagcctgcctccgtgtctgggactcctggacagtcggtcaccatctctgcactggaaccngccgtgacattgggtncttataactatgtctcctggtcccaacaacacccaggcaacggcccccaaatcatcatttatgatgtcagtcatcggcccctctggacgtttcctggtcgcttctctcggctccaagtctggcactcggcctccctgaccatctcggggctccgaggctgagacgagctacgtattatgctatttcatacagagacacaaacngtctggtgttcggcggacgggaccaaaggttcgaccgttccttcggtcacgcccaagggccttcgtccccgttggtccc

SEQ ID NO: 311247 - DNA, 349 bp, Homo sapiens
  misc_feature: GZ8MTXP01BIIJN.25.36.D03.1.454.CMB.2.raw
  modified_base (320)..(320): a, c, t, g, unknown or other
  misc_feature (320)..(320): n is a, c, g, or t
  modified_base (348)..(349): a, c, t, g, unknown or other
  misc_feature (348)..(349): n is a, c, g, or t
tcagactgtacagtcacgaccggtgctcgatttagctgcgtcacgatctctcttgggagcagaagccagggaaagcccctgacctcctgatctataaggcgtccactttagaaagtggggtcccatcaaggttcagcggcagtggatctgggacagaattcactctcaccatcagcagcctgcagcctgatgattttgcaacttattactgccaacaatataataattattcgacctactttggccaggggaccaaggtggagatcaaacgaactgtggctgcaccatctgtcttcatcttcccgcatctgaactgtacngtctgagcgggctggcaaggcgacatgnn

SEQ ID NO: 311248 - DNA, 539 bp, Homo sapiens
  misc_feature: GZ8MTXP01ASZ8L.25.36.D03.1.454.CMB.2.raw
  modified_base (178)..(178): a, c, t, g, unknown or other
  misc_feature (178)..(178): n is a, c, g, or t
  modified_base (281)..(281): a, c, t, g, unknown or other
  misc_feature (281)..(281): n is a, c, g, or t
  modified_base (299)..(299): a, c, t, g, unknown or other
  misc_feature (299)..(299): n is a, c, g, or t
  modified_base (305)..(305): a, c, t, g, unknown or other
  misc_feature (305)..(305): n is a, c, g, or t
  modified_base (315)..(315): a, c, t, g, unknown or other
  misc_feature (315)..(315): n is a, c, g, or t
  modified_base (356)..(356): a, c, t, g, unknown or other
  misc_feature (356)..(356): n is a, c, g, or t
  modified_base (395)..(395): a, c, t, g, unknown or other
  misc_feature (395)..(395): n is a, c, g, or t
tcagactgtacagtcacgaccggtgctcgatttagctgcgtcacgatctctcttggggtgtgggctcagaagcagagttctggggtgtctccaccatggcctggacccctctctggctcactctcctcactctttgcataggttctgtggtttcttctgaactgactcaggaccccgntgtgtctgtggccttgggacagacagtcaggatcacatgccaaggagacagcctcagaacttattatgcatcctggaccagcagaagccgggacaggcccctntacttgtcttctacggtnaaaacncccgcccctnaggactctcagaccgattcctctggctccgctacaggaacncagccttcctgaccatccactggggctcgaggcgcaagntgacggctgactattacgtcggttccctcccgggacaccgagtggaagcgtaggttgtggtcgttcgggcggaacgggaccagggtcgaccgtcgtaggttcgcggcccaagggctcgccccgtcggttcctcgttcgtcccgg

SEQ ID NO: 311249 - DNA, 513 bp, Homo sapiens
  misc_feature: GZ8MTXP01ARK63.25.36.D03.1.454.CMB.2.raw
  modified_base (226)..(226): a, c, t, g, unknown or other
  misc_feature (226)..(226): n is a, c, g, or t
  modified_base (456)..(456): a, c, t, g, unknown or other
  misc_feature (456)..(456): n is a, c, g, or t
tcagactgtacagtcacgaccggtgctcgatttagctgcgtcacgatctctcttgggggtctcaggaggcagcgctctcgggacgtctccaccatggcctgggctctgctgttcctcaccctcctcactcagggcacagggtcctgggcccagtctgccctgactcagcctgcctccgtgtctgggactcctggacagtcggtcaccatctcctgcactggaaccngccgtgacattggtgcttataactatgtctcctggtcccaacaacacccaggccaaggcccccaaactcatcatttatgatgtcagtcatcggccctctggagtttcctggtcgcttctctggctccaagtctggcaactcggcctcctgaccatctcggggctcgaggctgaggacgagctacttattacttgctatttcatacagagacacaacagtctggtgtcggnggaggaccaagttcgaccgttcttcggtcacgccaaggccttccgtcccgttcgtcc

SEQ ID NO: 311250 - DNA, 566 bp, Homo sapiens
  misc_feature: GZ8MTXP01EAM0U.25.36.D03.1.454.CMB.2.raw
  modified_base (208)..(208): a, c, t, g, unknown or other
  misc_feature (208)..(208): n is a, c, g, or t
  modified_base (478)..(478): a, c, t, g, unknown or other
  misc_feature (478)..(478): n is a, c, g, or t
tcagactgtacagtcacgaccggtgctcgatttagctgcgtcacgatctctcttggggagcttcagctgtggtagagaagacaggattcaggacaatctccagcatggccagccttccctctcctcctcaccctcctcactcactgtgcagggtcctgggcccagtctgtggtgactcagccaccctcagcgtctcgggacccccggnagacggtcaccctctcttgttctggaagcagctaccaaatatcggaactaacactgtagaactggtaccagcaggtccccaggaactcggaccccctaaattctactatttatagtagttatcagccgaccctcgacggggtccctcgaccgtattctctggcctcaagtctggccacctcacgccctccctcgcctagtcgaggttcggggtaccagttctggaggatgaggtctggtctttagtacgtgcgcagcagtgggatggacngctaagtagttgggttcgttgggtttcggggcggttagggacgaggtcgtacgcccggttccgagggttccaacggccccgtaacggg

SEQ ID NO: 311251 - DNA, 533 bp, Homo sapiens
  misc_feature: GZ8MTXP01BEC0S.25.36.D03.1.454.CMB.2.raw
  modified_base (244)..(244): a, c, t, g, unknown or other
  misc_feature (244)..(244): n is a, c, g, or t
  modified_base (438)..(438): a, c, t, g, unknown or other
  misc_feature (438)..(438): n is a, c, g, or t
  modified_base (441)..(441): a, c, t, g, unknown or other
  misc_feature (441)..(441): n is a, c, g, or t
  modified_base (449)..(449): a, c, t, g, unknown or other
  misc_feature (449)..(449): n is a, c, g, or t
tcagactgtacagtcacgaccggtgctcgatttagctgcgtcacgatctctcttgggggggtctcaggaggcagcgctctcgggacgtctccaccatggcctgggctctgctgttcctcaccctcctcactcagggcacagggtcctgggcccagtctgccctgactcagcctgcctccgtgtctgggactcctggacagtcggtcaccatctcctgcactggaaccagccgtgacattgggtncttataactatgtctcctggtcccaacaacacccagcaacggcccccaaactcatcatttatgatgtcagtcatcggccctctggtagtttcctggttcgcttctctggctcaagtctggcactcgcctccctgaccatcgcgggcctcgaggctggacggacgaggtctacttattagttgctatttcatacnganacaccaanagtctggtgttcgggcggagggacctaaggtcggaccgttcgttcggtcacgcccgtaacggccttccgtccccgttgggtccc

SEQ ID NO: 311252 - DNA, 630 bp, Homo sapiens
  misc_feature: GZ8MTXP01D5JZM.25.36.D03.1.454.CMB.2.raw
  modified_base (243)..(243): a, c, t, g, unknown or other
  misc_feature (243)..(243): n is a, c, g, or t
tcagactgtacagtcacgaccggtgctcgatttagctgcgtcacgatctctcttggggggtctcaggaggcagcgctctcgggacgtctccaccatggcctgggctctgctgttcctcaccctcctcactcagggcacagggtcctgggcccagtctgccctgactcagcctgcctccgtgtctgggactcctggacagtcggtcaccatctcctgcactggaaccagccgtgacattgggtnacttataactatgtctcctcgtaccaacaacaccagacaacgaccccaaactcatctatttatagatgtcagtcacgtccgcctgtggtagtttccgtggtctcttctctgctcgaagtctggacacgtcggcctccctcgacctagtccgtcggggcctaccgacggtctaggacggacggaggtacttaacgtttaatttagtttcgtacttactttactaataactaacgaacgaaccaaacctaaactaacgttacgttcgggttcgggttcggggttacggggtaacggggttaaaccggtaaacggttacggttaccggttcccgttaccggtaaccgtaccgaacccgaacggtaccgttccgtccccgttcccggtccg

SEQ ID NO: 311253 - DNA, 527 bp, Homo sapiens
  misc_feature: GZ8MTXP01A8TN0.25.36.D03.1.454.CMB.2.raw
  modified_base (228)..(228): a, c, t, g, unknown or other
  misc_feature (228)..(228): n is a, c, g, or t
  modified_base (243)..(243): a, c, t, g, unknown or other
  misc_feature (243)..(243): n is a, c, g, or t
tcagactgtacagtcacgaccggtgctcgatttagctgcgtcacgatctctcttgggggggtctcaggaggcagcgctctcgggacgtctccaccatggcctgggctctgctgttcctcaccctcctcactcagggcacagggtcctgggcccagtctgccctgactcagcctgcctccgtgtctgggactcctggacagtcggtcaccatctcctgcactggaaccngccgtgacattggtncttataactatgtctcctgtcccaacaacaccaggcaacggccccaaactcatcatttatgatgtcagtcatcggccctctggagtttcctggtcgcttctctggctccaagtctggcaactcggcctccctgaccatcgtcgggctccaggctggaggacgagctagtttacttagttgctatttcaattacagagacaccaacagtctggtgttcggcggagggacctaaggttcgaccgttcttcggtcacgcccaaggcttcgtccccgttcggtaaccc

SEQ ID NO: 311254 - DNA, 503 bp, Homo sapiens
  misc_feature: GZ8MTXP01BPC45.25.36.D03.1.454.CMB.2.raw
  modified_base (207)..(207): a, c, t, g, unknown or other
  misc_feature (207)..(207): n is a, c, g, or t
  modified_base (345)..(345): a, c, t, g, unknown or other
  misc_feature (345)..(345): n is a, c, g, or t
  modified_base (421)..(421): a, c, t, g, unknown or other
  misc_feature (421)..(421): n is a, c, g, or t
  modified_base (449)..(449): a, c, t, g, unknown or other
  misc_feature (449)..(449): n is a, c, g, or t
  modified_base (451)..(451): a, c, t, g, unknown or other
  misc_feature (451)..(451): n is a, c, g, or t
  modified_base (470)..(470): a, c, t, g, unknown or other
  misc_feature (470)..(470): n is a, c, g, or t
  modified_base (494)..(494): a, c, t, g, unknown or other
  misc_feature (494)..(494): n is a, c, g, or t
tcagactgtacagtcacgaccggtgctcgatttagctgcgtcacgatctctcttggggagcttcagctgtggtagagaagacaggattcaggacaatctccagcatggccggcctccctctcctcctcaccctcctcactcactgtgcagggtcctgggcccagtctgtgctgactcagccaccctcagtgtctgggacccccgggnagagggtctccatctcttgttctgggagcagctccgacgtcggaaatagttgtctactggtaccagcagctcccagaacgccccaagctcctcatctataggaatgatcagcggcctcagggatactgacccgattcnctggctcgagtctggctctcggcctcctggccatcagtcgggctccgggtccgaggactggaggctggggaaattnttactgtgctagtttgggatgccagtcngngtggttcgaggttgtcggngagggccagctgccgtcaggttcngcccgaagg

SEQ ID NO: 311255 - DNA, 532 bp, Homo sapiens
  misc_feature: GZ8MTXP01AGPYH.25.36.D03.1.454.CMB.2.raw
  modified_base (228)..(228): a, c, t, g, unknown or other
  misc_feature (228)..(228): n is a, c, g, or t
  modified_base (242)..(242): a, c, t, g, unknown or other
  misc_feature (242)..(242): n is a, c, g, or t
  modified_base (260)..(260): a, c, t, g, unknown or other
  misc_feature (260)..(260): n is a, c, g, or t
  modified_base (304)..(304): a, c, t, g, unknown or other
  misc_feature (304)..(304): n is a, c, g, or t
  modified_base (324)..(324): a, c, t, g, unknown or other
  misc_feature (324)..(324): n is a, c, g, or t
  modified_base (454)..(454): a, c, t, g, unknown or other
  misc_feature (454)..(454): n is a, c, g, or t
  modified_base (499)..(499): a, c, t, g, unknown or other
  misc_feature (499)..(499): n is a, c, g, or t
  modified_base (505)..(505): a, c, t, g, unknown or other
  misc_feature (505)..(505): n is a, c, g, or t
tcagactgtacagtcacgaccggtgctcgatttagctgcgtcacgatctctcttgggggggtctcaggaggcagcgctctcgggacgtctccaccatggcctgggctctgctgttcctcaccctcctcactcagggcacagggtcctgggcccagtctgccctgactcagcctgcctccgtgtctgggactcctggacagtcggtcaccatctcctgcactggaaccngccgtgacattggngcttataactatgtctcnggtcccaacaacacccaggcaacggcccccaaatcatcatttangatgtcagtcatcggccctntggagtttcctggtcgtcttctcttagggcctccaagtcctgggccaactcggccctccctgaccatcgtcggggcctcccgaggcctggacggacgaggctactttattattgtctatttcatacaganacaccaacagtctggtgtcggcggaggaccaagttcgaccgttcncggtcncgcccaggccttcgccccgttcggtcc

SEQ ID NO: 311256 - DNA, 563 bp, Homo sapiens
  misc_feature: GZ8MTXP01D0JXH.25.36.D03.1.454.CMB.2.raw
  modified_base (178)..(178): a, c, t, g, unknown or other
  misc_feature (178)..(178): n is a, c, g, or t
  modified_base (280)..(280): a, c, t, g, unknown or other
  misc_feature (280)..(280): n is a, c, g, or t
  modified_base (297)..(297): a, c, t, g, unknown or other
  misc_feature (297)..(297): n is a, c, g, or t
  modified_base (303)..(303): a, c, t, g, unknown or other
  misc_feature (303)..(303): n is a, c, g, or t
tcagactgtacagtcacgaccggtgctcgatttagctgcgtcacgatctctcttggggtgtgggctcagaagcagagttctggggtgtctccaccatggcctggacccctctctggctcactctcctcactctttgcataggttctgtggtttcttctgaactgactcaggaccccgntgtgtctgtggccttgggacagacagtcaggatcacatgaccaaggagacagcctcagaacttatatgcatctggaccagcagaagccggacacggcccctntactgtctctacggtanaaaacncccgcccctcagggactctcagaccgattccctctcggctcccgcctacaaggaacacagtcttcctgaccatcacgtgggctcgaggcacaaagatagacggctcgaactattaacgttcgggttcccgtcccggggacaacccgagtcggtaagcgtaagggttgtggttcttcgggcggtaagggaaccagggtcgaaccgtccgtaggttcgacggcccgaacggctcgccccgtcggttcctaacttcgttcccg

SEQ ID NO: 311257 - DNA, 544 bp, Homo sapiens
  misc_feature: GZ8MTXP01C61P6.25.36.D03.1.454.CMB.2.raw
  modified_base (207)..(207): a, c, t, g, unknown or other
  misc_feature (207)..(207): n is a, c, g, or t
  modified_base (233)..(233): a, c, t, g, unknown or other
  misc_feature (233)..(233): n is a, c, g, or t
  modified_base (295)..(295): a, c, t, g, unknown or other
  misc_feature (295)..(295): n is a, c, g, or t
  modified_base (301)..(301): a, c, t, g, unknown or other
  misc_feature (301)..(301): n is a, c, g, or t
  modified_base (329)..(329): a, c, t, g, unknown or other
  misc_feature (329)..(329): n is a, c, g, or t
  modified_base (426)..(426): a, c, t, g, unknown or other
  misc_feature (426)..(426): n is a, c, g, or t
tcagactgtacagtcacgaccggtgctcgatttagctgcgtcacgatctctcttggggagcttcagctgtggtagagaagacaggattcaggacaatctccagcatggccggcctccctctcctcctcaccctcctcactcactgtgcagggtcctgggcccagtctgtgctgactcagccaccctcagtgtcgtcgggaccccggnagaggtctccatctcttgtctgggancagctccgacgtcggaaatagttgctactggtaccagcagctccagaaccgccccaagctcncatcanagatgatcagcggcctcgacggactacngaccgtattctcgtggctcgaagtctgggcctccgccggccctccctggcccatcgagtcggcctcggtccgagactgaggctaggaattagttacngtgtcgtaaggttttgggattgcccgtagtcctggaaggtcgggttccggtaggttggttcgggcgggaagggcccaagcgtacggcccgttccgtagggttccaacggccccgaagg

SEQ ID NO: 311258 - DNA, 517 bp, Homo sapiens
  misc_feature: GZ8MTXP01DDVZE.25.36.D03.1.454.CMB.2.raw
  modified_base (243)..(243): a, c, t, g, unknown or other
  misc_feature (243)..(243): n is a, c, g, or t
  modified_base (260)..(260): a, c, t, g, unknown or other
  misc_feature (260)..(260): n is a, c, g, or t
  modified_base (298)..(298): a, c, t, g, unknown or other
  misc_feature (298)..(298): n is a, c, g, or t
  modified_base (425)..(425): a, c, t, g, unknown or other
  misc_feature (425)..(425): n is a, c, g, or t
  modified_base (428)..(428): a, c, t, g, unknown or other
  misc_feature (428)..(428): n is a, c, g, or t
tcagactgtacagtcacgaccggtgctcgatttagctgcgtcacgatctctcttgggggggtctcaggaggcagcgctctcgggacgtctccaccatggcctgggctctgctgttcctcaccctcctcactcagggcacagggtcctgggcccagtctgccctgactcagcctgcctccgtgtctgggactcctggacagtcggtcaccatctcctgcactggaaccagccgtgacattgggncttataactatgtctcngtccaacaacaccaggcaacgccccaaatcatcattangatgtcagtcatcggccctctggtagtttcctggtcgcttctcgtggctccgaaagtctggcaactcggcctccctgacatctcgggctcgagctgagacgagctacttattattgctattcatacnganacacaacagtctggtaagttcggacggtagggaccgaaggttcgaccgttcttcggtcacgccaacggccttcgcccccgttcggtccc

SEQ ID NO: 311259 - DNA, 564 bp, Homo sapiens
  misc_feature: GZ8MTXP01AD69I.25.36.D03.1.454.CMB.2.raw
  modified_base (208)..(208): a, c, t, g, unknown or other
  misc_feature (208)..(208): n is a, c, g, or t
  modified_base (236)..(236): a, c, t, g, unknown or other
  misc_feature (236)..(236): n is a, c, g, or t
  modified_base (304)..(304): a, c, t, g, unknown or other
  misc_feature (304)..(304): n is a, c, g, or t
tcagactgtacagtcacgaccggtgctcgatttagctgcgtcacgatctctcttggggagcttcagctgtggtagagaagacaggattcaggacaatctccagcatggccggcctccctctcctcctcaccctcctcactcactgtgtagggtcctgggcccagtctgtgctgactcagccaccctcagtgtctcgggacccccgggnagagggtctccatctcttgttctgggancagctccgacgtcggaaattaagttgtctactggtaccagcagctcccagaaaccgccccaagctccncatcataggaatgatcagccggccctgagggactacctgacccgtattctctggctcgaagtctggcctccgtcggccctcccgtggccatcgaggttgggccgtccgggtccgaggacgtgaggctagaagttattacgtgtgcgtaggtttgggatcgcctagtcgtgaggtcggtcccggttagggtcggttcgggacgggagggacccgaaggccgttcgacccgtcgtacgggtccacggtcccgaaggtccccg

SEQ ID NO: 311260 - DNA, 535 bp, Homo sapiens
  misc_feature: GZ8MTXP01DKCKP.25.36.D03.1.454.CMB.2.raw
  modified_base (243)..(243): a, c, t, g, unknown or other
  misc_feature (243)..(243): n is a, c, g, or t
  modified_base (336)..(336): a, c, t, g, unknown or other
  misc_feature (336)..(336): n is a, c, g, or t
tcagactgtacagtcacgaccggtgctcgatttagctgcgtcacgatctctcttgggggggtctcaggaggcagcgctctcgggacgtctccaccatggcctgggctctgctgttcctcaccctcctcactcagggcacagggtcctgggcccagtctgccctgactcagcctgcctccgtgtctgggactcctggacagtcggtcaccatctcctgcactggaaccagccgtgacattggtncttataactatgtctcctggtcccaacaacacccaggcaacggcccccaaactcatcattatgatgtcagtcatcggccctctggagtttccnggtcgcttctctggctcaagtctggcaactcggcctccctgaccatctcgggctccaggctgagcgagctattattagtgctatttcatacagagtacacaacagtcgtggttcgtcgggttcgggaagggaccctaaaggtttcgaacccgttccttacgggtcacggtcccaaggccttcgcccccgttcgggtccc

SEQ ID NO: 311261 - DNA, 521 bp, Homo sapiens
  misc_feature: GZ8MTXP01AOPHQ.25.36.D03.1.454.CMB.2.raw
  modified_base (228)..(228): a, c, t, g, unknown or other
  misc_feature (228)..(228): n is a, c, g, or t
  modified_base (243)..(243): a, c, t, g, unknown or other
  misc_feature (243)..(243): n is a, c, g, or t
  modified_base (261)..(261): a, c, t, g, unknown or other
  misc_feature (261)..(261): n is a, c, g, or t
  modified_base (376)..(376): a, c, t, g, unknown or other
  misc_feature (376)..(376): n is a, c, g, or t
tcagactgtacagtcacgaccggtgctcgatttagctgcgtcacgatctctcttgggggggtctcaggaggcagcgctctcgggacgtctccaccatggcctgggctctgctgttcctcaccctcctcactcagggcacagggtcctgggcccagtctgccctgactcagcctgcctccgtgtctgggactcctggacagtcggtcaccatctcctgcactggaaccngccgtgacattggtncttataactatgtctccnggtcccaacaacacccaggcaaggcccccaaatcatcatttatgatgtcagtcatcggccctctggagtttcctggtcgcttctctggctccaagtctggcaactcggcctcccngaccatctcggggctccgaggctgaggacgaggctacttattattgctatttcatacagagacacaacagtctggtgttcgggcggagggacctaagttcgaccgttcttcggtcacgtcccaaggcttcgtccccttcggtccc

SEQ ID NO: 311262 - DNA, 669 bp, Homo sapiens
  misc_feature: GZ8MTXP01EAJ1X.25.36.D03.1.454.CMB.2.raw
  modified_base (209)..(209): a, c, t, g, unknown or other
  misc_feature (209)..(209): n is a, c, g, or t
  modified_base (267)..(267): a, c, t, g, unknown or other
  misc_feature (267)..(267): n is a, c, g, or t
  modified_base (356)..(356): a, c, t, g, unknown or other
  misc_feature (356)..(356): n is a, c, g, or t
tcagactgtacagtcacgaccggtgctcgatttagctgcgtcacgatctctcttggggagcttcagctgtggtagagaagacaggattcaggacaatctccagcatggccggcctccctctcctcctcaccctcctcactcactgtgcagggtcctgggcccagtctgtgctgactcagccaccctcagtgtcgtcgggacccccgggnagagggtctccatctcttgttcgtgggagcagcctccgacggtcggaaattaagtttntctactggtacccagcagcctacccgaagaaacccggccccaagcctcctcatctataggatgatcacgcggccctcgaacggctacgngaccgtattcctctggctacgaagtcctcggcctcccgtccggccctcccgtaggcctagtcgaggttcgggccctccgggtaccggagacgtgaacgtctaggggtaaattacgtttaacgtggtaccgtgttaaggttttggggaactcggtaacccgttaggttacccggtgggtaacgggtttccggggttaccccggtagggggtttccggttaccgggggtaacggggaacggggaccccgttaaggtccgtacggtaaccccgtttaccggacggttaccgaacccggttaaccccgtaaccgggg

SEQ ID NO: 311263 - DNA, 519 bp, Homo sapiens
  misc_feature: GZ8MTXP01D5NDT.25.36.D03.1.454.CMB.2.raw
  modified_base (228)..(228): a, c, t, g, unknown or other
  misc_feature (228)..(228): n is a, c, g, or t
  modified_base (243)..(243): a, c, t, g, unknown or other
  misc_feature (243)..(243): n is a, c, g, or t
  modified_base (260)..(260): a, c, t, g, unknown or other
  misc_feature (260)..(260): n is a, c, g, or t
  modified_base (328)..(328): a, c, t, g, unknown or other
  misc_feature (328)..(328): n is a, c, g, or t
  modified_base (426)..(426): a, c, t, g, unknown or other
  misc_feature (426)..(426): n is a, c, g, or t
  modified_base (443)..(443): a, c, t, g, unknown or other
  misc_feature (443)..(443): n is a, c, g, or t
tcagactgtacagtcacgaccggtgctcgatttagctgcgtcacgatctctcttgggggggtctcaggaggcagcgctctcgggacgtctccaccatggcctgggctctgctgttcctcaccctcctcactcagggcacagggtcctgggcccagtctgccctgactcagcctgcctccgtgtctgggactcctggacagtcggtcaccatctcctgcactggaaccngccgtgacattggtncttataactatgtctcngtccaacaacaccaggcaagccccaaatcatcatttatgatgtcagtcatcgacctctggtatttccnggtcgcttctctgctcagtctggcaactcggcctcctgaccatcgtcgggctccaggctggaggacgagctaacttattattgctatttcatacaganacacaacagtctgggtnttcgggcggaaggggacctaaaggttcgacccgttcgttacgggcagcccgaaggccttcgcccccgttgggtccc

SEQ ID NO: 311264 - DNA, 604 bp, Homo sapiens
  misc_feature: GZ8MTXP01CR6W3.25.36.D03.1.454.CMB.2.raw
  modified_base (188)..(188): a, c, t, g, unknown or other
  misc_feature (188)..(188): n is a, c, g, or t
  modified_base (209)..(209): a, c, t, g, unknown or other
  misc_feature (209)..(209): n is a, c, g, or t
  modified_base (237)..(237): a, c, t, g, unknown or other
  misc_feature (237)..(237): n is a, c, g, or t
  modified_base (308)..(308): a, c, t, g, unknown or other
  misc_feature (308)..(308): n is a, c, g, or t
tcagactgtacagtcacgaccggtgctcgatttagctgcgtcacgatctctcttggggagcttcagctgtggtagagaagacaggattcaggacaatctccagcatggccggcctccctctcctcctcaccctcctcactcactgtgcagggtcctgggcccagtctgtgctgactcagcccaccctnagtgtctcggggacccccggnaggaggtctccatctcttgttctgggancagctcgacgtacggaaatagttgtcactggtaccagcagcctcccgagaaaccggccccaaagcctcctnatctatagaatgatcgagcggcctgacggatacgtgaccgattctctgtctcgaagtcgtggcctccgtccggccctcccgtcggccatcgaggtcggccttccgggccgaggactggagggtctaggggtaaatttacgttaaccgttggtcgtcgtaggttttgggacttcgcccgtaaggttccgtggtaacgggttcgggttccggtaacgggttcggttaccggggcggaacggggaccttaacgggcctcggtaacccgttcgacgggttaccaacggccccgtaaccgg

SEQ ID NO: 311265 - DNA, 523 bp, Homo sapiens
  misc_feature: GZ8MTXP01D6TBE.25.36.D03.1.454.CMB.2.raw
  modified_base (440)..(440): a, c, t, g, unknown or other
  misc_feature (440)..(440): n is a, c, g, or t
  modified_base (444)..(444): a, c, t, g, unknown or other
  misc_feature (444)..(444): n is a, c, g, or t
  modified_base (450)..(450): a, c, t, g, unknown or other
  misc_feature (450)..(450): n is a, c, g, or t
  modified_base (474)..(474): a, c, t, g, unknown or other
  misc_feature (474)..(474): n is a, c, g, or t
  modified_base (501)..(501): a, c, t, g, unknown or other
  misc_feature (501)..(501): n is a, c, g, or t
tcagactgtacagtcacgaccggtgctcgatttagctgcgtcacgatctctcttgggggggtctcaggaggcagcgctctcgggacgtctccaccatggcctgggctctgctcctcctcagcctcctcactcagggcacaggatcccgggctcagtctgccctgactcagcctcgctcagtgtccggtctcctggacagtcagtcaccatctcctgcactggaaccagaagtgattcttggtgcttatgacactgtctcctggcaccagtttacccaggaaaacgcccccagagtcatcctttatgatgtcaggaagcggccctcgacggggtccctgatcgcttctcgtgggtccaaatctggcaacacggcctccctgaccatctctgggcctccgagtctgagatgagcgtagtatttattattgctgttcatatgnaggntaactnttagttttcggttgttcggcgcgngggacctaaggttcgaacccgttccgngggttcctaacgcccgaaccgg

SEQ ID NO: 311266 - DNA, 504 bp, Homo sapiens
  misc_feature: GZ8MTXP01ARAG2.25.36.D03.1.454.CMB.2.raw
  modified_base (262)..(262): a, c, t, g, unknown or other
  misc_feature (262)..(262): n is a, c, g, or t
tcagactgtacagtcacgaccggtgctcgatttagctgcgtcacgatctctcttggggagcttcagctgtgggtagagaagacaggactcaggacaatctccagcatggccagcttccctctcctcctcaccctcctcactcactgtgcagggtcctgggcccagtctgtgctgtctcagccaccctcagtgtctggggccccccgggcagagggtcgacatctcttgttctggaagtcgctccaacgtcggcagtaatagngtaagctggtaccagcaactcccaggaaccgcccccacactcctcatgtatgggaatgatcagcgcccctcaggggtcctgaccgattctctgcctccacgtctggcacctcagccctcctgccatccgtggctcatctgagatgaggggcgattatattgtgcagcgtgggatgacaggaagaacggttatgttcgtcggaattgggcaagggtcacgtcctaggtcagccaaggaacccc

SEQ ID NO: 311267 - DNA, 561 bp, Homo sapiens
  misc_feature: GZ8MTXP01D2TGI.25.36.D03.1.454.CMB.2.raw
  modified_base (236)..(236): a, c, t, g, unknown or other
  misc_feature (236)..(236): n is a, c, g, or t
tcagactgtacagtcacgaccggtgctcgatttagctgcgtcacgatctctcttggggagcttcagctgtggtagagaagacaggattcaggacaatctccagcatggccggcctccctctcctcctcaccctcctcactcactgtgcagggtcctgggcccagtctgtgctgactcagccaccctcagtgtctcgggacccccgggcagagggtctccatctcttgttctgggancagctccgacgtcggaaattaagttgtctactggtaccagcagctcccagaaccggccccaagctcctcatctatagatgatcagcggccctgacggactactgaccgtattctctggctcgaagtctggcctcctcgccctccctggccatcgagtcggctcggtccgagatgacggtctagggtaacttattactgtgcgtagtttgggatcgtccgagtctggaagtcgggttccggtacggggttgttccggggcgggaacgggacccaaggtcgttcggaacccggttcccgtaggggttccaacggccccgtaaacggg

SEQ ID NO: 311268 - DNA, 529 bp, Homo sapiens
  misc_feature: GZ8MTXP01ASF19.25.36.D03.1.454.CMB.2.raw
  modified_base (211)..(211): a, c, t, g, unknown or other
  misc_feature (211)..(211): n is a, c, g, or t
  modified_base (390)..(390): a, c, t, g, unknown or other
  misc_feature (390)..(390): n is a, c, g, or t
  modified_base (401)..(401): a, c, t, g, unknown or other
  misc_feature (401)..(401): n is a, c, g, or t
  modified_base (418)..(418): a, c, t, g, unknown or other
  misc_feature (418)..(418): n is a, c, g, or t
  modified_base (420)..(420): a, c, t, g, unknown or other
  misc_feature (420)..(420): n is a, c, g, or t
  modified_base (424)..(424): a, c, t, g, unknown or other
  misc_feature (424)..(424): n is a, c, g, or t
  modified_base (433)..(433): a, c, t, g, unknown or other
  misc_feature (433)..(433): n is a, c, g, or t
tcagactgtacagtcacgaccggtgctcgatttagctgcgtcacgatctctcttggggagcttcagctgtggtagagaagacaggattcaggacaatctccagcatggccggcctccctctcctcctcacccctcctcactcactgtgcagggtcctgggcccagtctgtgctgactcagcccaccctcagtgtctcgggaccccccgggnagagggtctccatctcttgttctgggagcagctccgagtcggaaatagttgtcactggtaccagcagctcccagaaaccgcccccaagctcctcatctataggaatgatcagccggccctcgacgggactacctgacccgattcctctggctcgaagtctggctcctcggccctcccgnggaccactcgngtcggcgtccgtcgagngngagngagtatatntgtgtgtgttggtgtcgtcgtagtcgtggtggtcggttcggtcggttgggtcgggcgggacggcgacgcgtcgtccgtcgtacgcgtcgccgaacg

SEQ ID NO: 311269 - DNA, 495 bp, Homo sapiens
  misc_feature: GZ8MTXP01D003E.25.36.D03.1.454.CMB.2.raw
  modified_base (337)..(337): a, c, t, g, unknown or other
  misc_feature (337)..(337): n is a, c, g, or t
  modified_base (352)..(352): a, c, t, g, unknown or other
  misc_feature (352)..(352): n is a, c, g, or t
  modified_base (364)..(364): a, c, t, g, unknown or other
  misc_feature (364)..(364): n is a, c, g, or t
  modified_base (381)..(381): a, c, t, g, unknown or other
  misc_feature (381)..(381): n is a, c, g, or t
  modified_base (427)..(427): a, c, t, g, unknown or other
  misc_feature (427)..(427): n is a, c, g, or t
tcagactgtacagtcacgaccggtgctcgatttagctgcgtcacgatctctcttggggacccaaaaccacacccctccttgggagaatcccctagatcacagctcctcaccatggactggacctggagcatccttttcttggtggcagcagcaacaggtgcccactcccaggttcaactggtgcagtctggacctgaggtgaagaagcctggggcctcagtgaaggtctcctgcaaggcttctggttacacctttagcagctatggcatcagctgggtgcgacaggcccctggacaaggggcttgagtggatggcatggatcagcttaacatggatnacagactaaatgcanagaatacgaggngagagtcactgacacanacacacacacgagacacacgacacgatgacgagagagcgagagatntgacgacgaacgcgttatattacgtgtgacgagagtaagtattaatgtcttacgtccggttcgtaacg

SEQ ID NO: 311270 - DNA, 596 bp, Homo sapiens
  misc_feature: GZ8MTXP01C230F.25.36.D03.1.454.CMB.2.raw
  modified_base (187)..(187): a, c, t, g, unknown or other
  misc_feature (187)..(187): n is a, c, g, or t
  modified_base (233)..(233): a, c, t, g, unknown or other
  misc_feature (233)..(233): n is a, c, g, or t
  modified_base (304)..(304): a, c, t, g, unknown or other
  misc_feature (304)..(304): n is a, c, g, or t
tcagactgtacagtcacgaccggtgctcgatttagctgcgtcacgatctctcttggggagcttcagctgtggtagagaagacaggattcaggacaatctccagcatggccggcctccctctcctcctcaccctcctcactcactgtgcagggtcctgggcccagtctgtgctgactcagccaccctnagtgtctcgggaccccggcagagggtctccatctcttgtctgggancagctccgacgtcggaaatagttgtctactggtaccagcagcctacccagaaaccggcccccaagcctccncatcataggaatgatcagccgcctcgacggactacctgacccgtattctctggctcgaagtctggcctcccgtcggccctcccgtggcccagtcaggtcgggccgttccggtccgaggatggaacggtctagggaattattacgtgtagcgtaaggtttgggaattcggcctaggtcctggtaaggttcgggttacggtacgggttggttccggggcgggttaacgggcccgaaagtccggttacggaaccccggtttccgtaggggttacccaacgggccccgtaaacggg

SEQ ID NO: 311271 - DNA, 642 bp, Homo sapiens
  misc_feature: GZ8MTXP01D38WM.25.36.D03.1.454.CMB.2.raw
  modified_base (187)..(187): a, c, t, g, unknown or other
  misc_feature (187)..(187): n is a, c, g, or t
  modified_base (208)..(208): a, c, t, g, unknown or other
  misc_feature (208)..(208): n is a, c, g, or t
  modified_base (240)..(240): a, c, t, g, unknown or other
  misc_feature (240)..(240): n is a, c, g, or t
  modified_base (482)..(482): a, c, t, g, unknown or other
  misc_feature (482)..(482): n is a, c, g, or t
  modified_base (487)..(487): a, c, t, g, unknown or other
  misc_feature (487)..(487): n is a, c, g, or t
tcagactgtacagtcacgaccggtgctcgatttagctgcgtcacgatctctcttggggagcttcagctgtggtagagaagacaggattcaggacaatctccagcatggccggcctccctctcctcctcaccctcctcactcactgtgcagggtcctgggcccagtctgtgctgactcagccaccctnagtgtcgtcgggacccccggnaggaggtcctccattcttcttgttcgtgggancagtcctaccgacgtacggtaaattagtttgtactacgtcggaccagacacgtccctacccgaaacggaaaccccggccccccaaagtccctaccctactaacttacttaagtaaggtaattcggaactcgacggcccgccccgtagaacggggtaccttaccgtggaacccttatttcccgtcgtcgggacctacggtaacgttcgtcgggtccctccgtccggtcccctccgtacggccnttcgnggtcgggtccttcccgggacgaggagtcggagtgtagggtaagttattacgttgtgtgtggttggtagtcgtccgtgtcgtggtggtcggttcggtcggttcggttcgggcgggacggacgacgtcgtcgtcgtcgtacgcgtcgccgtaaccgg

SEQ ID NO: 311272 - DNA, 732 bp, Homo sapiens
  misc_feature: GZ8MTXP01C9V20.25.36.D03.1.454.CMB.2.raw
  modified_base (225)..(225): a, c, t, g, unknown or other
  misc_feature (225)..(225): n is a, c, g, or t
  modified_base (240)..(240): a, c, t, g, unknown or other
  misc_feature (240)..(240): n is a, c, g, or t
  modified_base (257)..(257): a, c, t, g, unknown or other
  misc_feature (257)..(257): n is a, c, g, or t
tcagactgtacagtcacgaccggtgctcgatttagctgcgtcacgatctctcttgggggggtctcaggaggcagcgctctcgggacgtctccaccatggcctgggctctgctgttcctcaccctcctcactcagggcacagggtcctgggcccagtctgccctgactcagcctgcctccgtgtctggactcctggacagtcggtcacatctctgcactggaaccngccgtgacattggtncttataactatgtctcngtccaacaacaccagcaacggccccaatcatcattatgatgtcagttcatccggccctctggtacgtttccctggtcgtctttctcgtcggccttccgaaagtcctagggcctaaaccgtccgggcccctaccctcgaccctacgtccgtcgggggtccttacccgaacggtaccgttagggaacgggaaccggtaacgggtaccttaaaccgttttaacgttttaagtttacggtacccttaaatttttaccgaaactttaaccgaaaggtaacggaaacccgtaaaccctaaaaccgtaacgttacccggttggggttcggtttaccggggaccggggtaaacggggttaacccgtaaaacgggtttcggaaaccccggtttcccgttaacccggggttcccgtaaccgggtaacccccgtaaacggggcccgttaccccgggtaaccccccccgttcggggtttaacccccg

SEQ ID NO: 311273 - DNA, 668 bp, Homo sapiens
  misc_feature: GZ8MTXP01A36KY.25.36.D03.1.454.CMB.2.raw
  modified_base (207)..(207): a, c, t, g, unknown or other
  misc_feature (207)..(207): n is a, c, g, or t
  modified_base (235)..(235): a, c, t, g, unknown or other
  misc_feature (235)..(235): n is a, c, g, or t
  modified_base (300)..(300): a, c, t, g, unknown or other
  misc_feature (300)..(300): n is a, c, g, or t
tcagactgtacagtcacgaccggtgctcgatttagctgcgtcacgatctctcttggggagcttcagctgtggtagagaagacaggattcaggacaatctccagcatggccggcctccctctcctcctcaccctcctcactcactgtgcagggtcctgggcccagtctgtgctgactcagccaccctcagtgtctcgggacccccggnagagggtctccatctcttgttctgggancagctccgacgtcggaaatagttgtctactggtaccagcagctcccagaaccgccccaagctccncatctataggatgatcagcgccctgacgggactactgacccgattctcgtggctacgaagtcgtgggtcctccccgtccgggccccttccccgtacggccctagtccgagggttcgggccgttcccggggtccggagggagttcgggaagggtccttaggggtaaacttagtttaccgtgggttagtccgttaggttttgggggaacttcggaacccgtaggttccgttgggtaacgggtttcggggttacccgggtacggggtttcgggttaccgggggccggggaacggggggacccaaacgggtccgttaccgggaaccccgggtttcccgaagggttcccgtaacgggttccccggtaaccggg

SEQ ID NO: 311274 - DNA, 528 bp, Homo sapiens
  misc_feature: GZ8MTXP01DBCNF.25.36.D03.1.454.CMB.2.raw
  modified_base (208)..(208): a, c, t, g, unknown or other
  misc_feature (208)..(208): n is a, c, g, or t
  modified_base (296)..(296): a, c, t, g, unknown or other
  misc_feature (296)..(296): n is a, c, g, or t
  modified_base (302)..(302): a, c, t, g, unknown or other
  misc_feature (302)..(302): n is a, c, g, or t
  modified_base (468)..(468): a, c, t, g, unknown or other
  misc_feature (468)..(468): n is a, c, g, or t
tcagactgtacagtcacgaccggtgctcgatttagctgcgtcacgatctctcttggggagcttcagctgtgggtagagaagacaggactcaggacaatctccagcatggccagcttccctctcctcctcaccctcctcactcactgtgcagggtcctgggcccagtctgtgctgtctcagcccaccctcagtgtctggggcccccggnagagggtcgacatctcttgttctggaatcgctccaacgtcggcagtaatagtgtaagctggtaccagcaactccaggaaccgccccanactccncatgtatgggaatgatcagcgcccctcgaggggtcctgaccgattcctctgccctcacgtctggccaccctcacgtccctccctggcccagtcccggtgggcctccaatcgtgagatgaggggccgtattattatgtgcagcgtggatgacaggaagtaacggttntgttcgttacgggaattcgggacaacggtcaccggtctagggcacgcccgaaggaacccc

SEQ ID NO: 311275 - DNA, 521 bp, Homo sapiens
  misc_feature: GZ8MTXP01BO3CC.25.36.D03.1.454.CMB.2.raw
  modified_base (228)..(228): a, c, t, g, unknown or other
  misc_feature (228)..(228): n is a, c, g, or t
  modified_base (243)..(243): a, c, t, g, unknown or other
  misc_feature (243)..(243): n is a, c, g, or t
  modified_base (325)..(325): a, c, t, g, unknown or other
  misc_feature (325)..(325): n is a, c, g, or t
tcagactgtacagtcacgaccggtgctcgatttagctgcgtcacgatctctcttgggggggtctcaggaggcagcgctctcgggacgtctccaccatggcctgggctctgctgttcctcaccttcctcactcagggcacagggtcctgggcccagtctgccctgactcagcctgcctccgtgtctgggactcctggacagtcggtcaccatctcctgcactggaaccngccgtgacattggtncttataactatgtctcctggtcccaacaacacccaggcaacggcccccaaatcatcatttatgatgtcagtcatcggccctntggagtttcctggtcgcttctctggctcaagtctggcactcggcctccctgaccatctcggggctcaggctgaggacgagcttacttattattgctatttcatacagagacactaacagtctggtgttcgggcggtagggacctaaggttcgaccgttccttcgggtcacgccctaagggcttcgccccttggtcc

SEQ ID NO: 311276 - DNA, 529 bp, Homo sapiens
  misc_feature: GZ8MTXP01D2H95.25.36.D03.1.454.CMB.2.raw
  modified_base (206)..(206): a, c, t, g, unknown or other
  misc_feature (206)..(206): n is a, c, g, or t
  modified_base (234)..(234): a, c, t, g, unknown or other
  misc_feature (234)..(234): n is a, c, g, or t
  modified_base (296)..(296): a, c, t, g, unknown or other
  misc_feature (296)..(296): n is a, c, g, or t
  modified_base (330)..(330): a, c, t, g, unknown or other
  misc_feature (330)..(330): n is a, c, g, or t
  modified_base (373)..(373): a, c, t, g, unknown or other
  misc_feature (373)..(373): n is a, c, g, or t
tcagactgtacagtcacgaccggtgctcgatttagctgcgtcacgatctctcttggggagcttcagctgtggtagagaagacaggattcaggacaatctccagcatggccggcctccctctcctcctcaccctcctcactcactgtgcagggtcctgggcccagtctgtgctgactcagccaccctcagtgtctgggacccccggnagagggtctccatctcttgttctgggancagctccgacgtcggaaataagttgtctactggtacagcagctccagaacgccccaagctcncatctatagatgatcagcggccctcacggatacngaccgtattctctgctcgaagtctggctctcgcctcctgccancgagtcgggctccggtccgaggactgaggtctagggtaattattacgtgtagcgtagtttggattgccagtctggaacgttggttacggtcgggttgttcgggcgggttaacgggccaaggcctaggccgttccgaggttccgaacgcccgaacgg

SEQ ID NO: 311277 - DNA, 545 bp, Homo sapiens
  misc_feature: GZ8MTXP01AZUVT.25.36.D03.1.454.CMB.2.raw
  modified_base (227)..(227): a, c, t, g, unknown or other
  misc_feature (227)..(227): n is a, c, g, or t
  modified_base (241)..(241): a, c, t, g, unknown or other
  misc_feature (241)..(241): n is a, c, g, or t
  modified_base (259)..(259): a, c, t, g, unknown or other
  misc_feature (259)..(259): n is a, c, g, or t
  modified_base (322)..(322): a, c, t, g, unknown or other
  misc_feature (322)..(322): n is a, c, g, or t
  modified_base (401)..(401): a, c, t, g, unknown or other
  misc_feature (401)..(401): n is a, c, g, or t
  modified_base (445)..(445): a, c, t, g, unknown or other
  misc_feature (445)..(445): n is a, c, g, or t
tcagactgtacagtcacgaccggtgctcgatttagctgcgtcacgatctctcttgggggggtctcaggaggcagcgctctcgggacgtctccaccatggcctgggctctgctgttcctcaccctcctcactcagggcacagggtcctgggcccagtctgccctgactcagcctgcctccgtgtctgggactcctggacagtcgtcaccatctcctgcactggaaccngccgtgacattggncttataactatgtctccnggtcccaacaacacccaggcaacggcccccaaatcatcatttatgatgtcagtcatcggcctntggtagtttcctggtcgcttctctgctcagtctggcactcgcctccctgaccatctcgggctccgaggctgacggacgngtctacgttattagttgactatttcaatacagagacactaaacngtctggtaacgttcgggcggtacgggacctaaggttcgaacccgttccgttacgggttcacggtccccgaagggcccttaccggcccccgttcgggtccc

SEQ ID NO: 311278 - DNA, 519 bp, Homo sapiens
  misc_feature: GZ8MTXP01DVW8L.25.36.D03.1.454.CMB.2.raw
  modified_base (227)..(227): a, c, t, g, unknown or other
  misc_feature (227)..(227): n is a, c, g, or t
  modified_base (242)..(242): a, c, t, g, unknown or other
  misc_feature (242)..(242): n is a, c, g, or t
  modified_base (451)..(451): a, c, t, g, unknown or other
  misc_feature (451)..(451): n is a, c, g, or t
  modified_base (489)..(489): a, c, t, g, unknown or other
  misc_feature (489)..(489): n is a, c, g, or t
tcagactgtacagtcacgaccggtgctcgatttagctgcgtcacgatctctcttgggggggtctcaggaggcagcgctctcgggacgtctccaccatggcctgggctctgctgttcctcaccctcctcactcagggcacagggtcctgggcccagtctgccctgactcagcctgcctccgtgtctgggactcctggacagtcgtcaccatctcctgcactggaaccngccgtgacattggtncttataactatgtctcctggtcccaacaacacccaggcaacggccccaaatcatcatttatgatgtcagtcatcggccctctggagtttcctggtcgtcttctctggctccaagtctggcaactcggcctccctgaccatcgtcggggctccgaggctgaggacgagctaacttattagttgtctatttcattacagagaacacctaangtctggtgttcggcggagggacgagttcgaccgttccncggtcacgtccagcttcgccccttcggtcc

SEQ ID NO: 311279 - DNA, 532 bp, Homo sapiens
  misc_feature: GZ8MTXP01CIHME.25.36.D03.1.454.CMB.2.raw
  modified_base (244)..(244): a, c, t, g, unknown or other
  misc_feature (244)..(244): n is a, c, g, or t
  modified_base (262)..(262): a, c, t, g, unknown or other
  misc_feature (262)..(262): n is a, c, g, or t
  modified_base (305)..(305): a, c, t, g, unknown or other
  misc_feature (305)..(305): n is a, c, g, or t
tcagactgtacagtcacgaccggtgctcgatttagctgcgtcacgatctctcttgggggggtctcaggaggcagcgctctcgggacgtctccaccatggcctgggctctgctgttcctcaccctcctcactcagggcacagggtcctgggcccagtctgccctgactcagcctgcctccgtgtctgggactcctggacagtcggtcaccatctcctgcactggaaccagccgtgacattgggtncttataactatgtctccnggtcccaacaacacccaggcaaggcccccaaatcatcatttangatgtcagtcatcggcctctggatttcctggtcgcttctctggctccaagtctggcaactcggcctccctgaccatcgtcggggctccgaggcctgacggacgaggctacttattacttgactatttcattacagagacaccaacagtctgggtcgttcggcggtaggaccaaaggttcacccggttcttcggtcacgccctaagggccttcgcccccttgggtccc

SEQ ID NO: 311280 - DNA, 750 bp, Homo sapiens
  misc_feature: GZ8MTXP01ELHMO.25.36.D03.1.454.CMB.2.raw
  modified_base (209)..(209): a, c, t, g, unknown or other
  misc_feature (209)..(209): n is a, c, g, or t
  modified_base (237)..(237): a, c, t, g, unknown or other
  misc_feature (237)..(237): n is a, c, g, or t
tcagactgtacagtcacgaccggtgctcgatttagctgcgtcacgatctctcttggggagcttcagctgtggtagagaagacaggattcaggacaatctccagcatggccggcctccctctcctcctcaccctcctcactcactgtgcagggtcctgggcccagtctgtgctgactcagccaccctcagtgtcgtcgggacccccgggnagagggtctccatctcttgttctgggancagcctccgacgtacggaaatagttgtctactggtaccagcagcctacccaagaaccggcccccaagcctcctcatctaataggatgactcacgccggcccctgacgggactaccgtgacccgtattcctcgtcgggtcctcggaaacgttcctcgggtccctcccgttccgggccccttcccgtggccctacgttccgacgggtttcggggcccgttacccggggtcccggaagggaacgtcgggaaaggggtccttaaggggtaaacttttagtttaaccgttgggttacggtcggttaagggtttttcgggggaatttcgggcccctaagggttcccgttaggggtaacggtttccgggggttccccgggtaaacccgggggttttgggttcccgggggtaaccggggttaaacggggttaccccgaaaacgggtcccggtttaccggaacccccgggttccgttaaacgggggttccctaacccgggttaacccccgtaaacccggggg

SEQ ID NO: 311281 - DNA, 511 bp, Homo sapiens
  misc_feature: GZ8MTXP01B6IX8.25.36.D03.1.454.CMB.2.raw
  modified_base (206)..(206): a, c, t, g, unknown or other
  misc_feature (206)..(206): n is a, c, g, or t
tcagactgtacagtcacgaccggtgctcgatttagctgcgtcacgatctctcttggggagcttcagctgtggtagagaagacaggattcaggacaatctccagcatggccggcctccctctcctcctcaccctcctcactcactgtgcagggtcctgggcccagtctgtgctgactcagccaccctcagtgtctgggacccccggnagagggtctccatctcttgttctgggagcagctccgacgtcggaaataagttgctactggtaccagcagctcccagaacgccccaagctcctcatctatagatgatcagcggcctcacgggatactgaccgattctctggctcgaagtctggcctcctcggccctccctcggccatcagtcgggctccggtccgaggatgaggctagggaattattactgtgctaggtttggatgccagtctgaagtggttcggtacggttgttcgggcggggaccgagctgaccgtctaggcacgccgaagccg

SEQ ID NO: 311282 - DNA, 519 bp, Homo sapiens
  misc_feature: GZ8MTXP01AMUA3.25.36.D03.1.454.CMB.2.raw
  modified_base (227)..(227): a, c, t, g, unknown or other
  misc_feature (227)..(227): n is a, c, g, or t
  modified_base (242)..(242): a, c, t, g, unknown or other
  misc_feature (242)..(242): n is a, c, g, or t
  modified_base (304)..(304): a, c, t, g, unknown or other
  misc_feature (304)..(304): n is a, c, g, or t
  modified_base (324)..(324): a, c, t, g, unknown or other
  misc_feature (324)..(324): n is a, c, g, or t
  modified_base (399)..(399): a, c, t, g, unknown or other
  misc_feature (399)..(399): n is a, c, g, or t
  modified_base (443)..(443): a, c, t, g, unknown or other
  misc_feature (443)..(443): n is a, c, g, or t
  modified_base (471)..(471): a, c, t, g, unknown or other
  misc_feature (471)..(471): n is a, c, g, or t
  modified_base (498)..(498): a, c, t, g, unknown or other
  misc_feature (498)..(498): n is a, c, g, or t
  modified_base (503)..(503): a, c, t, g, unknown or other
  misc_feature (503)..(503): n is a, c, g, or t
tcagactgtacagtcacgaccggtgctcgatttagctgcgtcacgatctctcttgggggggtctcaggaggcagcgctctcgggacgtctccaccatggcctgggctctgctgttccctcaccctcctcactcagggcacagggtcctgggcccagtctgccctgactcagcctgcctcgtgtctgggactcctggacagtcgtcaccatctcctgcactggaaccngccgtgacattggtncttataactatgtctcctggtcccaacaacacccaggcaacggcccccaaatcatcatttangatgtcagtcatcggccctntggagtttcctggtcgcttctctggctccaagtctggctcctcggcctccctgccatcagtgggctccggtccgnggactgaggctagaactattactgtgcgtagtttgggatgaccngtctggagtgggtcgcggttggtcgggnggaggacccaagcgttcgaaccgtcgnggtcngccaacgggctcccgg

SEQ ID NO: 311283 - DNA, 673 bp, Homo sapiens
  misc_feature: GZ8MTXP01A8AE5.25.36.D03.1.454.CMB.2.raw
  modified_base (206)..(206): a, c, t, g, unknown or other
  misc_feature (206)..(206): n is a, c, g, or t
  modified_base (268)..(268): a, c, t, g, unknown or other
  misc_feature (268)..(268): n is a, c, g, or t
  modified_base (392)..(392): a, c, t, g, unknown or other
  misc_feature (392)..(392): n is a, c, g, or t
tcagactgtacagtcacgaccggtgctcgatttagctgcgtcacgatctctcttggggagctctgagagcggagccccagccccagaattcccaggtgttttcatttggtgatcagcactgaacacagaggactcaccatggagtttgggctgagctggtttcttgttgttattttccaggtgtccagagtgaggtgcaggttggnggagtcgtgggggagcttggtccagcctgggagggtccgtgagagtctcctgtgcagcctcnggattcatcttcagtgaccactacagtcggactggggtcccgccagggctccgagggggaagggctgggaggtggggttgacccgttaatagaaaataaagcgtaaaaagagttaacaccgaanaagaaactaccgccgacgttacgtagtagaaaagggcaaagttacttactaaattttactaccgttaaacgaaagagtaacgttagtaaacttaacgaaacgtaaactaacgtaacgttacgttaacgttacgtacgtaacgtaaacgtaacgtaaacgaacgaaccgtaaacggaaaaccggaaacgggaaaccggaaccggtaaccggttaacgttacgttacgttacgtaacggtacggtaacggtacgtacgttacgttaaccggttaacgtaaccg

SEQ ID NO: 311284 - DNA, 541 bp, Homo sapiens
  misc_feature: GZ8MTXP01DBEOX.25.36.D03.1.454.CMB.2.raw
  modified_base (427)..(427): a, c, t, g, unknown or other
  misc_feature (427)..(427): n is a, c, g, or t
  modified_base (431)..(431): a, c, t, g, unknown or other
  misc_feature (431)..(431): n is a, c, g, or t
tcagactgtacagtcacgaccggtgctcgatttagctgcgtcacgatctctcttggggagcttcagctgtggtagagaagacaggattcaggacaatctccagcatggccggcctccctctcctcctcaccctcctcactcactgtgcagggtcctgggcccagtctgtgctgactcagccaccctcagtgtcgtcgggacccccggcagagggtctccattctcttgttctgggagcagcctcgacgtcggaaatagttgtctatggtaccagcagcctccagaaccggcccccaagcctcctcatctagtaggaatgaatcgacgcggccctcgaggactactgaccctattcctctggctcgaacgtcgtggctccgttccggccctcccgtggccactcgagtcggccttccggccgaggagngagngtagtattattagtgtgtgtgttggtagtcgtcgtgtcgtggtggtcggttcggtcgggttcggtcgggcgggacgggacgacgcgtcgtccgtcgtcgacgtcgccgcg

SEQ ID NO: 311285 - DNA, 552 bp, Homo sapiens
  misc_feature: GZ8MTXP01CTT0T.25.36.D03.1.454.CMB.2.raw
  modified_base (178)..(178): a, c, t, g, unknown or other
  misc_feature (178)..(178): n is a, c, g, or t
  modified_base (224)..(224): a, c, t, g, unknown or other
  misc_feature (224)..(224): n is a, c, g, or t
  modified_base (283)..(283): a, c, t, g, unknown or other
  misc_feature (283)..(283): n is a, c, g, or t
  modified_base (310)..(310): a, c, t, g, unknown or other
  misc_feature (310)..(310): n is a, c, g, or t
  modified_base (347)..(347): a, c, t, g, unknown or other
  misc_feature (347)..(347): n is a, c, g, or t
  modified_base (370)..(370): a, c, t, g, unknown or other
  misc_feature (370)..(370): n is a, c, g, or t
  modified_base (385)..(385): a, c, t, g, unknown or other
  misc_feature (385)..(385): n is a, c, g, or t
  modified_base (425)..(425): a, c, t, g, unknown or other
  misc_feature (425)..(425): n is a, c, g, or t
tcagactgtacagtcacgaccggtgctcgatttagctgcgtcacgatctctcttggggtgtgggctcagaagcagagttctggggtgtctccaccatggcctggacccctctctggctcactctcctcactctttgcataggttctgtggtttcttctgaactgactcaggaccccgntgtgtctgtggccttgggacagacagtcaggatcacatgccaaggnacagcctcaagtaacttattatgcatcctggaccagcagaagccgggacacggcccctntacttgtcttctacggtacgaaaaccnccccgcccctacgagggactcctcagaccgattcccnctggcctcccgcctaacagaacncagccttctgaccancacgtgggctcgaggcactaagatgaggctgactattacnggttcccgtaccgggacaccgaggtgtaacgcgaggttgtggtcttcgggcgggaacgggaccaagggtcgaccgttcgtaggttccgacgcccgaaggcctcgcccctggttccaacgttctcccg

SEQ ID NO: 311286 - DNA, 529 bp, Homo sapiens
  misc_feature: GZ8MTXP01CHFSA.25.36.D03.1.454.CMB.2.raw
  modified_base (206)..(206): a, c, t, g, unknown or other
  misc_feature (206)..(206): n is a, c, g, or t
  modified_base (299)..(299): a, c, t, g, unknown or other
  misc_feature (299)..(299): n is a, c, g, or t
  modified_base (363)..(363): a, c, t, g, unknown or other
  misc_feature (363)..(363): n is a, c, g, or t
tcagactgtacagtcacgaccggtgctcgatttagctgcgtcacgatctctcttggggagcttcagctgtggtagagaagacaggattcaggacaatctccagcatggccggcctccctctcctcctcaccctcctcactcactgtgcagggtcctgggcccagtctgtgctgactcagccaccctcagtgtctgggacccccggnagagggtctccatctcttgttctgggagcagctccgacgtcggaaataagttgtctactggtaccagcagctcccagaacgccccaagctccncatctatagatgatcagcgcctcacggactactgaccgattctctggctcgaagtctggcctcncgcctccctggccatcagtcgggctccggtccgaggatggaggctagggaattattactgtgcgtaggtttggatcgcctagtctggaagtcggttccggtacgggttggttcgggcgggaagggcccaaggctcggaaccgtccgtaggccaacgcccgtaacgg

SEQ ID NO: 311287 - DNA, 595 bp, Homo sapiens
  misc_feature: GZ8MTXP01B4LW8.25.36.D03.1.454.CMB.2.raw
  modified_base (267)..(267): a, c, t, g, unknown or other
  misc_feature (267)..(267): n is a, c, g, or t
  modified_base (306)..(306): a, c, t, g, unknown or other
  misc_feature (306)..(306): n is a, c, g, or t
  modified_base (350)..(350): a, c, t, g, unknown or other
  misc_feature (350)..(350): n is a, c, g, or t
  modified_base (383)..(383): a, c, t, g, unknown or other
  misc_feature (383)..(383): n is a, c, g, or t
tcagactgtacagtcacgaccggtgctcgatttagctgcgtcacgatctctcttggggagctctgggagaggagcccagcactagaagtcggcggtgtttccattcggtgatcagcactgaacacagaggactcaccatggagtttgggctgagctgggttttcctcgttgcttcttttaagaggtgtccactgtcaggtgcacctggtggagtcgtgggggagcgtggtccagcctgggagtccctgagctctcctgtgaagcctntggtatttagttcagtgttctggcatgcacgtgggtccnccaggctccgagggcgaagggggccgtagttggtggctagttanagcacatgatgggaaagttcagtaaatattagngacagtacgtcggtaggaacggcctataccacctatccacgagacgactaacgttacccgggaattagttgtacgttagtaggaacgtcggtacacgtccgtaggaacggtaggtaacggacggttccgttcggttcgttacgttaggttagttcgttggtaacggaggtaaggtacgggtcgggggttaggttaacgggttaaggttaagg

SEQ ID NO: 311288 - DNA, 517 bp, Homo sapiens
  misc_feature: GZ8MTXP01DWSJC.25.36.D03.1.454.CMB.2.raw
  modified_base (246)..(246): a, c, t, g, unknown or other
  misc_feature (246)..(246): n is a, c, g, or t
  modified_base (375)..(375): a, c, t, g, unknown or other
  misc_feature (375)..(375): n is a, c, g, or t
  modified_base (379)..(379): a, c, t, g, unknown or other
  misc_feature (379)..(379): n is a, c, g, or t
  modified_base (422)..(422): a, c, t, g, unknown or other
  misc_feature (422)..(422): n is a, c, g, or t
tcagactgtacagtcacgaccggtgctcgatttagctgcgtcacgatctctcttggggggggtctcaggaggcagcgctctcgggacgtctccaccatggcctgggctctgctgttcctcaccctcctcactcagggcacagggtcctgggcccagtctgccctgactcagcctgcctccgtgtctgggactcctggacagtcggtcaccatctcctgcactggaacccagccgtgaccattggtncttataactatgtctcctggtcccaacaacacccaggcaacggcccccaaactcatcatttactgatgtcagtcatcggccctctggagtttcctggtcgcttctctggctcagtctgcactcgctccngacntcgcgggctcgagctgagacgagctacttattatgtctatttnatacagagacacctaacagtcgtgggtgttcggcgggacggaccgaagttcgaccgttcttcgtcacgcccaaggcttaccgtcccgttcggtcc

SEQ ID NO: 311289 - DNA, 690 bp, Homo sapiens
  misc_feature: GZ8MTXP01B236F.25.36.D03.1.454.CMB.2.raw
  modified_base (229)..(229): a, c, t, g, unknown or other
  misc_feature (229)..(229): n is a, c, g, or t
  modified_base (245)..(245): a, c, t, g, unknown or other
  misc_feature (245)..(245): n is a, c, g, or t
  modified_base (307)..(307): a, c, t, g, unknown or other
  misc_feature (307)..(307): n is a, c, g, or t
tcagactgtacagtcacgaccggtgctcgatttagctgcgtcacgatctctcttggggggggtctcaggaggcagcgctctcgggacgtctccaccatggcctgggctctgctgttcctcaccctcctcactcagggcacagggtcctgggcccagtctgccctgactcagcctgcctccgtgtctgggactcctggacagtcggtcaccatctcctgcactggaaccngccgtgactattggtnacttataactatgtctcctggtcccaacaacacccaggcaaggcccccaaatcatcatttangatgtcagtcatccggccctcgtggtagtttcctggtcgtctttcctcgtcgggccttcccgtaaagttcctcgggacctaaccgttccgggcccttccccgtgaccctagttcccgtccgggggccttcccgaagggtcgtggaacgggacgagggtcttaacgtttagttaacgttggtacttaattttccaaattaacgaggaacgaaccaacctaaacgtaacggtccgttggggttcggtttaccggggacggggtaaacggggttacccgtaaaacgggtttcggaaccccgggttcccgttaccggggttaaccgaaccggtaacccccgaaacggggtcccgttacccgggtccccccccgttcggggttccccc

SEQ ID NO: 311290 - DNA, 554 bp, Homo sapiens
  misc_feature: GZ8MTXP01EFQWM.25.36.D03.1.454.CMB.2.raw
  modified_base (177)..(177): a, c, t, g, unknown or other
  misc_feature (177)..(177): n is a, c, g, or t
  modified_base (279)..(279): a, c, t, g, unknown or other
  misc_feature (279)..(279): n is a, c, g, or t
  modified_base (296)..(296): a, c, t, g, unknown or other
  misc_feature (296)..(296): n is a, c, g, or t
  modified_base (301)..(301): a, c, t, g, unknown or other
  misc_feature (301)..(301): n is a, c, g, or t
  modified_base (310)..(310): a, c, t, g, unknown or other
  misc_feature (310)..(310): n is a, c, g, or t
  modified_base (333)..(333): a, c, t, g, unknown or other
  misc_feature (333)..(333): n is a, c, g, or t
  modified_base (358)..(358): a, c, t, g, unknown or other
  misc_feature (358)..(358): n is a, c, g, or t
  modified_base (397)..(397): a, c, t, g, unknown or other
  misc_feature (397)..(397): n is a, c, g, or t
  modified_base (423)..(423): a, c, t, g, unknown or other
  misc_feature (423)..(423): n is a, c, g, or t
tcagactgtacagtcacgaccggtgctcgatttagctgcgtcacgatctctcttggggtgtgggctcagaagcagagttctggggtgtctccaccatggcctggacccctctctggctcactctcctcactctttgcataggttctgtggtttcttctgaactgactcaggaccccntgtgtctgtggccttgggacagacagtcaggatcacatgaccaaggagacagcctcaagtaacttatatgcatctgaccagcagaagccggacacgcccctntactgtctctacggtanaaacncccgccctnaggactctcacgaccgtattccnctcggctcccgctaacaaggaaccncagtccttcctgaccatcacgtgggctcgaggcacaagntggagctgactattactcggttcccnccgggacaccgaggtggtaagcgtaggtttgtcggttcgttcgggcgggtaagggaaccaagggtcgttaaccgtcgtacgggttcgcgcccgtaagggctcgcccccgtggttacctccgttcgttcccg

SEQ ID NO: 311291 - DNA, 620 bp, Homo sapiens
  misc_feature: GZ8MTXP01EJFN7.25.36.D03.1.454.CMB.2.raw
  modified_base (209)..(209): a, c, t, g, unknown or other
  misc_feature (209)..(209): n is a, c, g, or t
  modified_base (236)..(236): a, c, t, g, unknown or other
  misc_feature (236)..(236): n is a, c, g, or t
  modified_base (352)..(352): a, c, t, g, unknown or other
  misc_feature (352)..(352): n is a, c, g, or t
tcagactgtacagtcacgaccggtgctcgatttagctgcgtcacgatctctcttggggagcttcagctgtggtagagaagacaggattcaggacaatctccagcatggccggcctccctctcctcctcaccctcctcactcactgtgcagggtcctgggcccagtctgtgctgactcagcccaccctcagtgtctcgggacccccgggnagaggtctccatctcttgttctgggancagctccgagtacggaaattagttgtctacgtggtaccagcagcctcccaagaaaccggccccaagcctcctcatctataggaatgatcagcgccctgacggactactgaaccgtnttcctctggctacggaagtcgtggcctccgtccggccctccgtggcccagtccgaggttcgggccttccgggcgaggactggaaggtctagggtaaatttacgtttaaccgtggtgcgttaggttttcgggaacttcgaccgtagttccgtggtaacggttcgggttacccggtagggtttggttaccgggacggggaacgggaccttaaaggcccgttacggaacccgtttcccgagggttacccgtaaccgccccggtaaaccggg

SEQ ID NO: 311292 - DNA, 679 bp, Homo sapiens
  misc_feature: GZ8MTXP01A6TFX.25.36.D03.1.454.CMB.2.raw
  modified_base (228)..(228): a, c, t, g, unknown or other
  misc_feature (228)..(228): n is a, c, g, or t
  modified_base (244)..(244): a, c, t, g, unknown or other
  misc_feature (244)..(244): n is a, c, g, or t
tcagactgtacagtcacgaccggtgctcgatttagctgcgtcacgatctctcttgggggggtctcaggaggcagcgctctcgggacgtctccaccatggcctgggctctgctgttcctcaccctcctcactcagggcacagggtcctgggcccagtctgccctgactcagcctgcctccgtgtctgggactcctggacagtcggtcaccatctcctgcactggaaccngccgtgacattgggtnacttatactatgtctctcgtaccaacaacaccaggacaacgaccccaactcatctattatgtatgtacagtcacgtccggtcctcgtcggtacgtttccgtcggttcgtctttctcgtacggtcctccgtaacgtcgtacgggtacctaaccgtccggtacccttcccgtacgtaccctacgtccggtccgggggtacctccggacggtcgtacgggaacgggaacggtacggtaccttaacgtttacgtttacgttacgtacttaactttactaataacgaacgtaacgtaaccaaccgtaaacgtacgttacggttgggttcggttcggggacgggtaacgggttaaccgtaaacgggttccggttacccggttccgttaccgggtaacaccggtaacccgaacgggtccgttacccgtccccgttcggtccc

SEQ ID NO: 311293 - DNA, 598 bp, Homo sapiens
  misc_feature: GZ8MTXP01DL8CX.25.36.D03.1.454.CMB.2.raw
  modified_base (392)..(392): a, c, t, g, unknown or other
  misc_feature (392)..(392): n is a, c, g, or t
  modified_base (408)..(408): a, c, t, g, unknown or other
  misc_feature (408)..(408): n is a, c, g, or t
tcagactgtacagtcacgaccggtgctcgatttagctgcgtcacgatctctcttggggacccaaaaaccacacccctccttgggagaatcccctagatcacagctcctcaccatggactggacctggagcatccttttcttggtggcagcagcaacaggtgcccactcccaggttcaactggtgcagtctggacctgaggtgaagagcctggggcctcagtgaaggtctcctgcaaggcttctggttacacctttagcagctatggcatcagctgggtgcgacaggcccctggacaaggggcttgagtggatggcatggatcagccttaacatggtatcacagactaatcgcaacgaagggaacttccgaggggcagagtcaccttgaccanagacacactccacgancacacgcctaacgactacgggaccctagggaacgggtacgacccgtaggaacggacttcgtacggaaccggaaccggaaccgggtacccggttaagttaaactttaaccgtcgggttagaccggacgggttaacggttcggtaatttaagttcggtacctttaccggttcccggggttcgttaaccccgg

SEQ ID NO: 311294 - DNA, 630 bp, Homo sapiens
  misc_feature: GZ8MTXP01A1OKT.25.36.D03.1.454.CMB.2.raw
  modified_base (233)..(233): a, c, t, g, unknown or other
  misc_feature (233)..(233): n is a, c, g, or t
  modified_base (326)..(326): a, c, t, g, unknown or other
  misc_feature (326)..(326): n is a, c, g, or t
tcagactgtacagtcacgaccggtgctcgatttagctgcgtcacgatctctcttggggggggtctcaggaggcagcgctctcgggacgtctccaccatggcctgggctctgctgttcctcaccctcctcactcagggcacgagggtcctgggcccagtctgccctgactcagcctgcctccgtgtctgggactcctggacagtcggtcaccatctcctgcacgtacggaaccncgccgtagactagttggtctacttaataactatcgtcctccgtacgtacccaaacaaccaccgaggaccaaccgaccccaatcatctatttangtatcgacagtcacgtccgtcctgtggttactttccgtggtctcttctcgtcgcctcgacgtcgtcgacctacgtccgtccctcctcgacctacgtccggtccgggtcctaccggacggtcgtaggacgggacgacggtacttactttagttacgttcgtacttattactataacgagacaaaccacgtaaacgtcgttcggtggttcggtacgggacgggtaacggaccgtaacggtccgttacccggttccgttccggtaacgaccgaaccgtacggtccgttcccgtccccgttcggtccc

SEQ ID NO: 311295 - DNA, 537 bp, Homo sapiens
  misc_feature: GZ8MTXP01ER961.25.36.D03.1.454.CMB.2.raw
  modified_base (246)..(246): a, c, t, g, unknown or other
  misc_feature (246)..(246): n is a, c, g, or t
  modified_base (303)..(303): a, c, t, g, unknown or other
  misc_feature (303)..(303): n is a, c, g, or t
  modified_base (440)..(440): a, c, t, g, unknown or other
  misc_feature (440)..(440): n is a, c, g, or t
  modified_base (463)..(463): a, c, t, g, unknown or other
  misc_feature (463)..(463): n is a, c, g, or t
tcagactgtacagtcacgaccggtgctcgatttagctgcgtcacgatctctcttggggggggtctcaggaggcagcgctctcgggacgtctccaccatggcctgggctctgctgttcctcaccctcctcactcagggcacagggtcctgggcccagtctgccctgactcagcctgcctccgtgtctgggactccgtggacagtcggtcaccatctcctgcactggaaccagccgtgactattggtncttaataactatgtctctgtacccaacaacaccagcaacgaccccaatcatcattangatgtcagtcatcggcccttgtggtagtttcctggtcgtcttctcgtcggctccaaagtctgggcaacgtcggcctccctgaccatcgcgggctcgagctgaggacgagactacttattattgctattcatacaganacacaacagtctggtgttcgggnggacgggaacgtaaagttcgaccggttccttcgggtcacggcccaagggccttccgtcccccgttcggtaaccc

SEQ ID NO: 311296 - DNA, 583 bp, Homo sapiens
  misc_feature: GZ8MTXP01DPJRC.25.36.D03.1.454.CMB.2.raw
  modified_base (247)..(247): a, c, t, g, unknown or other
  misc_feature (247)..(247): n is a, c, g, or t
  modified_base (267)..(267): a, c, t, g, unknown or other
  misc_feature (267)..(267): n is a, c, g, or t
tcagactgtacagtcacgaccggtgctcgatttagctgcgtcacgatctctcgttggggggggtctcaggaggcagcgctctcgggacgtctccaccatggcctgggctctgctgttcctcaccctcctcactcagggcacagggtcctgggcccagtctgccctgactcagcctgcctccgtgtctgggactcctggacagtcgtcaccatctcctgcactggaaccagccgtgactagttgggtnacttaataactatgtctccncgtacccaacaacaccaggaccaacgaccccaaactcatctattatgatgtcagtcagtcggcctcgtggtagtttccgtggtcgtcttctctacggctccaaagtctcggctaactcggcctccctgacctatcgtcgggctcgacggctaggaggacgaggtcttaatttattaaggtttcgtactacttactactaacgaacgaacgaacaacctaactacgtcgtggtcggtcgggacgggtacggacgtaacgtacgttaccgttccgttcgtaacgacgaaccgacgccgttcccgtcccgttccgtccg

SEQ ID NO: 311297 - DNA, 546 bp, Homo sapiens
  misc_feature: GZ8MTXP01EDS0G.25.36.D03.1.454.CMB.2.raw
  modified_base (247)..(247): a, c, t, g, unknown or other
  misc_feature (247)..(247): n is a, c, g, or t
  modified_base (530)..(530): a, c, t, g, unknown or other
  misc_feature (530)..(530): n is a, c, g, or t
tcagactgtacagtcacgaccggtgctcgatttagctgcgtcacgatctctcttggggggggtctcaggaggcagcgctctcgggacgtctccaccatggcctgggctctgctgttcctcaccctcctcactcagggcacagggtcctgggcccagtctgccctgactcagcctgcctccgtgtctgggactcctggacagtcggtcaccatctcctgcactggaacccagcccgtgacattgggtnacttataactatgtctcctggtcccaacaacacccaggcaacggcccccaaactcatcatttatgatgtcagtcatcggccctctggtagtttcctggtcgtcttctctcggctcaagtctggcaactcggcctccctcgaccatcgtcggggctccgaaggcgtgacgggacgacgggtcttaacttatttaagttcgtactatttcaattacagagacaaccaacagtctggtgttcggcggacggacgaagttcgaccgttcttcggtcacgcccaggcncgtccccgttggtccc

SEQ ID NO: 311298 - DNA, 527 bp, Homo sapiens
  misc_feature: GZ8MTXP01EFRXD.25.36.D03.1.454.CMB.2.raw
  modified_base (228)..(228): a, c, t, g, unknown or other
  misc_feature (228)..(228): n is a, c, g, or t
  modified_base (243)..(243): a, c, t, g, unknown or other
  misc_feature (243)..(243): n is a, c, g, or t
  modified_base (324)..(324): a, c, t, g, unknown or other
  misc_feature (324)..(324): n is a, c, g, or t
  modified_base (335)..(335): a, c, t, g, unknown or other
  misc_feature (335)..(335): n is a, c, g, or t
  modified_base (455)..(455): a, c, t, g, unknown or other
  misc_feature (455)..(455): n is a, c, g, or t
  modified_base (512)..(512): a, c, t, g, unknown or other
  misc_feature (512)..(512): n is a, c, g, or t
tcagactgtacagtcacgaccggtgctcgatttagctgcgtcacgatctctcttgggggggtctcaggaggcagcgctctcgggacgtctccaccatggcctgggctctgctgttcctcaccctcctcactcagggcacagggtcctgggcccagtctgccctgactcagcctgcctccgtgtctgggactcctggacagtcggtcaccatctcctgcactggaaccngccgtgacattggtncttataactatgtctctggtcccaacaacacccaggcaacggcccccaaatcatcatttatgatgtcagtcatcggccctntggagtttccnggtcgcttctctggctccaagtctggcaactcggcctccctgaccatcgtcggggctccgaggcctggaggacgaggcttaacgttattagttgctatttcataccagtagaacaccaanagtctgggtgttcggcggaggaccaagttcgaccgttcttcgggtcagcccaaggcncgtccccgttggtcc

SEQ ID NO: 311299 - DNA, 581 bp, Homo sapiens
  misc_feature: GZ8MTXP01ENVV5.25.36.D03.1.454.CMB.2.raw
  modified_base (270)..(270): a, c, t, g, unknown or other
  misc_feature (270)..(270): n is a, c, g, or t
  modified_base (316)..(316): a, c, t, g, unknown or other
  misc_feature (316)..(316): n is a, c, g, or t
  modified_base (360)..(360): a, c, t, g, unknown or other
  misc_feature (360)..(360): n is a, c, g, or t
  modified_base (365)..(365): a, c, t, g, unknown or other
  misc_feature (365)..(365): n is a, c, g, or t
  modified_base (391)..(391): a, c, t, g, unknown or other
  misc_feature (391)..(391): n is a, c, g, or t
  modified_base (494)..(494): a, c, t, g, unknown or other
  misc_feature (494)..(494): n is a, c, g, or t
  modified_base (530)..(530): a, c, t, g, unknown or other
  misc_feature (530)..(530): n is a, c, g, or t
tcagactgtacagtcacgaccggtgctcgatttagctgcgtcacgatctctcttggggagctctgggagaggagcccagcactagaagtcggcggtgtttccattcggtgatcagcactgaacacagaggactcaccatggagtttgggctgagcttgggttttcctcgttgcttcttttaagaggtgtccactgtcaggtgcaccgtggtggagtcgtggggggagcgtggtccaggccgtggggacgtccctgagactctctgtgaancctgtggtatttagttcagttggttctggcatgcacgtgggtcccncgaggctacgagggcgaaggggggccgagtggtgactaggttanagcanatgatgggaattcagaattattacgngacagtacgtcggaggaacggcctattaccactatcacgaagaacaactaacgttaccggaattagttgtacgtagtagaagtcggtacacgtcgtaggacgnggtcgaacggcgtcgttctagttagttacgtttcgnggtggacggtaaggtgggtacggggttaggtttaagggttaagtttaaggg

SEQ ID NO: 311300 - DNA, 520 bp, Homo sapiens
  misc_feature: GZ8MTXP01AWZBC.25.36.D03.1.454.CMB.2.raw
  modified_base (201)..(201): a, c, t, g, unknown or other
  misc_feature (201)..(201): n is a, c, g, or t
  modified_base (273)..(273): a, c, t, g, unknown or other
  misc_feature (273)..(273): n is a, c, g, or t
  modified_base (316)..(316): a, c, t, g, unknown or other
  misc_feature (316)..(316): n is a, c, g, or t
  modified_base (358)..(358): a, c, t, g, unknown or other
  misc_feature (358)..(358): n is a, c, g, or t
  modified_base (363)..(363): a, c, t, g, unknown or other
  misc_feature (363)..(363): n is a, c, g, or t
  modified_base (385)..(385): a, c, t, g, unknown or other
  misc_feature (385)..(385): n is a, c, g, or t
  modified_base (407)..(407): a, c, t, g, unknown or other
  misc_feature (407)..(407): n is a, c, g, or t
  modified_base (432)..(432): a, c, t, g, unknown or other
  misc_feature (432)..(432): n is a, c, g, or t
  modified_base (436)..(436): a, c, t, g, unknown or other
  misc_feature (436)..(436): n is a, c, g, or t
  modified_base (449)..(449): a, c, t, g, unknown or other
  misc_feature (449)..(449): n is a, c, g, or t
  modified_base (457)..(457): a, c, t, g, unknown or other
  misc_feature (457)..(457): n is a, c, g, or t
  modified_base (485)..(485): a, c, t, g, unknown or other
  misc_feature (485)..(485): n is a, c, g, or t
  modified_base (495)..(495): a, c, t, g, unknown or other
  misc_feature (495)..(495): n is a, c, g, or t
tcagactgtacagtcacgaccggtgctcgatttagctgcgtcacgatctctcttggggagctctgggagaggagcccagcactagaagtcggcggtgtttccattcggtgatcagcactgaacacagaggactcaccatggagtttgggctgagcttgggttttcctcgttgctcttttaagaggtgtccactgtcaggtncacctgggtggagtcgtgggggagcgtggtccaggccgtggggacgtccctgagactctcctgtgaagcctntggtatttagtttcagttggttctggcatgcactggggtcccnccaggcctccgaggcgaagggggccgagtggtggctagttanagcantgatggaattcagtaatattangcagactcgagaggccatcacntcacagacgactactcccgggaatnttgntacttggaatgangtctgagngtcgaggctcggcttgtacgttattcgngtgcgtaagnggtcggggaggttggttaagttaag

SEQ ID NO: 311301 - DNA, 587 bp, Homo sapiens
  misc_feature: GZ8MTXP01DV4ZF.25.36.D03.1.454.CMB.2.raw
  modified_base (209)..(209): a, c, t, g, unknown or other
  misc_feature (209)..(209): n is a, c, g, or t
  modified_base (234)..(234): a, c, t, g, unknown or other
  misc_feature (234)..(234): n is a, c, g, or t
  modified_base (520)..(520): a, c, t, g, unknown or other
  misc_feature (520)..(520): n is a, c, g, or t
tcagactgtacagtcacgaccggtgctcgatttagctgcgtcacgatctctcttggggagcttcagctgtggtagagaagacaggattcaggacaatctccagcatggccggcctccctctcctcctcaccctcctcactcactgtgcagggtcctgggcccagtctgtgctgactcagcccaccctcagtgtcgtcgggacccccggnagaggtctcatctcttgtctgggancagctcgacgtacggaaatagttgtctactggtaccagcagcctacccgaagaaacccggcccccaaagcctcctcatctataggaatgatcgacgccgcccctagaccgggataccgtgaacccgtattcctcgttcggctacgaagttccgtcggccttcccgtccggccctcccgtcggaccatcgaggtcgggcctccgggtcgaggatggacgtctagggtaattagttactggtgtcgtaggtttgggatcgtacctgtcgtggaaggtcggttaccggngggttggtcgggcggacgggacaacggctacggtaacccgttcgacggccaaccggcccgtaaccgg

SEQ ID NO: 311302 - DNA, 732 bp, Homo sapiens
  misc_feature: GZ8MTXP01DXNFT.25.36.D03.1.454.CMB.2.raw
tcagactgtacagtcacgaccggtgctcgatttagctgcgtcacgatctctcttggggagcttcagctgtggtagagaagacaggattcaggacaatctccagcatggtcggcctccctctcctcctcaccctcctcactcactgtgcagggtcctgggcccagtctgtgctgactcagccaccctcggtgtctgaacgcccccaggcagaggtcaccatctcctgttctggaagcagctccaacgtcggagataatgctgtaaactggtaccagcaggtcccagggaacgctacccaaactctacatctaataggaatgatcagccggccccctcgaaggggactacccgtacgaaaccccgtatttccgtccgttcggggaccttaccggaaacggtttccgttcggggtccctttccccgtccggggtcccccttaccccgttgggcccctaaagttccccgtaagggtttccgggggaccctttccccgggggtcccggaaaggggtacgttcgggaaacggggggttccgttaggtaaaatttacgtttaaccgtggtttacggccgttaagggttttggggaattcggcccgtaagggttccgttgggttaggttccggggttcccggtaacgggggtttcgggtttccgggggcggggttaacggggaaccccgtaaggcccgtttacggaaccccgggttccgtaacgggttcccgaacccggg

SEQ ID NO: 311303 - DNA, 745 bp, Homo sapiens
  misc_feature: GZ8MTXP01BZ239.25.36.D03.1.454.CMB.2.raw
  modified_base (187)..(187): a, c, t, g, unknown or other
  misc_feature (187)..(187): n is a, c, g, or t
  modified_base (209)..(209): a, c, t, g, unknown or other
  misc_feature (209)..(209): n is a, c, g, or t
  modified_base (242)..(242): a, c, t, g, unknown or other
  misc_feature (242)..(242): n is a, c, g, or t
  modified_base (270)..(270): a, c, t, g, unknown or other
  misc_feature (270)..(270): n is a, c, g, or t
  modified_base (378)..(378): a, c, t, g, unknown or other
  misc_feature (378)..(378): n is a, c, g, or t
tcagactgtacagtcacgaccggtgctcgatttagctgcgtcacgatctcgtcttggggagcttcagctgtggtagagaagacaggattcaggacaatctccagcatggccggcctccctctcctcctcaccctcctcactcactgtgcagggtcctgggcccagtctgtgctgactcagccacctnagtgtcgtcgggaccccccggnaggcggtcctccattccttcgttgtcgtgggancagtcctccgacgtacgtaaattagttntactacgtacgtacagcacgcctacccgaacggaaccccgccccagtcctccactatactagtaggatgactcgacgccggacctacgacggtactacgtcgaccgtnttctcgtcgctacggtacgtcgtcgtcctcccgtccgtccctccgcggacctacgtccgacgggttccgggtacccgttccgggtaccggaggtacgtcgggtacggtacgttaagggttaaacgtttacgtttaaccgttcgggttacggtacggtttagggtttacggggtaacgttaccgggtacccgttacgttccggttggggtaacgggtttccggggttacccggggttaccgggggttcggggttacccgggggtacggggttaaaccggggttacccgttaacgggtcccggtaccgggttaacccggttacccgggtaccgggttacccggtaacccgggttaaccccggtaaccgg

SEQ ID NO: 311304 - DNA, 663 bp, Homo sapiens
  misc_feature: GZ8MTXP01DQK2N.25.36.D03.1.454.CMB.2.raw
  modified_base (228)..(228): a, c, t, g, unknown or other
  misc_feature (228)..(228): n is a, c, g, or t
  modified_base (244)..(244): a, c, t, g, unknown or other
  misc_feature (244)..(244): n is a, c, g, or t
  modified_base (328)..(328): a, c, t, g, unknown or other
  misc_feature (328)..(328): n is a, c, g, or t
tcagactgtacagtcacgaccggtgctcgatttagctgcgtcacgatctctcttgggggggttctcaggaggcagcgctctcgggacgtctccaccatggcctgggctctgctgttcctcaccctcctcactcagggcacagggtcctgggcccagtctgccctgactcagcctgcctccgtgtctgggactcctggacagtcggtcacatctcctgcactggaaccngccgtgacattgggtntcttataactatgtctcctggtcccaacaacaccagacaacggcccccaaactcatctatttatgatgtcagtcatcggccctntgtactttcctggtcgtcttctctacgggtctccgaagtccgtcgggacctaaccgtccgggcccttccctacgacctacgtccgtcgggggccttcccgaagggtcctaggacggacgacggtcttaactttatttagggttacgtcttaacttttccaattaaacgcggaacgaacctaccgaaaacctagttccgtgggttcgggtttacggacgggggtaaacggttaaccccgtaaaggttttcgggaaaccccgttcccggttacggttaacccgaacgaacccgttaaacggggcccttcccgggtcccccccgttaaggggttcccc

SEQ ID NO: 311305 - DNA, 634 bp, Homo sapiens
  misc_feature: GZ8MTXP01BAVB6.25.36.D03.1.454.CMB.2.raw
tcagactgtacagtcacgaccggtgctcgatttagctgcgtcacgatctctcttggggagcttcagctgtggtagagaagacaggattcaggacaatctccagcatggccggcctccctctcctcctcaccctcctcactcactgtgcagggtcctgggcccagtctgtgctgactcagccaccctcagtgtctcgggacccccgggcagagggtctccatctcttgtctgggagcagctccgacgtacggaaataagttgtctactggtaccagcagcctaccccgaagaaacccggcccccaaagcctcctcatctataggatgatcacgccggccctcgacggactacgtgaccgtattctcgtggctacgaacgtctcggcctccgtccggccctcccgtggcccatccgaggttcgggccgttccgggtacccgaggacgtggacgggtcctaggggtaaattagtttaaccgtgtcggcgtaggtttggggattcgcccgtagtcgtggtaacggtcgggttacccgggtcgggttggttaccggggcggggaaccgggggttccaaacgggtccgtaccgggtaaccccggttcgtaacgggttccaaccgggttccccgaaccggg

SEQ ID NO: 311306 - DNA, 605 bp, Homo sapiens
  misc_feature: GZ8MTXP01ATYJG.25.36.D03.1.454.CMB.2.raw
  modified_base (245)..(245): a, c, t, g, unknown or other
  misc_feature (245)..(245): n is a, c, g, or t
  modified_base (309)..(309): a, c, t, g, unknown or other
  misc_feature (309)..(309): n is a, c, g, or t
tcagactgtacagtcacgaccggtgctcgatttagctgcgtcacgatctctcttggggggggtctcaggaggcagcgctctcgggacgtctccaccatggcctgggctctgctgttcctcaccctcctcactcagggcacagggtcctgggcccagtctgccctgactcagcctgcctccgtgtctgggactcctggacagtcggtcaccatctcctgcactggaaccagccgtgactattggtntacttatactatgtctcctgtacccaacaacacccaggcaacggcccccaaactcatcatttangatgtcagtcatcggccctgtggtagtttccgtggtcgtctttctctcgggaccttccgaagtcctgggacctaacctccgggccctccctcgaccctacgttccgtcggggtcctcccgaggccgtaggacggacgtaggacttaactttagttattgtacctattcctatacgacgataccacaactacgtacgtgggtcgttcgggacgggacgggttaaccgtaggttcgaccggttccgttcggtccgacgaacccgtaaggcccgttccgtcccccgttcggttaacccc

SEQ ID NO: 311307 - DNA, 527 bp, Homo sapiens
  misc_feature: GZ8MTXP01DV0H4.25.36.D03.1.454.CMB.2.raw
  modified_base (246)..(246): a, c, t, g, unknown or other
  misc_feature (246)..(246): n is a, c, g, or t
  modified_base (311)..(311): a, c, t, g, unknown or other
  misc_feature (311)..(311): n is a, c, g, or t
  modified_base (331)..(331): a, c, t, g, unknown or other
  misc_feature (331)..(331): n is a, c, g, or t
  modified_base (342)..(342): a, c, t, g, unknown or other
  misc_feature (342)..(342): n is a, c, g, or t
  modified_base (379)..(379): a, c, t, g, unknown or other
  misc_feature (379)..(379): n is a, c, g, or t
  modified_base (384)..(384): a, c, t, g, unknown or other
  misc_feature (384)..(384): n is a, c, g, or t
tcagactgtacagtcacgaccggtgctcgatttagctgcgtcacgatctctcttggggggggtctcaggaggcagcgctctcgggacgtctccaccatggcctgggctctgctgttcctcaccctcctcactcagggcacagggtcctgggggcccagtctgccctgactcagcctgcctccgtgtctgggactcctggacagtcggtcaccatctctgcactggaaccagccgtgactattggtnacttaataactatgtctcctggtacccaacaaccacccaggcaacggcccccaaatcatcattangatgtcagtcatcggccctntggtatttccnggtctcttctctaggctcgagtctgcactcgcctccngaccntcgcgggctcgaggctgagcgagctacttattatgctattcatacagagaacacctaactagtctgggtaagtcggacggacgggacctaaggtcgaccgttcgttcggtcacgcccgagccttaccgtccccgttcggtccc

SEQ ID NO: 311308 - DNA, 621 bp, Homo sapiens
  misc_feature: GZ8MTXP01DWUGX.25.36.D03.1.454.CMB.2.raw
  modified_base (311)..(311): a, c, t, g, unknown or other
  misc_feature (311)..(311): n is a, c, g, or t
  modified_base (351)..(351): a, c, t, g, unknown or other
  misc_feature (351)..(351): n is a, c, g, or t
  modified_base (356)..(356): a, c, t, g, unknown or other
  misc_feature (356)..(356): n is a, c, g, or t
tcagactgtacagtcacgaccggtgctcgatttagctgcgtcacgatctctcttggggagctctgggagaggagcccagcactagaagtcggcggtgttaccattcggtgatcagcactgaacacagaggactcaccatggagttgggctgagcttgggttttcctcgttgcttcttttaagaggtgtccactgtcaggtgcacctggtggagtcgtgggggagcgtggtccagccgtgggagtccctgagactctcctgtgaagcctctggtatttagttcagttggttctggcatgctacgtgggtccnccaggcctcgagggcgaagggggccgagtggtgctagtanagcanatgatgggaaatttcagtaaattattagtgaccagtaccgtccggtaggaacggggtcctaattaccacctattccaaccgaagaacgtaaactaaacgtttaccccgggggaaatagtttagtagtaacgttaggaaattggtaccagtccgtagagcggtcgaggttaccgtcgggacttcgttggttaatttccgttggttaaccgggagtaaggtacgggttacgggggttagggtttaagggttaaggttttaaacgggg

SEQ ID NO: 311309 - DNA, 572 bp, Homo sapiens
  misc_feature: GZ8MTXP01AUBPS.25.36.D03.1.454.CMB.2.raw
  modified_base (245)..(245): a, c, t, g, unknown or other
  misc_feature (245)..(245): n is a, c, g, or t
  modified_base (264)..(264): a, c, t, g, unknown or other
  misc_feature (264)..(264): n is a, c, g, or t
  modified_base (302)..(302): a, c, t, g, unknown or other
  misc_feature (302)..(302): n is a, c, g, or t
  modified_base (322)..(322): a, c, t, g, unknown or other
  misc_feature (322)..(322): n is a, c, g, or t
  modified_base (499)..(499): a, c, t, g, unknown or other
  misc_feature (499)..(499): n is a, c, g, or t
tcagactgtacagtcacgaccggtgctcgatttagctgcgtcacgatctctcgttgggggggtctcaggaggcagcgctctcgggacgtctccaccatggcctgggctctgctgttcctcaccctcctcactcagggcacagggtccgtgggcccagtctgccctgactcagcctgcctccgtgtctggactcctggacagtcgtcaccatctcctgcactggaaccagccgtgactagttggtntacttataactatgtctcngtccaacaacaccaggcaacgccccaatcatcatttangatgtcagtcactcggcctntggtagtttccgtcggtcgtcttctcgtacgggctccgaagttcgtcgggacctaaccgtccgggtcccttcccgtacgaccctacgtccgtccgggggccttcccgagggtcctaggacgggacgtacggtacttaactttagtttactgtacttatttcatacagacacacaacngtcgtagggtcgttacggcggaggaccgtagtcgaccgttcgcgtcacgccgagccttcgccccgttggtccc

SEQ ID NO: 311310 - DNA, 587 bp, Homo sapiens
  misc_feature: GZ8MTXP01CJFVY.25.36.D03.1.454.CMB.2.raw
  modified_base (188)..(188): a, c, t, g, unknown or other
  misc_feature (188)..(188): n is a, c, g, or t
  modified_base (208)..(208): a, c, t, g, unknown or other
  misc_feature (208)..(208): n is a, c, g, or t
  modified_base (575)..(575): a, c, t, g, unknown or other
  misc_feature (575)..(575): n is a, c, g, or t
tcagactgtacagtcacgaccggtgctcgatttagctgcgtcacgatctctcttggggagcttcagctgtggtagagaagacaggattcaggacaatctccagcatggccggcctccctctcctcctcaccctcctcactcactgtgcagggtcctgggcccagtctgtgctgactcacgccaccctnagtgtcgtcgggaccccggnaggaggtctccatctcctgcactggaaccagccgtgactagttggtgtacttataactatcgtcctcctcggtaccccaaacaaaccaccccaaggaccaaaccggacccccaaactcctaatctatttatgatgtacagtcactccccggcctcgtggtactttcgtcggtcgtcttctacgtcgggcctaccgaagttccaggacctacgtccggccctcccgtcgaacctgtccggtccgggcctccggagtcgtaggacgggacggacggtaccttattatttatcgtctatttacatacgagacacaaccagttagtcgttggtacgtcggacggagacgtaagtcgaaccgtcgcgttacnccgcgtaaccgg

SEQ ID NO: 311311 - DNA, 541 bp, Homo sapiens
  misc_feature: GZ8MTXP01APT3P.25.36.D03.1.454.CMB.2.raw
  modified_base (246)..(246): a, c, t, g, unknown or other
  misc_feature (246)..(246): n is a, c, g, or t
  modified_base (264)..(264): a, c, t, g, unknown or other
  misc_feature (264)..(264): n is a, c, g, or t
  modified_base (329)..(329): a, c, t, g, unknown or other
  misc_feature (329)..(329): n is a, c, g, or t
tcagactgtacagtcacgaccggtgctcgatttagctgcgtcacgatctctcttggggggggtctcaggaggcagcgctctcgggacgtctccaccatggcctgggctctgctgttcctcaccctcctcactcagggcacagggtcctgggcccagtctgccctgactcagcctgcctccgtgtctgggactcctggacagtcggtcaccatctcctgcactggaaccagccgtgactattgggtncttataactatgtctccnggtacccaacaacacccaggccaacggcccccaaatcatcatttatgatgtcagtcatcggcctntggatttctggtcgtcttctctaggctccgaagtctggcaacgtcggcctccctgaccatcgtcggggctccgaggcctgacggacgaggcttacttattagtgctatttcatacagacgacacaactgtcgtggtaagtcgggcgggagggacctaaaggttcgaccgttcttcggtcagcccgaagggccttccgtccccgttgggtccc

SEQ ID NO: 311312 - DNA, 574 bp, Homo sapiens
  misc_feature: GZ8MTXP01ECFPC.25.36.D03.1.454.CMB.2.raw
  modified_base (211)..(211): a, c, t, g, unknown or other
  misc_feature (211)..(211): n is a, c, g, or t
  modified_base (301)..(301): a, c, t, g, unknown or other
  misc_feature (301)..(301): n is a, c, g, or t
  modified_base (308)..(308): a, c, t, g, unknown or other
  misc_feature (308)..(308): n is a, c, g, or t
  modified_base (353)..(353): a, c, t, g, unknown or other
  misc_feature (353)..(353): n is a, c, g, or t
  modified_base (358)..(358): a, c, t, g, unknown or other
  misc_feature (358)..(358): n is a, c, g, or t
tcagactgtacagtcacgaccggtgctcgatttagctgcgtcacgatctctcttggggagcttcagctgtgggtagagaagacaggactcaggacaatctccagcatggccagcttcccctctcctcctcaccctcctcactcactgtgcagggtcctgggcccagtctgtgctgtctcagccacctcagtgtcgtcgggggccccccggnagagggtcacatctcttgttctggaagtcgctccaacgtcggcagtaatagtgtaagctggtaccagcaactcccaggaaccgcccccanactcctnatgtatgggaatgatcagccgccctcgacggggtcctgacccgtnttccnctcgccctccgacgtctcggcacctcacgtccctcccgtcggcctacgtccggtcgggcctaccaagttcgagaggattggaggggacccgtatttattagttgacgtcgaggtcggtgggatgaacgaaggaaacgtaaggttatggttcgttaggtaagttcgggaaccttaacggtcaccgtcgtagggccacggtaacccgaacggaacccc

SEQ ID NO: 311313 - DNA, 550 bp, Homo sapiens
  misc_feature: GZ8MTXP01ERTOH.25.36.D03.1.454.CMB.2.raw
  modified_base (317)..(317): a, c, t, g, unknown or other
  misc_feature (317)..(317): n is a, c, g, or t
tcagactgtacagtcacgaccggtgctcgatttagctgcgtcacgatctctcttggggagcttcagctgtggtagagaagacaggattcaggacaatctccagcatggccggcctccctctcctcctcaccctcctcactcactgtgcagggtcctgggcccagtctgtgctgactcagccaccctcagtgtctcgggacccccgggcagagggtctccatctcttgttctgggagcagctccgacgtcggaaataagttgtcactggtaccagcacgccaccgacgaaccgaccccacgctcctcatactagtagncaatgacgtcgaccgtaccgacccggtctaccggtagtaacccgtacgtaccgtacttcgtctcgacgtcgtacgtctcgtcgtcctcccgtccgtccctcgtccgacgtcgacgtcgggggtcgtcggtccgtacggagtgtagacgtagtatagtacgtgtgtgtagttggtcgttgtcgtgttcgttggttcgtggtcggtcggtcggtcgggacggtaacggcgtaacg

SEQ ID NO: 311314 - DNA, 749 bp, Homo sapiens
  misc_feature: GZ8MTXP01APEC6.25.36.D03.1.454.CMB.2.raw
  modified_base (228)..(228): a, c, t, g, unknown or other
  misc_feature (228)..(228): n is a, c, g, or t
  modified_base (245)..(245): a, c, t, g, unknown or other
  misc_feature (245)..(245): n is a, c, g, or t
  modified_base (305)..(305): a, c, t, g, unknown or other
  misc_feature (305)..(305): n is a, c, g, or t
  modified_base (315)..(315): a, c, t, g, unknown or other
  misc_feature (315)..(315): n is a, c, g, or t
tcagactgtacagtcacgaccggtgctcgatttagctgcgtcacgatctctcgttggggggggtctcaggaggcagcgctctcgggacgtctccaccatggcctgggctctgctgttcctcaccctcctcactcagggcacagggtcctgggcccagtctgccctgactcagcctgcctccgtgtctgggactcctggacagtcgtcaccatctctgcactggaaccngccgtagactattggtntacttataactatgtctcctggtacccaacaaccacccaggaccaacggacccccaaacncatcatttangatgtcagtcagtccggccctcgtggtacgtttccgtggtcgtccgtttctcctgggcctccgaaagtccgtacgggaccaaccgtccgggtcccctccccgtacgaccctacgtccgtccgggggccttaccgacgggtccgtagggaacgggaccgagggtaccttaacgtttagtttaacgtttcggtaccttaatttttaccaacgtttaaccgtaacgggaacgttaaaccccgaaaccctaaaccggtaacggtttacccggttgggggtttaaccgggtttaccgggggaccgggggtaaacggggttaaaccccgtaaacgggtttacgttaaccccgggtttcccgttaccggggttaacccaaccgggtaaccccgtaaacgggtccccgttacccgggtcccccccgttccggggttaacccc

SEQ ID NO: 311315 - DNA, 782 bp, Homo sapiens
  misc_feature: GZ8MTXP01EU41X.25.36.D03.1.454.CMB.2.raw
  modified_base (211)..(211): a, c, t, g, unknown or other
  misc_feature (211)..(211): n is a, c, g, or t
  modified_base (245)..(245): a, c, t, g, unknown or other
  misc_feature (245)..(245): n is a, c, g, or t
  modified_base (268)..(268): a, c, t, g, unknown or other
  misc_feature (268)..(268): n is a, c, g, or t
  modified_base (307)..(307): a, c, t, g, unknown or other
  misc_feature (307)..(307): n is a, c, g, or t
  modified_base (348)..(348): a, c, t, g, unknown or other
  misc_feature (348)..(348): n is a, c, g, or t
tcagactgtacagtcacgaccggtgctcgatttagctgcgtcacgatcgtcgtcttggggagcttcagctgtggtagagaagacaggattcaggacaatctccagcatggccggcctccctctcctcctcaccctcctcactcacttgtgcaggtcctgggcccagtctgtgctgactcagcccaccctgagtgtcgtcgggacccccggnaggacgggtcctccgattctcttgttcgtgggancagctccgagtcggaaatagttntcactggtaccagcagctccgagaaccgccccagctccnatctagtaggatgactcacgccgccctagacgggactacgngtaaccgtatttcctcgtcggtacctacggtaaacgtcccgttccggggtcccttccccgttccccgggtccccctttacccggtcgggaaccccctagttacccggtaaacggggtttccccggggtaaccccgttttccccgggggaacccgtaaaggggttacccgtagggttaaaccgggtaccttaacggggggtaaactttttagttaaacccggtgggtacggtaaccggttggggttttaggggaacctttaccggccccgttaaggttccgttggggtaacgggttttccgggttccggggttaaacgggggttttcggtaaccggggaccgggggttaaacgttaccccggaaggttcccggttaccggaaaccccggttttccggtaacggggaccttaaccccggaacccgggtaacccggg

SEQ ID NO: 311316 - DNA, 498 bp, Homo sapiens
  misc_feature: GZ8MTXP01BGEFI.25.36.D03.1.454.CMB.2.raw
  modified_base (228)..(228): a, c, t, g, unknown or other
  misc_feature (228)..(228): n is a, c, g, or t
  modified_base (243)..(243): a, c, t, g, unknown or other
  misc_feature (243)..(243): n is a, c, g, or t
  modified_base (305)..(305): a, c, t, g, unknown or other
  misc_feature (305)..(305): n is a, c, g, or t
  modified_base (411)..(411): a, c, t, g, unknown or other
  misc_feature (411)..(411): n is a, c, g, or t
  modified_base (425)..(425): a, c, t, g, unknown or other
  misc_feature (425)..(425): n is a, c, g, or t
  modified_base (470)..(470): a, c, t, g, unknown or other
  misc_feature (470)..(470): n is a, c, g, or t
tcagactgtacagtcacgaccggtgctcgatttagctgcgtcacgatctctcttggggggtctcaggaggcagcgctctcgggacgtctccaccatggcctgggctctgctgttcctcaccctcctcactcagggcacagggtcctgggcccagtctgccctgactcagcctgcctccgtgtctgggactcctggacagtcggtcaccatctcctgcactggaacccngccgtgacattggtncttataactatgtctcctggtcccaacaacacccaggcaaggcccccaaactcatcatttangatgtcagtcatcgcctctgagtttcctggtcgcttctctggctccaagtctggcactcgctcctgaccatctcgggctcaggctgagacgagctacttatattgntatttcatacaganacaccaacagtctggtgttcggaggaggacgaagttgaccgttcncggtcagccaggcttcgccccttggtcc

SEQ ID NO: 311317 - DNA, 518 bp, Homo sapiens
  misc_feature: GZ8MTXP01C300V.25.36.D03.1.454.CMB.2.raw
  modified_base (345)..(345): a, c, t, g, unknown or other
  misc_feature (345)..(345): n is a, c, g, or t
  modified_base (445)..(445): a, c, t, g, unknown or other
  misc_feature (445)..(445): n is a, c, g, or t
  modified_base (480)..(480): a, c, t, g, unknown or other
  misc_feature (480)..(480): n is a, c, g, or t
tcagactgtacagtcacgaccggtgctcgatttagctgcgtcacgatctctcttggggacccaaaaaccacacccctccttgggagaatcccctagatcacagctcctcaccatggactggacctggagcatccttttcttggtggcagcagcaacaggtgcccactcccaggttcaactggtgcagtctggacctgaggtgaagaagcctggggcctcagtgaaggtctcctgcaaggcttctggttacacctttagcagctatggcatcagctgggtgcgacacggcccctggacaaggggcttgagtggatggcagtggatcagccttaacatcggtatcanagactaatgcacagggaacttccgagggcagacgtcacttgaccacagacacactccacgagcacagccctacgacgtggacctggaggacgcctagagntctgacgacgaacggtcgttatattacgtgtgcgngagtcgtattaagtcgtcttacgtccgttcgtaacccg

SEQ ID NO: 311318 - DNA, 567 bp, Homo sapiens
  misc_feature: GZ8MTXP01D5Z5F.25.36.D03.1.454.CMB.2.raw
  modified_base (244)..(244): a, c, t, g, unknown or other
  misc_feature (244)..(244): n is a, c, g, or t
  modified_base (467)..(467): a, c, t, g, unknown or other
  misc_feature (467)..(467): n is a, c, g, or t
tcagactgtacagtcacgaccggtgctcgatttagctgcgtcacgatctctcttggggggggtctcaggaggcagcgctctcgggacgtctccaccatggcctgggctctgctgttcctcaccctcctcactcagggcacagggtcctgggcccagtctgccctgactcagcctgcctccgtgtctgggactcctggacagtcgtcaccatctcctgcactggaaccagccgtgactattggtncttataactatgtctcctggtacccaacaacacccaggccaaacggccccccaaatcatctatttatgatgtcagtcatccggccctcgtggtacgtttcctggttcgtcttctctgggctccgaaagtcctgggcctaaccgtcgggcccttccctgacctatcgtcggggctccgaggctgacggacgaggtctacttattagttgctatttcatacaganacactacagtctggtggttcggacggtacggaccgtaaggtttacccgttcgttcggttccaagcccgaaggtcctccgccccttcggttccgtaacccg

SEQ ID NO: 311319 - DNA, 546 bp, Homo sapiens
  misc_feature: GZ8MTXP01AUXG2.25.36.D03.1.454.CMB.2.raw
  modified_base (226)..(226): a, c, t, g, unknown or other
  misc_feature (226)..(226): n is a, c, g, or t
  modified_base (240)..(240): a, c, t, g, unknown or other
  misc_feature (240)..(240): n is a, c, g, or t
  modified_base (256)..(256): a, c, t, g, unknown or other
  misc_feature (256)..(256): n is a, c, g, or t
  modified_base (460)..(460): a, c, t, g, unknown or other
  misc_feature (460)..(460): n is a, c, g, or t
tcagactgtacagtcacgaccggtgctcgatttagctgcgtcacgatctctcttggggggtctcaggaggcagcgctctcgggacgtctccaccatggcctgggctctgctgttcctcaccctcctcactcagggcacagggtcctgggcccagtctgccctgactcagcctgcctccgtgtctgggactcctggacagtcgtcaccatctcctgcactggaaccngccgtgacattggncttatactatgtctcnggtcccaacaacaccaggcaacggcccccaaatcatcatttatgatgtcagtcatcggccctctggtagtttcctggtcgcttctctacggcctcgaagtctgggccaaccgtcggccctccctgacccagtcgtcggggcctcccgaggcctgacggacgaggcttacttagttattgctatttcatacagtagacaccaaangtctgggtcgttcggcggtacggacgtaaaggttcgacccgttccttacgggtcacggcccaaggccttccgtccccgttggtccc

SEQ ID NO: 311320 - DNA, 670 bp, Homo sapiens
  misc_feature: GZ8MTXP01B7Q8E.25.36.D03.1.454.CMB.2.raw
  modified_base (212)..(212): a, c, t, g, unknown or other
  misc_feature (212)..(212): n is a, c, g, or t
  modified_base (304)..(304): a, c, t, g, unknown or other
  misc_feature (304)..(304): n is a, c, g, or t
tcagactgtacagtcacgaccggtgctcgatttagctgcgtcacgatctctcttggggagcttcagctgtgggtagagaagacaggactcaggacaatctccagcatggccagcttccctctcctcctcaccctcctcactcactgtgcagggtcctgggcccagtctgtgctgtctcagcccaccctcagtgtcgtcgggggccccccggnaggagggtcgacatctcttgttctggaagtcgctccaacgtcggcagtaatagtgtaagctggtaccagcaactcccaggaaccgcccccanactcctcatgtatgggaatgatcagccgcccctcgacggggtcctgacccgtattcctctcgccctccacgtctcgggccacccgtcacgtccctcccgtcggccctacgtcccggtcgggccttacccaaattccgtagacgggaattcgggaacgggggcccgttaagtttatttaagtttggtgccgtaaggtccgggttgggaagttaggaaccgaaaggggtaaacggtaaacgggtttagttacggttacgtttacgggtaaagtttcgggggaaacccttaaacggggttaacccgtaaccccggttcccgtttaaggggtacccaacggtaacccccgaaaacggggtaacccccccg

SEQ ID NO: 311321 - DNA, 571 bp, Homo sapiens
  misc_feature: GZ8MTXP01BG0SZ.25.36.D03.1.454.CMB.2.raw
  modified_base (208)..(208): a, c, t, g, unknown or other
  misc_feature (208)..(208): n is a, c, g, or t
  modified_base (261)..(261): a, c, t, g, unknown or other
  misc_feature (261)..(261): n is a, c, g, or t
  modified_base (300)..(300): a, c, t, g, unknown or other
  misc_feature (300)..(300): n is a, c, g, or t
  modified_base (306)..(306): a, c, t, g, unknown or other
  misc_feature (306)..(306): n is a, c, g, or t
tcagactgtacagtcacgaccggtgctcgatttagctgcgtcacgatctctcttggggagcttcagctgtgggtagagaagacaggactcaggacaatctccagcatggccagcttccctctcctcctcaccctcctcactcactgtgcagggtcctgggcccagtctgtgctgtctcagccaccctcagtgtctggggccccccggnagagggtcgacatctcttgttctggaagtcgctccaacgtcggcagtaatagngtaagctggtaccagccaactcccaggaaccgcccccanactccncatgtatgggaatgatcagccgcccctcacggggtcctgacccgattctctgccctccacgtctggccactcacgccctccctggccatcccgtggcctccaatctgagatgacggggccgtatttattagttgtgaagcgtaggggatggaacagggaagaaacgggttattggttcttacgggaagtttcggggaaccgttagggttccctaacccggttacctaacgggtcacgaccccgaaaccggttccccaaacccccg

SEQ ID NO: 311322 - DNA, 519 bp, Homo sapiens
  misc_feature: GZ8MTXP01DFRI6.25.36.D03.1.454.CMB.2.raw
  modified_base (208)..(208): a, c, t, g, unknown or other
  misc_feature (208)..(208): n is a, c, g, or t
  modified_base (235)..(235): a, c, t, g, unknown or other
  misc_feature (235)..(235): n is a, c, g, or t
  modified_base (302)..(302): a, c, t, g, unknown or other
  misc_feature (302)..(302): n is a, c, g, or t
  modified_base (482)..(482): a, c, t, g, unknown or other
  misc_feature (482)..(482): n is a, c, g, or t
tcagactgtacagtcacgaccggtgctcgatttagctgcgtcacgatctctcttggggagcttcagctgtggtagagaagacaggattcaggacaatctccagcatggccggcctccctctcctcctcaccctcctcactcactgtgcagggtcctgggcccagtctgtgctgactcagcccaccctcagtgtctgggacccccgggnagagggtctccatctcttgtctgggancagctccgacgtcgaaataagttgtcactggtaccagcagctcccagaaacggcccccaagcctccncatctataggaatgatcagcggcctcacgggatactgaccgattcctctggctcgaaagtctggctccgtcggccctcccgtggcccatcaggtcgggccttccggtccgaggatggagctagggaattgttactgtgcgtggttggatgcctagtctgaagtggccgtaggttgtcggnggttaggcaagctgccgtcgagttcaagcccgaacgg

SEQ ID NO: 311323 - DNA, 604 bp, Homo sapiens
  misc_feature: GZ8MTXP01DT6LT.25.36.D03.1.454.CMB.2.raw
  modified_base (178)..(178): a, c, t, g, unknown or other
  misc_feature (178)..(178): n is a, c, g, or t
  modified_base (285)..(285): a, c, t, g, unknown or other
  misc_feature (285)..(285): n is a, c, g, or t
  modified_base (305)..(305): a, c, t, g, unknown or other
  misc_feature (305)..(305): n is a, c, g, or t
  modified_base (311)..(311): a, c, t, g, unknown or other
  misc_feature (311)..(311): n is a, c, g, or t
  modified_base (344)..(344): a, c, t, g, unknown or other
  misc_feature (344)..(344): n is a, c, g, or t
  modified_base (370)..(370): a, c, t, g, unknown or other
  misc_feature (370)..(370): n is a, c, g, or t
tcagactgtacagtcacgaccggtgctcgatttagctgcgtcacgatctctcttggggtgtgggctcagaagcagagttctggggtgtctccaccatggcctggacccctctctggctcactctcctcactctttgcataggttctgtggtttcttctgaactgactcaggaccccgntgtgtctgtggccttgggacagacagtcaggatcacatgccaaggagacagcctcaagaactttatatgcatcctggtaccagcaagaagccgggacacggcccctntacttgtcttactacggtanaaaacnccccgccctcgaggactctcagaccgtattccncgtggcctccgaccctacaaggaacnctagcctttcctgaccattcacgtgggctcgaggcacgaagagtgaggcttagaacttatttaccgtcgggttcccctaccggggaaccaccgtagtacggtaacgcgtaagggtttgtgggttcgttcgggcgggtaacgggacgttaagggtcggaccgttaccgtacgggttccgacggaccccgtaagggccgtcgtcccccgtcggttacctaaccgttcgtttccccg

SEQ ID NO: 311324 - DNA, 602 bp, Homo sapiens
  misc_feature: GZ8MTXP01A1YM8.25.36.D03.1.454.CMB.2.raw
  modified_base (206)..(206): a, c, t, g, unknown or other
  misc_feature (206)..(206): n is a, c, g, or t
  modified_base (233)..(233): a, c, t, g, unknown or other
  misc_feature (233)..(233): n is a, c, g, or t
  modified_base (268)..(268): a, c, t, g, unknown or other
  misc_feature (268)..(268): n is a, c, g, or t
  modified_base (297)..(297): a, c, t, g, unknown or other
  misc_feature (297)..(297): n is a, c, g, or t
tcagactgtacagtcacgaccggtgctcgatttagctgcgtcacgatctctcttggggagcttcagctgtggtagagaagacaggattcaggacaatctccagcatggccggcctccctctcctcctcaccctcctcactcactgtgcagggtcctgggcccagtctgtgctgactcagccaccctcagtgtctggggcccccggnagagggtctccatctcttgtctgggancagctccgacgtcggaaatagttgtcatggtaccngcagctcccagaaccggccccaagctccncatctataggatgatcagcgccctgacggactactgaccgtattctctggctcgaagtctgggcctccgtccgggccctcccgtggcccatccgaggtcgggcctccgggtccgaggactggagctagggaattagttactggtagcgtaggtttggattcgccgtagtcgtggtaaggttcgggttccccggtaagggttcgggttccgggcggggaacggggaccccgttaaagggtcccgtacgggtaaccccggttcccgtacggggttacccgtaaccggaacccccggtaaacccgggg

SEQ ID NO: 311325 - DNA, 519 bp, Homo sapiens
  misc_feature: GZ8MTXP01AS0S1.25.36.D03.1.454.CMB.2.raw
  modified_base (227)..(227): a, c, t, g, unknown or other
  misc_feature (227)..(227): n is a, c, g, or t
  modified_base (243)..(243): a, c, t, g, unknown or other
  misc_feature (243)..(243): n is a, c, g, or t
  modified_base (261)..(261): a, c, t, g, unknown or other
  misc_feature (261)..(261): n is a, c, g, or t
  modified_base (305)..(305): a, c, t, g, unknown or other
  misc_feature (305)..(305): n is a, c, g, or t
  modified_base (324)..(324): a, c, t, g, unknown or other
  misc_feature (324)..(324): n is a, c, g, or t
  modified_base (444)..(444): a, c, t, g, unknown or other
  misc_feature (444)..(444): n is a, c, g, or t
  modified_base (452)..(452): a, c, t, g, unknown or other
  misc_feature (452)..(452): n is a, c, g, or t
tcagactgtacagtcacgaccggtgctcgatttagctgcgtcacgatctctcttgggggggtctcaggaggcagcgctctcgggacgtctccaccatggcctgggctctgctgttcctcaccctcctcactcagggcacagggtcctgggcccagtctgccctgactcagcctgcctccgtgtctgggactcctggacagtcgtcaccatctcctgcactggaaccngccgtgactattggtncttataactatgtctccnggtcccaacaacacccaggcaacggcccccaaatcatcatttangatgtcagtcatcggcctntggatttcctggtcgcttctctggcctcaagtctggcactcggctccctgaccatcgtcgggctccgaggcctgacggacgaggctacttagttattgctattcatacagacgacaccanagtctggnttcgggcggaggaccgaaggttcgaccgttcttcggtcacgccgaacgcttcgtccccgttcggtcc

SEQ ID NO: 311326 - DNA, 565 bp, Homo sapiens
  misc_feature: GZ8MTXP01CTTQQ.25.36.D03.1.454.CMB.2.raw
  modified_base (257)..(257): a, c, t, g, unknown or other
  misc_feature (257)..(257): n is a, c, g, or t
  modified_base (302)..(302): a, c, t, g, unknown or other
  misc_feature (302)..(302): n is a, c, g, or t
  modified_base (489)..(489): a, c, t, g, unknown or other
  misc_feature (489)..(489): n is a, c, g, or t
tcagactgtacagtcacgaccggtgctcgatttagctgcgtcacgatctctcttgggagatgggtcctgtcccagatgcacctgcaggagtcgggcccaggactggtgaagccttcggagaccctgtccctcacctgcagtgtctctggtggctccgtcagtgcttatactggagctggatccgccagtccgcgggagggactgggagtggattgggctatatatacgaatggattaaccacctacaacccctcctnaagagtcgagtcaccatatcagcggacacgtccagggatcaggtnttcctgcatctgtacttctgcgactgccgcggacacggccctatacctaactgtcgaccagagtattcgggacttgacgtacgtagtttcggaagtaattattattcttttgttgtctttgtactagtggtggggcggaaggggacgtacggtcgaccgtctcttcacgtcctccaccgacggcccncgtccgttccttccccgcggtccctacccttcccttccacgcgcctaaccgtcgtcgggggcctaacgcggcccgg

SEQ ID NO: 311327 - DNA, 544 bp, Homo sapiens
  misc_feature: GZ8MTXP01DSQ7S.25.36.D03.1.454.CMB.2.raw
  modified_base (187)..(187): a, c, t, g, unknown or other
  misc_feature (187)..(187): n is a, c, g, or t
  modified_base (208)..(208): a, c, t, g, unknown or other
  misc_feature (208)..(208): n is a, c, g, or t
  modified_base (236)..(236): a, c, t, g, unknown or other
  misc_feature (236)..(236): n is a, c, g, or t
  modified_base (329)..(329): a, c, t, g, unknown or other
  misc_feature (329)..(329): n is a, c, g, or t
  modified_base (473)..(473): a, c, t, g, unknown or other
  misc_feature (473)..(473): n is a, c, g, or t
tcagactgtacagtcacgaccggtgctcgatttagctgcgtcacgatctctcttggggagcttcagctgtggtagagaagacaggattcaggacaatctccagcatggccggcctccctctcctcctcaccctcctcactcactgtgcagggtcctgggcccagtctgtgctgactcagccaccctnagtgtctcgggacccccgggnagagggtctccatctcttgttctgggancagctccgacgtcggaaataagttgtctactggtaccagcagctcccagaaccggccccaagctcctcatctataggaatgatcagcgccctnacggactacctgaccgtattctctggctcgaagtctggcctccgtccggccctcccgtaggcccatcaggtcgggcctacgggtccgaggatggagtctagggaaattagttactgtagcgtaggtttgggattcgcctagtcnggaaggtcggttccgagggttgtcgggcggagggccaaggctgaaccgtcgaggttccaagcccgtaacgg

SEQ ID NO: 311328 - DNA, 534 bp, Homo sapiens
  misc_feature: GZ8MTXP01B818H.25.36.D03.1.454.CMB.2.raw
  modified_base (244)..(244): a, c, t, g, unknown or other
  misc_feature (244)..(244): n is a, c, g, or t
  modified_base (262)..(262): a, c, t, g, unknown or other
  misc_feature (262)..(262): n is a, c, g, or t
  modified_base (460)..(460): a, c, t, g, unknown or other
  misc_feature (460)..(460): n is a, c, g, or t
  modified_base (469)..(469): a, c, t, g, unknown or other
  misc_feature (469)..(469): n is a, c, g, or t
  modified_base (483)..(483): a, c, t, g, unknown or other
  misc_feature (483)..(483): n is a, c, g, or t
  modified_base (520)..(520): a, c, t, g, unknown or other
  misc_feature (520)..(520): n is a, c, g, or t
tcagactgtacagtcacgaccggtgctcgatttagctgcgtcacgatctctcgttgggggggtctcaggaggcagcgctctcgggacgtctccaccatggcctgggctctgctgttcctcaccctcctcactcagggcacagggtcctgggcccagtctgccctgactcagcctgcctccgtgtctgggactcctggacagtcggtcaccatctctgcactggaaccagccgtgacagttggtnacttataactatgtctcngtccaacaacaccaggcaacgccccaaatcatctattatgatgtcagtcatcggcctcgtggtactttccgtggtcgtctttcctctgggtcctccgaaagtcctagggcctaacgtccgggcctccctgacctagtcgtcggggctacccgaggcgttgacggacgaggctacttattatgtctatttcatacaganacacctaanagtctggtgtcggngtaggacctaagtcacgttcaggtcagccagcttacnccccgttgtaaccc

SEQ ID NO: 311329 - DNA, 527 bp, Homo sapiens
  misc_feature: GZ8MTXP01AC4DN.25.36.D03.1.454.CMB.2.raw
  modified_base (229)..(229): a, c, t, g, unknown or other
  misc_feature (229)..(229): n is a, c, g, or t
  modified_base (245)..(245): a, c, t, g, unknown or other
  misc_feature (245)..(245): n is a, c, g, or t
  modified_base (310)..(310): a, c, t, g, unknown or other
  misc_feature (310)..(310): n is a, c, g, or t
  modified_base (330)..(330): a, c, t, g, unknown or other
  misc_feature (330)..(330): n is a, c, g, or t
  modified_base (430)..(430): a, c, t, g, unknown or other
  misc_feature (430)..(430): n is a, c, g, or t
  modified_base (445)..(445): a, c, t, g, unknown or other
  misc_feature (445)..(445): n is a, c, g, or t
  modified_base (453)..(453): a, c, t, g, unknown or other
  misc_feature (453)..(453): n is a, c, g, or t
tcagactgtacagtcacgaccggtgctcgatttagctgcgtcacgatctctcttggggggggtctcaggaggcagcgctctcgggacgtctccaccatggcctgggctctgctgttcctcaccctcctcactcagggcacagggtcctgggcccagtctgccctgactcagcctgcctccgtgtctgggactcctggacagtcggtcaccatctcctgcactggaaccngccgtgactattggtnacttataactatgtctcctggtacccaacaacacccaggccaacggcccccaaatcatcatttangatgtcagtcatcggccctntggtagtttcctggtcgtcttctctggctcaagtctggcactcggcctccctgaccatcgcggggctccgaggctgaggacgagtctacttattaggttnctatttcatacaganacaccaangtctggtgtcggcgggtagaccgtaagttcgaccgttcgacggtcagcccgtaagccttcgccccgttggtccc

SEQ ID NO: 311330 - DNA, 579 bp, Homo sapiens
  misc_feature: GZ8MTXP01DKLT9.25.36.D03.1.454.CMB.2.raw
  modified_base (186)..(186): a, c, t, g, unknown or other
  misc_feature (186)..(186): n is a, c, g, or t
  modified_base (266)..(266): a, c, t, g, unknown or other
  misc_feature (266)..(266): n is a, c, g, or t
  modified_base (313)..(313): a, c, t, g, unknown or other
  misc_feature (313)..(313): n is a, c, g, or t
  modified_base (356)..(356): a, c, t, g, unknown or other
  misc_feature (356)..(356): n is a, c, g, or t
  modified_base (361)..(361): a, c, t, g, unknown or other
  misc_feature (361)..(361): n is a, c, g, or t
  modified_base (376)..(376): a, c, t, g, unknown or other
  misc_feature (376)..(376): n is a, c, g, or t
  modified_base (387)..(387): a, c, t, g, unknown or other
  misc_feature (387)..(387): n is a, c, g, or t
tcagactgtacagtcacgaccggtgctcgatttagctgcgtcacgatctctcttggggagctctgggagaggagcccagcactagaagtcggcggtgtttccattcggtgatcagcactgaacacagaggactcaccatggagtttgggctgagcgtggtttcctcgttaggctctttaagaggtntccactgtcaggtgcacctggtggagtcgtgggggagcgtggtccagcctgggaggtccctgagactctctgtgagcctntggtatttagtttcaggttggttctggcatgcacgtgggggtccccnccaggcctccgagggcgaagggggccgagtggtggctaggtanagcantagatgggaactttnagaatattacngacagtcgtcggtaggacggctatcactatcacgagacgaactacgtaccgggaatagttgtacgttacgttaggtaagttggtacacgtcgtaggaggtacggtcggaggttccgtcggttcgttcgttgttacgttcgttggtggtcggtaaggtaggtacggggttagggttaagggttaaggttaagg

SEQ ID NO: 311331 - DNA, 755 bp, Homo sapiens
  misc_feature: GZ8MTXP01CZQQL.25.36.D03.1.454.CMB.2.raw
  modified_base (188)..(188): a, c, t, g, unknown or other
  misc_feature (188)..(188): n is a, c, g, or t
  modified_base (209)..(209): a, c, t, g, unknown or other
  misc_feature (209)..(209): n is a, c, g, or t
  modified_base (242)..(242): a, c, t, g, unknown or other
  misc_feature (242)..(242): n is a, c, g, or t
tcagactgtacagtcacgaccggtgctcgatttagctgcgtcacgatctctcttggggagcttcagctgtggtagagaagacaggattcaggacaatctccagcatggccggcctccctctcctcctcaccctcctcactcactgtgcagggtcctgggcccagtctgtgctgactcacgccaccctnagtgtcgtcggggaccccggnaggacggtctccatctcgttgtacgtggggacncacgtccgtaccggaacggtacggtaaattagttcgtactacgtacggtaccagcacgaccctacccgaaaccggaaccccgaccccacgtccctacctactactacgtaagtaaggtaatcgacgtacgacggcccggtacccgtacggaaccggtacctaccgtacgtacccgttacttccgtcgtcggtacgtaacgggtaacgttcgtccggtcccttcccggtcccggtccctaccggtccgacctacgtcggtacgggtccgggtccgtaccgggtacggaaggtacgtcggtacggtacgtaacggttaagtttaacgtttacgttaggtacggtacggttacgggttacggtacggtacgtacgtacggttcggtcgggtaacgggttcgggttccggggttacgggttacggggtaccggggtacggggaccgggttaccggaacggtaaccggtaccggtaaccggtccggtaccggttaccgtaaccggaacccgtaaccgg

SEQ ID NO: 311332 - DNA, 575 bp, Homo sapiens
  misc_feature: GZ8MTXP01B5QQD.25.36.D03.1.454.CMB.2.raw
  modified_base (267)..(267): a, c, t, g, unknown or other
  misc_feature (267)..(267): n is a, c, g, or t
  modified_base (305)..(305): a, c, t, g, unknown or other
  misc_feature (305)..(305): n is a, c, g, or t
  modified_base (344)..(344): a, c, t, g, unknown or other
  misc_feature (344)..(344): n is a, c, g, or t
  modified_base (349)..(349): a, c, t, g, unknown or other
  misc_feature (349)..(349): n is a, c, g, or t
  modified_base (369)..(369): a, c, t, g, unknown or other
  misc_feature (369)..(369): n is a, c, g, or t
  modified_base (372)..(372): a, c, t, g, unknown or other
  misc_feature (372)..(372): n is a, c, g, or t
  modified_base (535)..(535): a, c, t, g, unknown or other
  misc_feature (535)..(535): n is a, c, g, or t
tcagactgtacagtcacgaccggtgctcgatttagctgcgtcacgatctctcttggggagctctgggagaggagcccagcactagaagtcggcggtgtttccattcggtgatcagcactgaacacagaggactcaccatggagtttgggctgagcttgggttttcctcgttgctcttttaagaggtgtccactgtcaggtgcacctggtggagtcgtgggggagcgtggtccagcctgggagtccctgagactctcctgtgagcctnggatttagttcagtggttctggcatgcacgtgggcccncaggctccgagggcaagggggccgagtggtgctagttanagcanagtgagtgtattcagtaatntangacagtacgtcggagacggctattaccactatccacgaagaacgaacctaacgttaccgggaattgttagtacgttaacgttaggaacgtcggtacacgtcgtaggacgtggtaacggaacggttccgtcggttacttcgttagttacgttcgttggtaacgnggaagtacgggtggggttaggttaagggttaacgttaagg

SEQ ID NO: 311333 - DNA, 801 bp, Homo sapiens
  misc_feature: GZ8MTXP01BGKV4.25.36.D03.1.454.CMB.2.raw
  modified_base (209)..(209): a, c, t, g, unknown or other
  misc_feature (209)..(209): n is a, c, g, or t
  modified_base (218)..(218): a, c, t, g, unknown or other
  misc_feature (218)..(218): n is a, c, g, or t
  modified_base (236)..(236): a, c, t, g, unknown or other
  misc_feature (236)..(236): n is a, c, g, or t
  modified_base (264)..(264): a, c, t, g, unknown or other
  misc_feature (264)..(264): n is a, c, g, or t
tcagactgtacagtcacgaccggtgctcgatttagctgcgtcacgatcgtcgtcgttggggagcttcagctgtggtagagaagacaggattcaggacaatctccagcatggccgcctccctctcctcctcaccctcctcactcactgtgcagggtcctgggcccagtctgtgctgactcagcccacctgagtgtcgtcgggaccccggnagcggtccncatctcttgtcgtgggancagcctaccgagttacggaaattagttntactacgtggtaacccagcacgtccctaccccgaaggaaaccccggccccctaagcccttacccgaccaaggttactaaggtaggaacttggtaactacgaacggccccggacccttacggaaagggtaccttaaccgtggaacccctttctttaccgtcggtcggtaccgttaccgggtaacggtcccgttccggtacccctcccgtccccggtcccttccccggtacggaccctagtaccggtacgggttaccgggtaccccgttaccgggtaccggaagtacggtacggtaacgttacgttaagttaaaccgtttaagttacggtggttacggtacggtttaggggttaggaccgttcggtaaccgtaggtttacccgttggggtaacgggtttccggggttcccggggttacgggtttacggggtaccgggggaacggggttaaccgggttacccgttaaacgggtcccgttaaccgggtaacccggtttacgggtaccgggttacccgtaaccgggttccccggtaaccggg

SEQ ID NO: 311334 - DNA, 584 bp, Homo sapiens
  misc_feature: GZ8MTXP01CCL9X.25.36.D03.1.454.CMB.2.raw
  modified_base (208)..(208): a, c, t, g, unknown or other
  misc_feature (208)..(208): n is a, c, g, or t
  modified_base (261)..(261): a, c, t, g, unknown or other
  misc_feature (261)..(261): n is a, c, g, or t
  modified_base (308)..(308): a, c, t, g, unknown or other
  misc_feature (308)..(308): n is a, c, g, or t
  modified_base (370)..(370): a, c, t, g, unknown or other
  misc_feature (370)..(370): n is a, c, g, or t
  modified_base (522)..(522): a, c, t, g, unknown or other
  misc_feature (522)..(522): n is a, c, g, or t
tcagactgtacagtcacgaccggtgctcgatttagctgcgtcacgatctctcttggggagcttcagctgtggtagagaagacaggattcaggacaatctccagcatggccggcctccctctcctcctcaccctcctcactcactgtgcagggtcctgggcccagtctgtgctgactcagcccaccctcagtgtctcgggacccccggnagagggtctccatctcttgttctgggagcagctccgacgtacggaaatagttntctactggtaccagcagcctcccagaaaccggcccccaaagcctccncatctataggatgatcagcgccctgacgggactaccgtgaccgattctctggctacgagtcnggcctccgtccggccctcccgtaggccagtcgaggtcgggccttccgggtccgagggtatcggagccgtaggtaattattacgtgtgcgtaggtttgggatcgtcctaggtcgtggtaacgggtggttccgggtacgggttggttccggggngggttacggggacccaaggccgtaggtaacccgtccctagggttccaacgcccgtaaccggg

SEQ ID NO: 311335 - DNA, 515 bp, Homo sapiens
  misc_feature: GZ8MTXP01BINWG.25.36.D03.1.454.CMB.2.raw
  modified_base (206)..(206): a, c, t, g, unknown or other
  misc_feature (206)..(206): n is a, c, g, or t
  modified_base (468)..(468): a, c, t, g, unknown or other
  misc_feature (468)..(468): n is a, c, g, or t
  modified_base (506)..(506): a, c, t, g, unknown or other
  misc_feature (506)..(506): n is a, c, g, or t
tcagactgtacagtcacgaccggtgctcgatttagctgcgtcacgatctctcttggggagcttcagctgtggtagagaagacaggattcaggacaatctccagcatggccggcctccctctcctcctcaccctcctcactcactgtgcagggtcctgggcccagtctgtgctgactcagccaccctcagtgtctgggacccccggnagagggtctccatctcttgttctgggagcagctccgacgtcggaaatagttgtctactggtaccagcagctcccagaaccggccccaagctcctcatctataggatgatcagcggccctgacggatactgaccgattctctggctcgaagtctggcctcctcggccctcctggccatcaggtcgggcctaccggtccgaggactgaggctaggggaattattactgtgctaggtttggatgcctagtctgaagtggttacgnggttgttcgggcggaggccagctggaactccgagttcncgccgaacg

SEQ ID NO: 311336 - DNA, 730 bp, Homo sapiens
  misc_feature: GZ8MTXP01CIAC1.25.36.D03.1.454.CMB.2.raw
  modified_base (188)..(188): a, c, t, g, unknown or other
  misc_feature (188)..(188): n is a, c, g, or t
  modified_base (208)..(208): a, c, t, g, unknown or other
  misc_feature (208)..(208): n is a, c, g, or t
  modified_base (234)..(234): a, c, t, g, unknown or other
  misc_feature (234)..(234): n is a, c, g, or t
  modified_base (257)..(257): a, c, t, g, unknown or other
  misc_feature (257)..(257): n is a, c, g, or t
  modified_base (294)..(294): a, c, t, g, unknown or other
  misc_feature (294)..(294): n is a, c, g, or t
  modified_base (301)..(301): a, c, t, g, unknown or other
  misc_feature (301)..(301): n is a, c, g, or t
  modified_base (307)..(307): a, c, t, g, unknown or other
  misc_feature (307)..(307): n is a, c, g, or t
  modified_base (350)..(350): a, c, t, g, unknown or other
  misc_feature (350)..(350): n is a, c, g, or t
  modified_base (355)..(355): a, c, t, g, unknown or other
  misc_feature (355)..(355): n is a, c, g, or t
tcagactgtacagtcacgaccggtgctcgatttagctgcgtcacgatctctcttggggagcttcagctgtggtagagaagacaggattcaggacaatctccagcatggccggcctccctctcctcctcaccctcctcactcactgtgcagggtcctgggcccagtctgtgctgactcagcccaccctnagtgtcgtcgggaccccggnagaggtctccatctcttgtctgggancagctcgagtacggaaatagttncactggtaccagacaactcccaaggaaccgcccccanactcctnatgtanggaatgactcagccgcccctcgacggggtcccccctggacctnttccnctcgccctcgacgtctaggccctaccctcacgtcccctcccgtggccctacgtcccggttcgggccctacccgtaaacgttccgtaggaaggacgttacgggacgggtacccgttaaagttttacgttttaacgttggttcggaccgaagggtccggttagggggaacttagggtaaaccgaaagggggtaaaacggttaaaccgggtttaagttacggttacccggtttaaaggggttaaacgttttaaccgggggaacccttaaaacgggggttcccttaaacccccgggtttccgggttaaaccggtaacccgaacccgggtaacccccgttaaacgggggtaacccccccgaaacccccgtttaaacccgg

SEQ ID NO: 311337 - DNA, 560 bp, Homo sapiens
  misc_feature: GZ8MTXP01ECIXO.25.36.D03.1.454.CMB.2.raw
  modified_base (207)..(207): a, c, t, g, unknown or other
  misc_feature (207)..(207): n is a, c, g, or t
  modified_base (234)..(234): a, c, t, g, unknown or other
  misc_feature (234)..(234): n is a, c, g, or t
  modified_base (489)..(489): a, c, t, g, unknown or other
  misc_feature (489)..(489): n is a, c, g, or t
tcagactgtacagtcacgaccggtgctcgatttagctgcgtcacgatctctcttggggagcttcagctgtggtagagaagacaggattcaggacaatctccagcatggccggcctccctctcctcctcaccctcctcactcactgtgcagggtcctgggcccagtctgtgctgactcagccaccctcagtgtctcgggacccccggnagaggtctccatctcttgttctgggancagctccgacgtcggaaatagttgtctactggtaccagcagctcccagaaccggcccccaagctcctcatctataggatgatcagcggcctcgacgggactacgtgaccgattcctctggctcgaagtcgtcggcctccgtccgggccctcccgtacgggccagtcgaggttcggggtcctcccggggtccgagggactgggaaggtcctaggggaaattagtttacctggtgcgtaggtttggatgcctagtcnggaacgtcggttcgagggttgtcgggcgggaggccaagtctaggccgtcgtaggttcctaacgccgaacgg

SEQ ID NO: 311338 - DNA, 558 bp, Homo sapiens
  misc_feature: GZ8MTXP01EASTL.25.36.D03.1.454.CMB.2.raw
  modified_base (208)..(208): a, c, t, g, unknown or other
  misc_feature (208)..(208): n is a, c, g, or t
  modified_base (230)..(230): a, c, t, g, unknown or other
  misc_feature (230)..(230): n is a, c, g, or t
  modified_base (235)..(235): a, c, t, g, unknown or other
  misc_feature (235)..(235): n is a, c, g, or t
  modified_base (362)..(362): a, c, t, g, unknown or other
  misc_feature (362)..(362): n is a, c, g, or t
tcagactgtacagtcacgaccggtgctcgatttagctgcgtcacgatctctcttggggagcttcagctgtggtagagaagacaggattcaggacaatctccagcatggccggcctccctctcctcctcaccctcctcactcactgtgcagggtcctgggcccagtctgtgctgactcagccaccctcagtgtctcgggacccccgggnagaggtctccatctcttgttcngggancagctccgacgtacgaaataagttgtctactggtaccagcagcctaccccgaagaaacccggcccccaaagcctcctcatctaataggaattgatcagccggccctcgaggactactgaccgattcncgtggctcgaagtctggcctccgtcgccctccgtggccatcgaggtcgggccttcggccggagatgagcgtagggtaatagttacttgtgtcgtagttggtagtgtcgtacgtcgtgtaaggtcggttcggtcggttcggttcggtcgggacggcgacgaacgtcgtccgtccgtacgttacgtcgccgaacccgg

SEQ ID NO: 311339 - DNA, 661 bp, Homo sapiens
  misc_feature: GZ8MTXP01AOOT0.25.36.D03.1.454.CMB.2.raw
  modified_base (187)..(187): a, c, t, g, unknown or other
  misc_feature (187)..(187): n is a, c, g, or t
  modified_base (206)..(206): a, c, t, g, unknown or other
  misc_feature (206)..(206): n is a, c, g, or t
  modified_base (237)..(237): a, c, t, g, unknown or other
  misc_feature (237)..(237): n is a, c, g, or t
tcagactgtacagtcacgaccggtgctcgatttagctgcgtcacgatctctcttggggagcttcagctgtggtagagaagacaggattcaggacaatctccagcatggccggcctccctctcctcctcaccctcctcactcactgtgcagggtcctgggcccagtctgtgctgactcagccaccctnagtgtctcgggaccccggnaggaggtctccatcctcttgttctggggacncacgtccgtaccgacggtacgtaaattagttcgtactacgtacgtacagcacgcctaccgaacgaacccgccccaacgtcctcctactactactagtagtaatgactacgacgccgtacctacgaacggtactacgtacgtacctattcctcgtcggactacggtacgtcgtcggtcctccgtacccgtccctccgtcgacctacgtcgtacggtccgggccgtccgggtacgaggtacgtacggacgtacgtaaggtaacttacgttacgtggtacgtacggttaggttaggtacgtcgtcgtacggtcgtgggtaacggtcgggttccgggtacgggttcgggtaccgggacgggacggggaccttacggtccggtaccgtcccggttaccgtacggttaccgtaacccggaaccgtaacgg

SEQ ID NO: 311340 - DNA, 542 bp, Homo sapiens
  misc_feature: GZ8MTXP01CF4R4.25.36.D03.1.454.CMB.2.raw
  modified_base (230)..(230): a, c, t, g, unknown or other
  misc_feature (230)..(230): n is a, c, g, or t
  modified_base (246)..(246): a, c, t, g, unknown or other
  misc_feature (246)..(246): n is a, c, g, or t
  modified_base (473)..(473): a, c, t, g, unknown or other
  misc_feature (473)..(473): n is a, c, g, or t
  modified_base (491)..(491): a, c, t, g, unknown or other
  misc_feature (491)..(491): n is a, c, g, or t
  modified_base (514)..(514): a, c, t, g, unknown or other
  misc_feature (514)..(514): n is a, c, g, or t
tcagactgtacagtcacgaccggtgctcgatttagctgcgtcacgatctctcgttggggggggtctcaggaggcagcgctctcgggacgtctccaccatggcctgggctctgctgttcctcaccctcctcactcagggcacagggtcctgggcccagtctgccctgactcagcctgcctccgtgtctgggactcctggacagtcggtcaccatctcctgcactggaaccngccgtgactattggtntcttataactatgtctcctggtcccaacaacacccaggccaacggcccccaaactcatcatttactgatgtcagtcatcgccctcgtggtagtttcctggtcgtcttctctcggtctcccaaagtctgggctaacgtccggcctccctgaccatcgtcgggctccgaggcgtgacggacgagtactacgttattagttgtctatttcattacgagtagaaccacaanacgtctggtaagttcggnggaggcgaaaggttcaccgttcncggtcacgccagcttcgccccttcgtcc

SEQ ID NO: 311341 - DNA, 664 bp, Homo sapiens
  misc_feature: GZ8MTXP01BDB5V.25.36.D03.1.454.CMB.2.raw
  modified_base (285)..(285): a, c, t, g, unknown or other
  misc_feature (285)..(285): n is a, c, g, or t
tcagactgtacagtcacgaccggtgctcgatttagctgcgtcacgatctctcttggggggggtctcaggaggcagcactctcgggacgtctccaccatggcctgggctctgctcctcctcagcctcctcactcagggcacaggatcccgggctcagtctgccctgactcagcctcgctcagtgtccggtctcctggacagtcagtcaccatctcctgcactggaaccagaagtgatcgttggtgtcttatgacactgtctctggcacctagtttaccaggaaacnccccagagtcatccttatgatgtcgagaacgcggccctcgaccgggtccctgactcgtccttctcgtgggtacctaaagtccgtacggaccaaacgaccgggtcccctccctcggaccctactccgtcgtcggggccttacccgaaggtccgttaggacgggtagtacgggagggtccttaaggtaattttaatttaagtttcggtcctttaggttttacaacgtttaagtcgggtacctaacgggtacctaaaacctttacgtttagtttttcggggttaacggtttcggggaccgttcggttaacggggttacccgtaaaggttccgggtaacccgttccgggtacgggttccaaccgggttccccgtaaaccgggg

SEQ ID NO: 311342 - DNA, 680 bp, Homo sapiens
  misc_feature: GZ8MTXP01C05DR.25.36.D03.1.454.CMB.2.raw
  modified_base (188)..(188): a, c, t, g, unknown or other
  misc_feature (188)..(188): n is a, c, g, or t
  modified_base (209)..(209): a, c, t, g, unknown or other
  misc_feature (209)..(209): n is a, c, g, or t
  modified_base (236)..(236): a, c, t, g, unknown or other
  misc_feature (236)..(236): n is a, c, g, or t
tcagactgtacagtcacgaccggtgctcgatttagctgcgtcacgatctctcttggggagcttcagctgtggtagagaagacaggattcaggacaatctccagcatggccggcctccctctcctcctcaccctcctcactcactgtgcagggtcctgggcccagtctgtgctgactcagcccaccctnagtgtcgtacgggaacccggnaggaggtctcatctcttgtcgtgggancagctcgacgtacggaattagttcgtctactggtaccagcacgccctaccccgaacgaaaccccggcccccaaagtccctacctacacttaccgtaagtaaggtaattagactacgacggcccggtacccctacggaaccggggtactaaccgtgtaacccgtactttccgtcgttcggaccgtacgggtaaacgttccgtcggtcccgttccccgtcccggggtccccttacccgtcgggacccctagtccggacgggtcggggtcccttcccggggaccgagggtacgtaggacggtacgtagggtaaattacgttactggtacgtgtaggtttggactgaccgtgtccgtggtaacggtcgggttccggtacgggttcggtacggggacggacggcaacggttccgacggtccgtcgtacggcctaacgcccgtaacccgg

SEQ ID NO: 311343 - DNA, 647 bp, Homo sapiens
  misc_feature: GZ8MTXP01BRFFF.25.36.D03.1.454.CMB.2.raw
tcagactgtacagtcacgaccggtgctcgatttagctgcgtcacgatctctcttggggggggtctcaggaggcagcgctctcgggacgtctccaccatggcccgggctctgctgttcctcaccctcctcactcagggcacaggatcccgggctcagtctgccctgactcagcctcgctcagtgtccgggtctcctggacagtcagtcaccatctcctgcactggaaccagaagtgatcttggtgcttatgacactgtctcctggcacctagtttacccaggaaacgcccccagacgtcattccttatgatgtcaggaacgcggccctcgacggggtccctgactcgcttctcgtacgggtaccaagtctacggaccaaccgaccgggccctacccgtcgaccctagtcctcgtcgggcctccgacggtcgtaggaggtagtggaaggtcttaggtaatttatttaagtttcgtccgtttaggttacctaagttagttacgacgtaacgggtaacctaaacgttaccgttaaggtttttgggttacgggtttccgggcgtacggtaacgggttaaccgttaacggttcggtaacccggttccggtcgggtaccgaccgttacccggtaacggttcccgttcccccggg

SEQ ID NO: 311344 - DNA, 717 bp, Homo sapiens
  misc_feature: GZ8MTXP01D9CCY.25.36.D03.1.454.CMB.2.raw
  modified_base (208)..(208): a, c, t, g, unknown or other
  misc_feature (208)..(208): n is a, c, g, or t
  modified_base (258)..(258): a, c, t, g, unknown or other
  misc_feature (258)..(258): n is a, c, g, or t
  modified_base (295)..(295): a, c, t, g, unknown or other
  misc_feature (295)..(295): n is a, c, g, or t
  modified_base (302)..(302): a, c, t, g, unknown or other
  misc_feature (302)..(302): n is a, c, g, or t
tcagactgtacagtcacgaccggtgctcgatttagctgcgtcacgatctctcttggggagcttcagctgtgggtagagaagacaggactcaggacaatctccagcatggccagcttccctctcctcctcaccctcctcactcactgtgcagggtcctgggcccagtctgtgctgtctcagccacctcagtgtcgtcggggcccccggnaggaggtcgacatctcttgtctggagtcgctccaagtcggcagtaatagngtaagctggtaccagccaactccaggaaccgccccanactcctnatgtatgggaatgatcagccgcccctcgacggggtcctgacccgtattcctctcggccctccgacgtctggcctaccttcacgccctcccgtcggacctacgtccggtacgggtccttaccgaacttcctaggaacgggtacttagggaaacgggggtcccgttaattttaaacggttttagttcggtcgtacgtacgggtacgggttaggggtaacgtaacggaaacgggtaaaggggtaaaacgggtttaaacgggtttacggtttacgggttttaaccgggtttaaaccggggtaaacgggtttaccgggggttaaacccggttaaaccggggttaaccccggttaacccggttaacccggttaacgggtacccggaaacccggtaacccccgaaaacccgggtaacccccg

SEQ ID NO: 311345 - DNA, 573 bp, Homo sapiens
  misc_feature: GZ8MTXP01BODLX.25.36.D03.1.454.CMB.2.raw
  modified_base (268)..(268): a, c, t, g, unknown or other
  misc_feature (268)..(268): n is a, c, g, or t
  modified_base (290)..(290): a, c, t, g, unknown or other
  misc_feature (290)..(290): n is a, c, g, or t
  modified_base (311)..(311): a, c, t, g, unknown or other
  misc_feature (311)..(311): n is a, c, g, or t
  modified_base (352)..(352): a, c, t, g, unknown or other
  misc_feature (352)..(352): n is a, c, g, or t
  modified_base (357)..(357): a, c, t, g, unknown or other
  misc_feature (357)..(357): n is a, c, g, or t
  modified_base (370)..(370): a, c, t, g, unknown or other
  misc_feature (370)..(370): n is a, c, g, or t
  modified_base (380)..(380): a, c, t, g, unknown or other
  misc_feature (380)..(380): n is a, c, g, or t
  modified_base (497)..(497): a, c, t, g, unknown or other
  misc_feature (497)..(497): n is a, c, g, or t
tcagactgtacagtcacgaccggtgctcgatttagctgcgtcacgatctctcttggggagctctgggagaggagcccagcactagaagtcggcggtgtttccattcggtgatcagcactgaacacagaggactcaccatggagtttgggctgagctgggttttcctcgttgcttcttttaagaggtgtccactgtcaggtgcacctggtggagtcgtgggggagcgtggtccagcctgggagtccctgagactctcctgtgaagcctntggtatttagttcagtggttcnggcatgctacgtggggtcccncgaggctccgagggcgaagggggccgagtggtggcagttanggcanagtgatggaattnagaatattangcagtactcggtagaacgggcctattaccgaccctatcctaccgaagaacgaacctaacgtttccccggggaaattagtttcgagttacgtaggaaagtggtacgagtccgtagagnggtcgggagacgtcgggcttcgtgttattacgttgtcggagaaggtacggtggggaggttggttaaggtttaacgg

SEQ ID NO: 311346 - DNA, 690 bp, Homo sapiens
  misc_feature: GZ8MTXP01DLLY6.25.36.D03.1.454.CMB.2.raw
  modified_base (208)..(208): a, c, t, g, unknown or other
  misc_feature (208)..(208): n is a, c, g, or t
  modified_base (235)..(235): a, c, t, g, unknown or other
  misc_feature (235)..(235): n is a, c, g, or t
  modified_base (269)..(269): a, c, t, g, unknown or other
  misc_feature (269)..(269): n is a, c, g, or t
  modified_base (298)..(298): a, c, t, g, unknown or other
  misc_feature (298)..(298): n is a, c, g, or t
  modified_base (492)..(492): a, c, t, g, unknown or other
  misc_feature (492)..(492): n is a, c, g, or t
tcagactgtacagtcacgaccggtgctcgatttagctgcgtcacgatctctcttggggagcttcagctgtggtagagaagacaggattcaggacaatctccagcatggtcggcctccctctcctcctcaccctcctcactcactgtgcagggtcctgggcccagtctgtgctgactcagccaccctcagtgtcctcgggacccccggnagagggtctccatctcttgtcgtggancagctccgacgtcggaaatagttgctatggtacngcagcctaccgagaaccgccccaagctcncatcatagatgatcagcgcctgaacggtactacctgaccgtattccttacgtgggacctacggaaagttccgtcgggtcccttcccgtcccgggccccttacccgttcggccctaagttccgaaggttccggggtcctcccgggtaccggaaggtcgtaggacggtaccgtaggtaaacgtttaagtttaccgnggttcgtacgttaggttttacggggaactttcgggacccctaaggtttccgtggggtaacggtttccggggttcccgggtaaaccggggtttggttacccgggggacgggttaaaccggggttacccttaaacgggtcccgttacgggaaccccgtttacggaccgggttaccaaccgggttaaccccggtaaccggg

SEQ ID NO: 311347 - DNA, 650 bp, Homo sapiens
  misc_feature: GZ8MTXP01BWM49.25.36.D03.1.454.CMB.2.raw
  modified_base (207)..(207): a, c, t, g, unknown or other
  misc_feature (207)..(207): n is a, c, g, or t
  modified_base (234)..(234): a, c, t, g, unknown or other
  misc_feature (234)..(234): n is a, c, g, or t
  modified_base (311)..(311): a, c, t, g, unknown or other
  misc_feature (311)..(311): n is a, c, g, or t
tcagactgtacagtcacgaccggtgctcgatttagctgcgtcacgatctctcttggggagcttcagctgtggtagagaagacaggattcaggacaatctccagcatggccggcctccctctcctcctcaccctcctcactcactgtgcagggtcctgggcccagtctgtgctgactcagccaccctcagtgtctcgggacccccggnagagggtctccatctcttgtctgggancagctcgacgtcggaaataagttgtctactggtaccagcagctcccaagaaccggcccccaagcctcctcatactanaggaatgatcgacgcggccctcgacgggactactgaccgtattctctggctcgaagttcgtggcctccgtccggccctcccgtaggccatcgaggtcgggccgtcccgggtccgaggacgtgaagggtctaggggtaaattacgtttaacctggttacgccgttaaggttttcggggaattcggacccgttaggttccgtgggtaacgttcggggttaccccgggagggtttcgggtttcccgggggacggggttaacggggttacccaaacgggtccgttcggtaaccccggttacccgtacggggttacctaaccgggttaaccccggtaaaccggg

SEQ ID NO: 311348 - DNA, 661 bp, Homo sapiens
  misc_feature: GZ8MTXP01CYKTW.25.36.D03.1.454.CMB.2.raw
  modified_base (276)..(276): a, c, t, g, unknown or other
  misc_feature (276)..(276): n is a, c, g, or t
  modified_base (464)..(464): a, c, t, g, unknown or other
  misc_feature (464)..(464): n is a, c, g, or t
  modified_base (554)..(554): a, c, t, g, unknown or other
  misc_feature (554)..(554): n is a, c, g, or t
tcagactgtacagtcacgaccggtgctcgatttagctgcgtcacgatctctcttggggagctctgagagcggagccccagccccagaattcccaggtgttttcatttggtgatcagcactgaacacagaggactcaccatggagtttgggctgagcttgggttttccttgtttgttatttttccaggtgtccagagtgaggtgcagttggtggagtcgtgggggagcgttggtccagccgtgggagggtccgtgagagtctcctgtgcagcctcgnggattcatcttcagtcgaccaataaagtggactcggggtcccgccgacggcgtaccggagggggaagggggcgtgggaggtggggttggaccgtaattaaggaaataagacgtaaagaacgttaacaaccaacgaagaactacgccgcgtactaggtagaaaggcaagtattacaatttactacctanaaaggatatacgaattaacgaaaaggtactacgtactagttatctagaactaaagtacgaaactacgaaccgtaaacggaaaaacccggngggaacccgtaccgggttaccggttaattacgtttaaccgttggttacgtaaccgttagggtaacccaaggtacccgttacgggtaaccgttaacccttaacccccg

SEQ ID NO: 311349 - DNA, 564 bp, Homo sapiens
  misc_feature: GZ8MTXP01CCD6L.25.36.D03.1.454.CMB.2.raw
  modified_base (235)..(235): a, c, t, g, unknown or other
  misc_feature (235)..(235): n is a, c, g, or t
tcagactgtacagtcacgaccggtgctcgatttagctgcgtcacgatctctcttggggagcttcagctgtggtagagaagacaggattcaggacaatctccagcatggccggcctccctctcctcctcaccctcctcactcactgtgcagggtcctgggcccagtctgtgctgactcagcccaccctcagtgtctggggacccccggcagagggtctccatctcttgtctgggancagctccgacgtcggaaataagttgtctactggtaccagcagcctcccaacgaaaccggcccccaaagcctcctcatctataggaatgatcagcgccctcgacgggatactgacccgtattctcgtggctcgaacgtctcggcctcctccggccctccctggcccatccgaggtcgggccgtccggccgaggactggagtctagggaacttagttacgtgttgtagtttggattcgcctagtcgtgtaggtcggtcggttcggttggttcgggacgggaggaccgacgcgtaacggccgtccgtaggtcacgtaacccgaacggtcccg

SEQ ID NO: 311350 - DNA, 714 bp, Homo sapiens
  misc_feature: GZ8MTXP01A42HA.25.36.D03.1.454.CMB.2.raw
  modified_base (229)..(229): a, c, t, g, unknown or other
  misc_feature (229)..(229): n is a, c, g, or t
  modified_base (246)..(246): a, c, t, g, unknown or other
  misc_feature (246)..(246): n is a, c, g, or t
tcagactgtacagtcacgaccggtgctcgatttagctgcgtcacgatctctcttggggggggtctcaggaggcagcgctctcgggacgtctccaccatggcctgggctctgctgttcctcaccctcctcactcagggcacagggtcctgggcccagtctgccctgactcagcctgcctccgtgtctgggactcctggacagtcgtcaccatctcctgcactggaacccngccgtgactagttggtntacttataactatcgtcctcctacgtaccaacaaccaccacgaccaaccgaccccaactcatactattatagtatcgtacacgtcacgtccgtcctcgtggtcgtttccgtcggtctcttctcgtcgctcgtagtcgtcgactaccgtccggtccctcccgtacgacctcgtccggtccgggtcctaccggacggtcgtacggacgggtaccggtacgtacttaacgtttacgtttacggttacgtactttactttactaaacgttaacgaacggtaaccgtaaacccgaaaccgtaaaccggttacggttcggttaacgggggttcgggttaccgggggacggggtaaccggggttaaccgttaaacgggttacccggttaccccggttcccggttaccgggtaacccggacccggtaacccgggtaaccggtccccgttacccggtcccccggttccggtaacccg

SEQ ID NO: 311351 - DNA, 533 bp, Homo sapiens
  misc_feature: GZ8MTXP01DMQ5A.25.36.D03.1.454.CMB.2.raw
  modified_base (203)..(203): a, c, t, g, unknown or other
  misc_feature (203)..(203): n is a, c, g, or t
  modified_base (246)..(246): a, c, t, g, unknown or other
  misc_feature (246)..(246): n is a, c, g, or t
  modified_base (257)..(257): a, c, t, g, unknown or other
  misc_feature (257)..(257): n is a, c, g, or t
  modified_base (262)..(262): a, c, t, g, unknown or other
  misc_feature (262)..(262): n is a, c, g, or t
  modified_base (299)..(299): a, c, t, g, unknown or other
  misc_feature (299)..(299): n is a, c, g, or t
  modified_base (391)..(391): a, c, t, g, unknown or other
  misc_feature (391)..(391): n is a, c, g, or t
  modified_base (398)..(398): a, c, t, g, unknown or other
  misc_feature (398)..(398): n is a, c, g, or t
  modified_base (406)..(406): a, c, t, g, unknown or other
  misc_feature (406)..(406): n is a, c, g, or t
  modified_base (444)..(444): a, c, t, g, unknown or other
  misc_feature (444)..(444): n is a, c, g, or t
  modified_base (449)..(449): a, c, t, g, unknown or other
  misc_feature (449)..(449): n is a, c, g, or t
tcagactgtacagtcacgaccggtgctcgatttagctgcgtcacgatctctcttggggagctctgagagcggagccccagccccagaattcccaggtgttttcatttggtgatcagcactgaacacagaggactcaccatggagtttgggctgagcgtggtttctgttgttattttccagtgtcagagtgaggtgcagttggnggagtcgtgggggagcttggtccagcctggagggtccgtgagngtctctgtgcngcctnggatcatcttcagtcaccactacatggactgggtccncaggctcgagggagggctggagtggtgcctataagaaataagctaaagagtcacacaagaactacgcgcgtctagtagaaaggcagacttanattactntacaaagnaatgaattacaaagtaactacactagtaatctagaaanaatanaacacgacgtaacgaaacgaacggacgacgtacgtagttagttcgttagtgtagtaacgtacgacgacgtaacgttaacgtaac

SEQ ID NO: 311352 - DNA, 707 bp, Homo sapiens
  misc_feature: GZ8MTXP01EPFNG.25.36.D03.1.454.CMB.2.raw
  modified_base (187)..(187): a, c, t, g, unknown or other
  misc_feature (187)..(187): n is a, c, g, or t
  modified_base (208)..(208): a, c, t, g, unknown or other
  misc_feature (208)..(208): n is a, c, g, or t
  modified_base (230)..(230): a, c, t, g, unknown or other
  misc_feature (230)..(230): n is a, c, g, or t
  modified_base (235)..(235): a, c, t, g, unknown or other
  misc_feature (235)..(235): n is a, c, g, or t
tcagactgtacagtcacgaccggtgctcgatttagctgcgtcacgatctctcttggggagcttcagctgtggtagagaagacaggattcaggacaatctccagcatggccggcctccctctcctcctcaccctcctcactcactgtgcagggtcctgggcccagtctgtgctgactcagccaccctnagtgtctcgggacccccgggnagcggtctcatcttcttgtcgnggacncacgtcctaccgacgtacggtaaattagttcgtctacgtcggtaccagacacgcctacccgaacgaaccccgacccccaagtcctacctactacttactaagtaggatagactcgacgccgtccctacgacgggtactaccgtcgaccgtacttccgtcgtcggtactacggtaacgttcgtcggtcctcccgtaccggtcccctccgtcggacctacgtccgtacgggttccgggtcccgttccgggtacgggaaggacgtcggacggtacgttaagggtaactttacgtttacgtaggtcgtacggttaggtttagggactcggtaccgtaggttcgtgggtaacgggttcgggttacccgggtacggggtttcgggtacggggacggggaacgggaccgttaacgggtccgtaccgggtaaccccgttcgggtaccgggttaccgtaacccgggttaacccgtaaccgg

SEQ ID NO: 311353 - DNA, 673 bp, Homo sapiens
  misc_feature: GZ8MTXP01A93WZ.25.36.D03.1.454.CMB.2.raw
  modified_base (188)..(188): a, c, t, g, unknown or other
  misc_feature (188)..(188): n is a, c, g, or t
  modified_base (209)..(209): a, c, t, g, unknown or other
  misc_feature (209)..(209): n is a, c, g, or t
  modified_base (237)..(237): a, c, t, g, unknown or other
  misc_feature (237)..(237): n is a, c, g, or t
  modified_base (366)..(366): a, c, t, g, unknown or other
  misc_feature (366)..(366): n is a, c, g, or t
tcagactgtacagtcacgaccggtgctcgatttagctgcgtcacgatctctcttggggagcttcagctgtggtagagaagacaggattcaggacaatctccagcatggccggcctccctctcctcctcaccctcctcactcactgtgcagggtcctgggcccagtctgtgctgactcagcccaccctnagtgtcgtcgggacccccggnagaggtctccatctcttgttcgtgggancagcctaccggacgtacggaaattaagttgtctacgtggtaccagcagcctacccaagaacccgcccccaagcctcctcatactagtaggaatgatcacgccgcctacgacggactacgtgaacccgtnttcctcgtggctaccggtaacgtccgtcggccctccgtcccgggcccttcccgtcggccctagtccgacgggtccgggtccgttcccgggtaccgaggcgttacggacgtccgtaaggggtaactttaacgtttaccgtcggttagtccgttagggttttgggaactcggtaccgtaggttccgtggtaacgggttcgggttacccgggtacgggttgggttaccggggacggggaacgggacccttaagggtccgttacgggtaacccgttccggtacgggttccctaacggccccgtaacccggg

SEQ ID NO: 311354 - DNA, 627 bp, Homo sapiens
  misc_feature: GZ8MTXP01D1PRE.25.36.D03.1.454.CMB.2.raw
  modified_base (245)..(245): a, c, t, g, unknown or other
  misc_feature (245)..(245): n is a, c, g, or t
  modified_base (265)..(265): a, c, t, g, unknown or other
  misc_feature (265)..(265): n is a, c, g, or t
tcagactgtacagtcacgaccggtgctcgatttagctgcgtcacgatctctcgttggggggggtctcaggaggcagcgctctcgggacgtctccaccatggcctgggctctgctgttcctcaccctcctcactcagggcacagggtcctgggcccagtctgccctgactcagcctgcctccgtgtctgggactcctggacagtcgtcaccatctcctgcactggaaccagccgtgactattggtntacttataactatgtctccngtacccaacaacaccagcaacgccccaatcatcatttatgatgtcagtcagtccggtccctgtggtagtttcctggtcgtcttctcgtcggctccaagtctggaccacgtcggccctccctcgacctagtcgtcgggctccgaggctaggacggacgacggtcttaactttacttagttcgtattaatttccaattacgaggtaacgaaaccaacctaaacgtacgttccgtgggttcggttaccggggacgggtaacggggttaaccgtaaaggtttcccggaacccggttcccgttaccgggtccaaccgggccccgtaaacgggcccgttaccccggtccccccgttcgggttcccccg

SEQ ID NO: 311355 - DNA, 792 bp, Homo sapiens
  misc_feature: GZ8MTXP01AKOLV.25.36.D03.1.454.CMB.2.raw
  modified_base (332)..(332): a, c, t, g, unknown or other
  misc_feature (332)..(332): n is a, c, g, or t
tcagactgtacagtcacgaccggtgctcgatttagctgcgtcacgatctctcttggggggggtctcaggaggcagcgctctcgggacgtctccaccatggcctgggctctgctgttcctcaccctcctcactcagggcacagggtcctgggcccagtctgccctgactcagcctgcctccgtgtctgggactccgtggacaggtcggtcaccatctcctgcactggaatcagccgtgactagttggtgcttaataactatcgtctcctcggtacccaaacaaccacccgaggaccaaacggtaccccccaaaactctatcctaagttttaangtattgtacaggtccacgttcccgggtcccttcgtgggttaccgtttcggtggtcgtcctttctacgtcggtcctaccgaaagttcgtcggtactaaccgtcccggtcccttccccgtgtaacccctagtccggtacccgggggtccttacccgaaagggttcccgtaaggggtacgggaaacccggtacgggttaacctttaaaccgtttaacgtttaaagttcgggttaacccttaaagtttttaccgaaacttaaccggtaaacggaaacccggttaaccctaaacccggtaaaccgttaaggttccggttaaggggttccgggttaccgggggaccggggttaaccgggtaaacccgttaaacgggttccggttaccccggttaccggtaacccgggtacccgaaccgggtaccccgaacgggttccccgttcccgggttccccccgtttcccggg

SEQ ID NO: 311356 - DNA, 646 bp, Homo sapiens
  misc_feature: GZ8MTXP01D53PJ.25.36.D03.1.454.CMB.2.raw
  modified_base (230)..(230): a, c, t, g, unknown or other
  misc_feature (230)..(230): n is a, c, g, or t
  modified_base (245)..(245): a, c, t, g, unknown or other
  misc_feature (245)..(245): n is a, c, g, or t
  modified_base (325)..(325): a, c, t, g, unknown or other
  misc_feature (325)..(325): n is a, c, g, or t
tcagactgtacagtcacgaccggtgctcgatttagctgcgtcacgatctctcgttgggggggggtctcaggaggcagcgctctcgggacgtctccaccatggcctgggctctgctgttcctcaccctcctcactcagggcacagggtcctgggcccagtctgccctgactcagcctgcctccgtgtctgggactccgtggacagtcggtcaccatctctgcactgaaccngcgtgactattggtntacttaataactatgtctcctcggtacccaacaaccacccgaggaccaaccggacccccaaactcatctatttactgatntcagtcacgtccgtcctgtggtacgtttcccgtggttcgtctttctacctcgggtcctcgaagtccgtacgggacctaaccgttccgggcccttcccgtacgaaccctacgttccggtccgggggtcctaccggtaagggccttagggaacgggtacgacggtacttaacgtttatttaggttcgtacttactttacaagtaaccagaacgaacctaaccgtacgtagtccgtgggtcggttcgggacggtacgggacctaagggttccgacccgttcggttcgtcaccgtccgacggtccttccgtccccgttggtcccg

SEQ ID NO: 311357 - DNA, 643 bp, Homo sapiens
  misc_feature: GZ8MTXP01E1XO5.25.36.D03.1.454.CMB.2.raw
  modified_base (209)..(209): a, c, t, g, unknown or other
  misc_feature (209)..(209): n is a, c, g, or t
  modified_base (235)..(235): a, c, t, g, unknown or other
  misc_feature (235)..(235): n is a, c, g, or t
  modified_base (474)..(474): a, c, t, g, unknown or other
  misc_feature (474)..(474): n is a, c, g, or t
tcagactgtacagtcacgaccggtgctcgatttagctgcgtcacgatctctcttggggagcttcagctgtggtagagaagacaggattcaggacaatctccagcatggccgcctccctctcctcctcaccctcctcactcactgtgcagggtcctgggcccagtctgtgctgactcacgcccaccctcagtgtcgcggggacccccggnagaggtctcatctcttgtcgtgggancagcctaccgacgtacggtaaattagttgtactactggtaccagcacgtaccacccgaaacggaaacccggcccccaaagccctccactatactaagtaaggaatgaatcgacgccggccctagaacggactactgaccgtattctcgtcgcctacgaagtccgtcgggcccttcccgtcccggccccttaccgcggaccctagtccgagggtccgggccgttaccgggccgaagtagnggacgtacgtaagtaattagttcgtgtcggtacgttaggttacggacgtcgtacgtagtcggtaggtaacgggtcgggttacgggtcggttacggggtacgggaacgggaaccgggacgttacggtccgtacggtaacccgtcgtaccggaccaaccgaacccgtaacg

SEQ ID NO: 311358 - DNA, 637 bp, Homo sapiens
  misc_feature: GZ8MTXP01BS7LX.25.36.D03.1.454.CMB.2.raw
  modified_base (208)..(208): a, c, t, g, unknown or other
  misc_feature (208)..(208): n is a, c, g, or t
  modified_base (304)..(304): a, c, t, g, unknown or other
  misc_feature (304)..(304): n is a, c, g, or t
  modified_base (311)..(311): a, c, t, g, unknown or other
  misc_feature (311)..(311): n is a, c, g, or t
  modified_base (352)..(352): a, c, t, g, unknown or other
  misc_feature (352)..(352): n is a, c, g, or t
  modified_base (371)..(371): a, c, t, g, unknown or other
  misc_feature (371)..(371): n is a, c, g, or t
tcagactgtacagtcacgaccggtgctcgatttagctgcgtcacgatctctcttggggagcttcagctgtggtagagaagacaggattcaggacaatctccagcatggccggcctccctctcctcctcacccctcctcactcactgtgcagggtcctgggcccagtctgtgctgactcagccaccctcagtgtctgggacccccgggnagagggtctccatcctcttgttcgtgggagcagctccgacgtcggaaatagtttgtctactggtaccagcagctcccagaaccgccccaagctccncatctanaggaatgatcagcgccctgacgggactacgtgaccgattcnctggctcgagtctggctcnccggcctccgtggccatcgagtcgggcctccgggtccgaggatcggaggtcctaggggtaattagtttacgtgtcggcgtagggtttgggacttcggccctaggttccgtggtaacggttcggggttaccccgggtagggggttccggttaccgggggacccgggggttaaacggggcccccgttaaaagggtcccgttacgggtaacccccggttccggttaaacgggttcccgtaacccgggttaacccccggtaaacccgggg

SEQ ID NO: 311359 - DNA, 742 bp, Homo sapiens
  misc_feature: GZ8MTXP01BUQ8K.25.36.D03.1.454.CMB.2.raw
  modified_base (230)..(230): a, c, t, g, unknown or other
  misc_feature (230)..(230): n is a, c, g, or t
  modified_base (236)..(236): a, c, t, g, unknown or other
  misc_feature (236)..(236): n is a, c, g, or t
  modified_base (244)..(244): a, c, t, g, unknown or other
  misc_feature (244)..(244): n is a, c, g, or t
  modified_base (269)..(269): a, c, t, g, unknown or other
  misc_feature (269)..(269): n is a, c, g, or t
  modified_base (289)..(289): a, c, t, g, unknown or other
  misc_feature (289)..(289): n is a, c, g, or t
  modified_base (333)..(333): a, c, t, g, unknown or other
  misc_feature (333)..(333): n is a, c, g, or t
tcagactgtacagtcacgaccggtgctcgatttagctgcgtcacgatctctcgttggggggggtctcaggaggcagcgctctcgggacgtctccaccatggcctgggctctgctgttcctcaccctcctcactcagggcacagggtcctgggcccagtctgccctgactcagcctgcctccgtgtctgggactcctggacagtcggtcaccatctcctgcactggaaccngccgtnacattggntcttataactatgtctctgtccaanacaccagcaacggccccaancatcatttatgatgtcagtcatcggccctcgtggtagtttcccnggtcgtcttctctacgggtccttccgaagttccgtacggcctaacgtccgggtccctcccgtacggaccctacgtccgtccgggggccttcccggaacgggtcccgttagggaacggggaaccggtaacgggtacccgttaaaccgttttaactttaaggttttcggtaccgtttaaacgtttttaccccgaaagtttaaaccaaacgggtaaaccgtaaacccgaaaccctaaaaccgttaaacgggttcccgttaagggggtttccgggtttaccgggggaccggggtaacggggttaaccgtaaacgggttccggttaacccgggttcccggttacgggttaacccgtacggtaaccccgaaacggggtccccgttacccgggtccccccgtttccggggttcccc

SEQ ID NO: 311360 - DNA, 679 bp, Homo sapiens
  misc_feature: GZ8MTXP01BZP5L.25.36.D03.1.454.CMB.2.raw
  modified_base (260)..(260): a, c, t, g, unknown or other
  misc_feature (260)..(260): n is a, c, g, or t
  modified_base (312)..(312): a, c, t, g, unknown or other
  misc_feature (312)..(312): n is a, c, g, or t
  modified_base (328)..(328): a, c, t, g, unknown or other
  misc_feature (328)..(328): n is a, c, g, or t
tcagactgtacagtcacgaccggtgctcgatttagctgcgtcacgatctctcttgggagatgggtcctgtcccagatgcacctgcaggagtcgggcccaggactggtgaagccttcggagaccctgtccctcacctgcagtgtctctggtggctccgtcagtgcttattactggagctggatccgccagtccgccgggagggactgggagtggattgggcgtatatatacgaatggattaaccacctacaacccctcctnaagagtcgagtcaccatatcagcggacacgtccagggatcgaggtgttcccngctatctgtacttcgngccgtacgtcggcccggaccggaccaccggtaccctataccgtaacgtgtcgaccaaggacgtacgttacggactggacgtacgttagtttacggaagttaatttattacttacgtttgttcgttcgtttagtacgtagttacgggtacgggaaccgggtaaacggggtaccggtaccggttaccgtacccgttccgttccgttaccgaccgtccctacccgaacccgtaaccgggtcccctaaccggttcccggttccccttccccgttccggtacccctaccccttcccgttacccgaacgtaaccgtacccgtcccgtcgggtcggggacctaaccggccggtcccgg

SEQ ID NO: 311361 - DNA, 579 bp, Homo sapiens
  misc_feature: GZ8MTXP01BYQ36.25.36.D03.1.454.CMB.2.raw
  modified_base (208)..(208): a, c, t, g, unknown or other
  misc_feature (208)..(208): n is a, c, g, or t
  modified_base (236)..(236): a, c, t, g, unknown or other
  misc_feature (236)..(236): n is a, c, g, or t
tcagactgtacagtcacgaccggtgctcgatttagctgcgtcacgatctctcttggggagcttcagctgtggtagagaagacaggattcaggacaatctccagcatggccggcctccctctcctcctcaccctcctcactcactgtgcagggtcctgggcccagtctgtgctgactcagcccaccctcagtgtctgggacccccgggnagagggtctccatctcttgttctgggancagctccgacgtcggaaataagttgtctactggtaccagcagctcccagaaccggcccccaagcctcctcatctataggaatgatcgagccggccctcgacgggactaccgtgacccgattcctctggctcgaagtctgggctcctccggccctcccgtggccatcgaggtcgggctacccgggtccgaggatcggaggtctaggggaattagttactggtgtcgtaggtttgggactggtccctagttcgtggtaaggtcgggttccggtacgggttggttcggggcgggacgggccgaaggtcgtggaacccgtccgtaggcctaacggccccgtaacggg

SEQ ID NO: 311362 - DNA, 577 bp, Homo sapiens
  misc_feature: GZ8MTXP01D2091.25.36.D03.1.454.CMB.2.raw
  modified_base (245)..(245): a, c, t, g, unknown or other
  misc_feature (245)..(245): n is a, c, g, or t
  modified_base (428)..(428): a, c, t, g, unknown or other
  misc_feature (428)..(428): n is a, c, g, or t
tcagactgtacagtcacgaccggtgctcgatttagctgcgtcacgatctctcttggggggggtctcaggaggcagcgctctcgggacgtctccaccatggcctgggctctgctgttcctcaccctcctcactcagggcacagggtcctgggcccagtctgccctgactcagcctgcctccgtgtctgggactcctggacagtcggtcaccatctcctgcactggaaccagccgtgactattggtncttataactatgtctcctgtccaacaacacccaggcaacggccccaaactcatcatttatgatgtcagtcatcggcccttctggtacgtttcctggtcgtcttctcgtcggcctccgaagtctggcaacgtccggctccctgacctatcgtcgggctcgaggctgaggacgagtctaacgttnttacgttgctatttcatacagacaactaccaagtgtcgtgggtaacgttcgggcgggtaaacgggaccgtaaaggttccgaacccggttccgttacgggtccacggaaccccgtaaagggcccttccggtccccccgttgggttccccg

SEQ ID NO: 311363 - DNA, 528 bp, Homo sapiens
  misc_feature: GZ8MTXP01A2JDH.25.36.D03.1.454.CMB.2.raw
  modified_base (244)..(244): a, c, t, g, unknown or other
  misc_feature (244)..(244): n is a, c, g, or t
  modified_base (447)..(447): a, c, t, g, unknown or other
  misc_feature (447)..(447): n is a, c, g, or t
  modified_base (493)..(493): a, c, t, g, unknown or other
  misc_feature (493)..(493): n is a, c, g, or t
tcagactgtacagtcacgaccggtgctcgatttagctgcgtcacgatctctcttggggggggtctcaggaggcagcgctctcgggacgtctccaccatggcctgggctctgctgttcctcaccctcctcactcagggcacagggtcctgggcccagtctgccctgactcagcctgcctccgtgtctgggactcctggacagtcggtcaccatctcctgcactggaaccagccgtgacattggtncttataactatgtctctgtccaacaacacccaggcaacggccccaaatcatcattatgatgtcagtcactcggccctcgtggtacgtttcctggtcgtcttctctcggctcaagtctggcaacgtcgcctcctgaccatcgtcgggctccgaggctgaggacgagtctacgttattagttgctattcatacagacgacactanagtctgggtcgttcggcgggtacgggactaaggttcgacccgttcncggtcacgcccaaggccttcgtccccgttggtccc

SEQ ID NO: 311364 - DNA, 554 bp, Homo sapiens
  misc_feature: GZ8MTXP01ED9QO.25.36.D03.1.454.CMB.2.raw
  modified_base (244)..(244): a, c, t, g, unknown or other
  misc_feature (244)..(244): n is a, c, g, or t
  modified_base (326)..(326): a, c, t, g, unknown or other
  misc_feature (326)..(326): n is a, c, g, or t
  modified_base (336)..(336): a, c, t, g, unknown or other
  misc_feature (336)..(336): n is a, c, g, or t
  modified_base (376)..(376): a, c, t, g, unknown or other
  misc_feature (376)..(376): n is a, c, g, or t
tcagactgtacagtcacgaccggtgctcgatttagctgcgtcacgatctctcttggggggggtctcaggaggcagcgctctcgggacgtctccaccatggcctgggctctgctgttcctcaccctcctcactcagggcacagggtcctgggcccagtctgccctgactcagcctgcctccgtgtctgggactcctggacagtcggtcaccatctcctgcactggaaccagccgtgacattggtntacttataactatgtctcctggtcccaacaacacccagcaacggcccccaaatcatcatttatgatgtcagtcatcgccctntggatttccnggtctcttctctggctcagtctggcaactcggcctccctnacatcgtcgggctccaggctggaggacgaggcttacgttattagttgtctatttcaattacaagtagaacacctaacagtcctagggtcgttcgggcgggtaacgggacgtaacggttcgacccgttccgttcgggtcacggcccgaagggccttccggtccccccgttggttccccg

SEQ ID NO: 311365 - DNA, 611 bp, Homo sapiens
  misc_feature: GZ8MTXP01DKXJA.25.36.D03.1.454.CMB.2.raw
  modified_base (236)..(236): a, c, t, g, unknown or other
  misc_feature (236)..(236): n is a, c, g, or t
  modified_base (390)..(390): a, c, t, g, unknown or other
  misc_feature (390)..(390): n is a, c, g, or t
tcagactgtacagtcacgaccggtgctcgatttagctgcgtcacgatctctcttggggagcttcagctgtggtagagaagacaggattcaggacaatctccagcatggccggcctccctctcctcctcaccctcctcactcactgtgcagggtcctgggcccagtctgtgctgactcagcccaccctcagtgtctcgggacccccgggcagagggtctccatctcttgtctgggancagctccgacgtcggaaataagttgtctactgtaccagcagctcccagaaccggcccccaagctcctcatctataggaatgatcagccgccctcgacgggatactgaccgattctctggctcgaagtctcggctccgtcggcctccctggccancgagtcgggctccggtccgaggatggaggctagggaacttagttaactggtgtcgtaggtttggggattcggccctaggtccgtggtaacggttcgggttcccgggtacgggttcgggttccggggcggggaacgggggacccgttaaacgggtcccgtacgggtaacccccgggttcccgtacggggttacccgtaaccggaacccccggtaaaccgggg

SEQ ID NO: 311366 - DNA, 533 bp, Homo sapiens
  misc_feature: GZ8MTXP01A2LV7.25.36.D03.1.454.CMB.2.raw
  modified_base (225)..(225): a, c, t, g, unknown or other
  misc_feature (225)..(225): n is a, c, g, or t
  modified_base (240)..(240): a, c, t, g, unknown or other
  misc_feature (240)..(240): n is a, c, g, or t
  modified_base (259)..(259): a, c, t, g, unknown or other
  misc_feature (259)..(259): n is a, c, g, or t
  modified_base (377)..(377): a, c, t, g, unknown or other
  misc_feature (377)..(377): n is a, c, g, or t
  modified_base (443)..(443): a, c, t, g, unknown or other
  misc_feature (443)..(443): n is a, c, g, or t
  modified_base (462)..(462): a, c, t, g, unknown or other
  misc_feature (462)..(462): n is a, c, g, or t
tcagactgtacagtcacgaccggtgctcgatttagctgcgtcacgatctctcttggggggggtctcaggaggcagcgctctcgggacgtctccaccatggcctgggctctgctgttcctcaccctcctcactcagggcacagggtcctgggcccagtctgccctgactcagcctgcctccgtgtctggactcctggacagtcgtcacatctctgcactggaaccngccgtgacattggtntcttataactatgtctccngtcccaacaacacccaggcaacggcccccaaactcatcatttatgatgtcagtcatcgccctcgtggtagtttcctggtcgtcgttctctggctcagtctgcactcgcctccctgacntcgcgggctcgaggctgaggacgagtctacgttattagttgctatttacatacagacacaaccaanagttccgtggtcgttcggngggtaacggaccgtaaagttcgaccgttccttcggtcacgcccgaagggccttccgtccccgttcggtccc

SEQ ID NO: 311367 - DNA, 650 bp, Homo sapiens
  misc_feature: GZ8MTXP01EP0R1.25.36.D03.1.454.CMB.2.raw
  modified_base (187)..(187): a, c, t, g, unknown or other
  misc_feature (187)..(187): n is a, c, g, or t
  modified_base (208)..(208): a, c, t, g, unknown or other
  misc_feature (208)..(208): n is a, c, g, or t
  modified_base (235)..(235): a, c, t, g, unknown or other
  misc_feature (235)..(235): n is a, c, g, or t
  modified_base (355)..(355): a, c, t, g, unknown or other
  misc_feature (355)..(355): n is a, c, g, or t
  modified_base (362)..(362): a, c, t, g, unknown or other
  misc_feature (362)..(362): n is a, c, g, or t
  modified_base (366)..(366): a, c, t, g, unknown or other
  misc_feature (366)..(366): n is a, c, g, or t
tcagactgtacagtcacgaccggtgctcgatttagctgcgtcacgatctctcttggggagcttcagctgtggtagagaagacaggattcaggacaatctccagcatggccggcctccctctcctcctcaccctcctcactcactgtgcagggtcctgggcccagtctgtgctgactcagccaccctnagtgtcgtcgggaaccccggnagagggtctcatctcttgtcgtgggancagcctccgacgtacggaaatagttgtctactggtaccagcacgcctacccgaacgaacccggacccccaagcctcctcatctaagtaggaatgatcacgccggcctcgacggactacgngaccgtnttcncgtggtctacgaagtcgtcgtcctccgtcggcctcccgtggccatcgaggtcggccgttccggcgaggtacgtggaacggtcgtaagggtaattacgtttacgtggtgtcgtagggtttaggggacttcggaccgtaggttcggtagggtaacgggtttcggggttaccgggtacggggtttcggggttaccggggaaccgggggttacggggaacccgaacgggtccgtaccgggtaacccggttccggtaacgggttccgaaccgggttcccggtaaccggg

SEQ ID NO: 311368 - DNA, 591 bp, Homo sapiens
  misc_feature: GZ8MTXP01C7R6U.25.36.D03.1.454.CMB.2.raw
  modified_base (188)..(188): a, c, t, g, unknown or other
  misc_feature (188)..(188): n is a, c, g, or t
  modified_base (207)..(207): a, c, t, g, unknown or other
  misc_feature (207)..(207): n is a, c, g, or t
  modified_base (233)..(233): a, c, t, g, unknown or other
  misc_feature (233)..(233): n is a, c, g, or t
tcagactgtacagtcacgaccggtgctcgatttagctgcgtcacgatctctcttggggagcttcagctgtggtagagaagacaggattcaggacaatctccagcatggccggcctccctctcctcctcaccctcctcactcactgtgcagggtcctgggcccagtctgtgctgactcagcccaccctnagtgtctcgggaccccggnagaggtctccatctcttgtctgggancagcctccgacgtcggaaattagttgtctactggtaccagcagcctaccccaagaacccggcccccaagcctcctcatctataggaatgatcacgccgccctcgacggactactgaccgtattctctggctacgaagtctcggcctccgtccggtccctcccgtcggccatccgaggtcgggtccgtccgggtccggaggagtggaacggtctaggggtaaacttagtttacctggtcgcgttagggtttgggaagtcgtaccgtagtcgtggtaacgtcgggttccggtacgggttggttcgggcgggttacgggccaaggcgtcgccggtccgaggttccgtaacgcccgtaacgg

SEQ ID NO: 311369 - DNA, 739 bp, Homo sapiens
  misc_feature: GZ8MTXP01CAJHJ.25.36.D03.1.454.CMB.2.raw
  modified_base (206)..(206): a, c, t, g, unknown or other
  misc_feature (206)..(206): n is a, c, g, or t
  modified_base (230)..(230): a, c, t, g, unknown or other
  misc_feature (230)..(230): n is a, c, g, or t
  modified_base (246)..(246): a, c, t, g, unknown or other
  misc_feature (246)..(246): n is a, c, g, or t
tcagactgtacagtcacgaccggtgctcgatttagctgcgtcacgatctctcgttgggggggtctcaggaggcagcgctctcgggacgtctccaccatggcctgggctctgctgttcctcaccctcctcactcagggcacgagggtcctgggcccaggtctggccctgactcagcctgcctcgtgtctggactcctggacagtcgnaccatctcctgacactggaaaccngtcgtgactagttggntacttaatactatcgtcctccgacgtacccaacaaccaccgacgaccaaccgacccctaaatcaatactaattagtgtatgtacagtcacgtccgcctgtggtctttccgtggtctcttctcgtcgtacctcgtacgtcgtacggacctaccgtcccggtccctcccgtaccgtaccgtacgtccggtccgggtccgtaccggtacggtacggtacgggtaacgggaacggtaacggtaacgttaacgtttaacgtttacggtttacgttacgttaactttactaaacgtaaacgtaacgaaacgtaaaccgtaaaccgtaaaccgtaacggttacggttacgggttaacgggttacggggttacggggtaaacgggttaaccggtaaaccggttaaccggttacccggttcccggttacccggtaaccgtacccggtaacccggtaacccgggtacccggttaccccggtcccccggttccccggtaacccg

SEQ ID NO: 311370 - DNA, 540 bp, Homo sapiens
  misc_feature: GZ8MTXP01EVHGZ.25.36.D03.1.454.CMB.2.raw
  modified_base (227)..(227): a, c, t, g, unknown or other
  misc_feature (227)..(227): n is a, c, g, or t
  modified_base (242)..(242): a, c, t, g, unknown or other
  misc_feature (242)..(242): n is a, c, g, or t
  modified_base (260)..(260): a, c, t, g, unknown or other
  misc_feature (260)..(260): n is a, c, g, or t
  modified_base (333)..(333): a, c, t, g, unknown or other
  misc_feature (333)..(333): n is a, c, g, or t
tcagactgtacagtcacgaccggtgctcgatttagctgcgtcacgatctctcttgggggggtctcaggaggcagcgctctcgggacgtctccaccatggcctgggctctgctgttcctcaccctcctcactcagggcacagggtcctgggcccagtctgccctgactcagcctgcctccgtgtctgggactcctggacagtcgtcaccatctcctgcactggaaccngccgtgacattggtncttataactatgtctccnggtcccaacaacacccaggcaaggcccccaaatcatcatttatgatgtcagtcatcggccctctggatttccnggtcgcttctctgctccaagtctggcactcggcctccctgaccatcgtcggggctcccgaggctgaggacgacggctacgttattagttgactatttcatacagtagaccactaacagtctggtgttcggacgggaggttacccgtaaaggtcgaacccgttcgttaccggtcacggtcccaaggccttcgcccccgttggtaaccc

SEQ ID NO: 311371 - DNA, 612 bp, Homo sapiens
  misc_feature: GZ8MTXP01ENE12.25.36.D03.1.454.CMB.2.raw
  modified_base (213)..(213): a, c, t, g, unknown or other
  misc_feature (213)..(213): n is a, c, g, or t
  modified_base (244)..(244): a, c, t, g, unknown or other
  misc_feature (244)..(244): n is a, c, g, or t
  modified_base (372)..(372): a, c, t, g, unknown or other
  misc_feature (372)..(372): n is a, c, g, or t
  modified_base (451)..(451): a, c, t, g, unknown or other
  misc_feature (451)..(451): n is a, c, g, or t
tcagactgtacagtcacgaccggtgctcgatttagctgcgtcacgatctctcttggggagcttcagctgtggtagagaagacaggattcaggacaatctccagcatggccggcctccctctcctcctcaccctcctcactcactgtgcagggtcctgggcccagtctgtgctgactcacgcccaccctcagtgtcgtcggggaccccccgggnaggacgggtctccattctcttgttctgggancagctccgacgtcggaaattagttgtctactggtaccagcagcctcccgaacgaacccggcccccaagcctcctcatctaataggaatgatcgagccggccctgacgggactaccgtgaccgattccncgtggctacgagtctgggcctccgtccggccctccgtacggcccagtccgaggttcgggccttccgggtccgaggtacnggaggtctaggggtaaactttgttactggtgtcgttagggttttgggactcggccctagttcgtggaacgggttcgggttccgggtacgggttggttaccggggcgggaaggggaccaggcgttcggaacccgttccggaggcctaacggcccgtaacggg

SEQ ID NO: 311372 - DNA, 597 bp, Homo sapiens
  misc_feature: GZ8MTXP01BQ9YP.25.36.D03.1.454.CMB.2.raw
  modified_base (253)..(253): a, c, t, g, unknown or other
  misc_feature (253)..(253): n is a, c, g, or t
  modified_base (257)..(257): a, c, t, g, unknown or other
  misc_feature (257)..(257): n is a, c, g, or t
  modified_base (287)..(287): a, c, t, g, unknown or other
  misc_feature (287)..(287): n is a, c, g, or t
  modified_base (295)..(295): a, c, t, g, unknown or other
  misc_feature (295)..(295): n is a, c, g, or t
  modified_base (300)..(300): a, c, t, g, unknown or other
  misc_feature (300)..(300): n is a, c, g, or t
  modified_base (313)..(313): a, c, t, g, unknown or other
  misc_feature (313)..(313): n is a, c, g, or t
  modified_base (531)..(531): a, c, t, g, unknown or other
  misc_feature (531)..(531): n is a, c, g, or t
tcagactgtacagtcacgaccggtgctcgatttagctgcgtcacgatctctcttgggagatgggtcctgtcccagatgcacctgcaggagtcgggcccaggactggtgaagccttcggagaccctgtccctcacctgcagtgtctctggtggctccgtcagtgcttatactggagctggatccgccagtccgcgggagggactggagtggattgggctatatatacgatggattaaccactacaacccctccnaagngtcgatcacatatcagcggacacgtcaggntcgaggtnttccngcatctgacttcngcgactgccgcggaccacggccctagtacctaacgtgtcgacccaaggacgtacgttccgggaactgggaccgtacgttagtttttacggaagtaatttattattcgtttagttgttctttagactagtcgggtgggaccgaaggggtacgtacggtcaccgtctcttcgacgtccctccgaccgtaacgggccctaacgtccggttccttcccccgnggtcccctaccccttccgttaccaacgcgcccgaaccgttcggcggggacctaacgcggtcccggg

SEQ ID NO: 311373 - DNA, 533 bp, Homo sapiens
  misc_feature: GZ8MTXP01DQE0O.25.36.D03.1.454.CMB.2.raw
  modified_base (213)..(213): a, c, t, g, unknown or other
  misc_feature (213)..(213): n is a, c, g, or t
  modified_base (311)..(311): a, c, t, g, unknown or other
  misc_feature (311)..(311): n is a, c, g, or t
  modified_base (364)..(364): a, c, t, g, unknown or other
  misc_feature (364)..(364): n is a, c, g, or t
  modified_base (369)..(369): a, c, t, g, unknown or other
  misc_feature (369)..(369): n is a, c, g, or t
  modified_base (454)..(454): a, c, t, g, unknown or other
  misc_feature (454)..(454): n is a, c, g, or t
  modified_base (494)..(494): a, c, t, g, unknown or other
  misc_feature (494)..(494): n is a, c, g, or t
tcagactgtacagtcacgaccggtgctcgatttagctgcgtcacgatctctcttggggagcttcagctgtgggtagagaagacaggactcaggacaatctccagcatggccagcttccctctcctcctcaccctcctcactcactgtgcagggtcctgggcccagtctgtgctgtctcagcccaccctcagtgtccgtcgggggccccccggnaggagggtcacatctcttgtctggaagtcgctccaacgtcggcagtaaatagtgtaaagctggtaaccagccaacctcccaaggaaaccggcccccanacctcctcatgtatgggaatcgatcagccgcccctgacggggtcctgaccgtnttccnctgccctccacgtctgcactcacgcctcctgccagtccgtcggcctaccaattcgagaggatcggacgggtaccgtatttaattnttgtgctagcggtggatacgagaggaagtagttatcgttntacggagttggacaggtcacgtctagcacgccgaagccc

SEQ ID NO: 311374 - DNA, 535 bp, Homo sapiens
  misc_feature: GZ8MTXP01BPDJL.25.36.D03.1.454.CMB.2.raw
  modified_base (323)..(323): a, c, t, g, unknown or other
  misc_feature (323)..(323): n is a, c, g, or t
  modified_base (530)..(530): a, c, t, g, unknown or other
  misc_feature (530)..(530): n is a, c, g, or t
tcagactgtacagtcacgaccggtgctcgatttagctgcgtcacgatctctcttgggagatgggtcctgtcccagatgcacctgcaggagtcgggcccaggactggtgaagccttcggagacccctgtccctcacctgcagtgtctctggtggctccgtcagtgcttattactggagctggatccgccagtccgccggaggggactggagtggattggggctatatatacgaatggattaaccacctacaacccctcctcaagagtcgagtcaccatatcagcggacacgtccagggatcaggtgttcctgcatctgacttcngcgactgccgcggacacggccctatactaactgtgccagagattcgggactgcgacgattttcggagaattattatctttgtgtcttttgactatgtggggccgaagggacgacggtcaccgtctcttcacgcctccaccaacgggcccaatcggttcttcccccttggccacccttccttccagaagcaacctcgtggggcaacgngccgg

SEQ ID NO: 311375 - DNA, 566 bp, Homo sapiens
  misc_feature: GZ8MTXP01CJB3Y.25.36.D03.1.454.CMB.2.raw
  modified_base (258)..(258): a, c, t, g, unknown or other
  misc_feature (258)..(258): n is a, c, g, or t
  modified_base (262)..(262): a, c, t, g, unknown or other
  misc_feature (262)..(262): n is a, c, g, or t
  modified_base (299)..(299): a, c, t, g, unknown or other
  misc_feature (299)..(299): n is a, c, g, or t
  modified_base (317)..(317): a, c, t, g, unknown or other
  misc_feature (317)..(317): n is a, c, g, or t
  modified_base (537)..(537): a, c, t, g, unknown or other
  misc_feature (537)..(537): n is a, c, g, or t
tcagactgtacagtcacgaccggtgctcgatttagctgcgtcacgatctctcttgggagatgggtcctgtcccagatgcacctgcaggagtcgggcccaggactggtgaagccttcggagaccctgtccctcacctgcagtgtctctggtggctccgtcagtgcttattactggagctggatccgccagtccggccgggagggactgggagtggattgggcgtatatatacgaatggattaaccactacaaccctccnaagngtcgatcacatatcagcgacacgtcaggatcgaggtntcctgctatctgacttcngcgactcgccgccggacacggccctaatactaactgtcgccaagagtacttcgggactggacgtacgttagtttcggaagtaatttattattctttgtgtcttttgactagtggtaggggaccggaaggggtacgtacggtaccaccgtctcttcacgcctccaccgaacggcccaatccggttccttccccgcggccctacccttcccgttccaacgcnccaaccgtcgcgggggcaacgcggcccgg

SEQ ID NO: 311376 - DNA, 686 bp, Homo sapiens
  misc_feature: GZ8MTXP01B2U7T.25.36.D03.1.454.CMB.2.raw
  modified_base (208)..(208): a, c, t, g, unknown or other
  misc_feature (208)..(208): n is a, c, g, or t
  modified_base (236)..(236): a, c, t, g, unknown or other
  misc_feature (236)..(236): n is a, c, g, or t
tcagactgtacagtcacgaccggtgctcgatttagctgcgtcacgatctctcttggggagcttcagctgtggtagagaagacaggattcaggacaatctccagcatggccggcctccctctcctcctcaccctcctcactcactgtgcagggtcctgggcccagtctgtgctgactcagccaccctcagtgtctcgggacccccgggnagagggtctccatctcttgttctgggancagctccgagtcggaaatagtttgtctactggtaccagcagctcccagaaccggcccccaagcctcctcatctataggaatgatcagcggccctgacgggactaccgtgacccgtattccgtactcgggctaccggaaagttccgtgggcccttcccgtccggggtccccttccccgtaggggcccctacgttccgaagggttcggggcccttcccggggtcccggaaggaacgttcggaggggtccttagggggaaactttagtttaacccgtagggttcgaccgttaaggtttttgggggaaacttcgggccctaagggtttccgtgggaacgggttcgggttcccgggttacgggttcggtttaccgggggacgggttacggggaacccgaggtcccgttacgggccccgtttaccggacggttccgaacggttaaccccgaacggg

SEQ ID NO: 311377 - DNA, 618 bp, Homo sapiens
  misc_feature: GZ8MTXP01DKR3O.25.36.D03.1.454.CMB.2.raw
  modified_base (209)..(209): a, c, t, g, unknown or other
  misc_feature (209)..(209): n is a, c, g, or t
  modified_base (224)..(224): a, c, t, g, unknown or other
  misc_feature (224)..(224): n is a, c, g, or t
  modified_base (235)..(235): a, c, t, g, unknown or other
  misc_feature (235)..(235): n is a, c, g, or t
  modified_base (260)..(260): a, c, t, g, unknown or other
  misc_feature (260)..(260): n is a, c, g, or t
  modified_base (303)..(303): a, c, t, g, unknown or other
  misc_feature (303)..(303): n is a, c, g, or t
  modified_base (341)..(341): a, c, t, g, unknown or other
  misc_feature (341)..(341): n is a, c, g, or t
  modified_base (355)..(355): a, c, t, g, unknown or other
  misc_feature (355)..(355): n is a, c, g, or t
tcagactgtacagtcacgaccggtgctcgatttagctgcgtcacgatctctcttggggagcttcagctgtggtagagaagacaggattcaggacaatctccagcatggccggcctccctctcctcctcaccctcctcactcactgtgcagggtcctgggcccagtctgtgctgactcagcccaccctcagtgtctcgggacccccgggnagaggtctccatctnttgtctgggancagcctcgacgtcggaaatagtttntctactggtaccagcagcctcccagaaccggccccaagctccncatctataggatgatcacgcggcctcgacggactacgngacccgtattcctntcggctacgaacgtcgtcggtcccttccgtccggcccttccgtcggcctactcgtaaggtcggggtcctccgggtcccggagggtacgtggaacggtctaggggtaaacttagtttaaccgtgtagtcgtaggttttgggattcgtccgtagtccgtggtaacggttcgggttccggtacgggttggttacgggcgggaacgggttacccaaggtccgtacggtaacccgttccgtaacggttccgaacggccccgtaacggg

SEQ ID NO: 311378 - DNA, 621 bp, Homo sapiens
  misc_feature: GZ8MTXP01ETSUY.25.36.D03.1.454.CMB.2.raw
  modified_base (244)..(244): a, c, t, g, unknown or other
  misc_feature (244)..(244): n is a, c, g, or t
tcagactgtacagtcacgaccggtgctcgatttagctgcgtcacgatctctcttggggggggtctcaggaggcagcgctctcgggacgtctccaccatggcctgggctctgctgttcctcaccctcctcactcagggcacagggtcctgggcccagtctgccctgactcagcctgcctccgtgtctggactcctggacagtcggtcaccatctcctgcactggaaccagccgtgactattggtntacttataactatgtctcctcggtacccaacaaccacccaggaccaacggacccccaaatcatctatttatgatgtcagtcacgtccggcctcgtggtacgtttccgtcggtcgtcttctcgtcggtctccgtaagtccgtacggcctaaccgttccgggccccttcccgtcgaccctacgttccggtccggggccttccgaacggtcgtaggacggacgagtacttaactttattacgttgtactatttacatacagtacaaccaactaacgacgtcgtgggtaagttcgggcgggtaacgggaccgtaaggtcgttacccggttccgttacgggtcacgcccgaggtcccttaccggtcccccgttgggtaaccc

SEQ ID NO: 311379 - DNA, 688 bp, Homo sapiens
  misc_feature: GZ8MTXP01C8IPS.25.36.D03.1.454.CMB.2.raw
  modified_base (242)..(242): a, c, t, g, unknown or other
  misc_feature (242)..(242): n is a, c, g, or t
  modified_base (261)..(261): a, c, t, g, unknown or other
  misc_feature (261)..(261): n is a, c, g, or t
  modified_base (300)..(300): a, c, t, g, unknown or other
  misc_feature (300)..(300): n is a, c, g, or t
tcagactgtacagtcacgaccggtgctcgatttagctgcgtcacgatctctcgttggggggggtctcaggaggcagcgctctcgggacgtctccaccatggcctgggctctgctgttcctcaccctcctcactcagggcacagggtcctgggcccagtctgccctgactcagcctgcctccgtgtctggactcctggacagtcggtcacatctctgcactggaaccagccgtgactattggntacttataactatgtctcncgtaccaacacaccagacaacgccccaaatcatcattangatgcagtcacgtccgtcctcgttggtagtttccgtggtctcttctcgtacggtcctctaaagtcgttacgggcctaaaccgtcccgggtaccctccccgttacgaaaccctacgtcccggttccggggacccttccggaacggtccgtaagggaacgggacgacgggtacctacgtttattaagttcgtacttactttaccaattaaccgaaggtaacgtaaacctaaacccaaaccgtaaggttacccgtggggttcggtttaccggggacgggtaaacgggttaaaccccgtaaagggtttccgaaccccggtttcccggacggttaaccgaaccggtaacccgtaaaccgggccgttacccggccccccgttcggttaaccccg

SEQ ID NO: 311380 - DNA, 622 bp, Homo sapiens
  misc_feature: GZ8MTXP01EDWKJ.25.36.D03.1.454.CMB.2.raw
  modified_base (210)..(210): a, c, t, g, unknown or other
  misc_feature (210)..(210): n is a, c, g, or t
  modified_base (238)..(238): a, c, t, g, unknown or other
  misc_feature (238)..(238): n is a, c, g, or t
tcagactgtacagtcacgaccggtgctcgatttagctgcgtcacgatctctcttggggagcttcagctgtggtagagaagacaggattcaggacaatctccagcatggccggcctccctctcctcctcaccctcctcactcactgtgcagggtcctgggcccagtctgtgctgactcagccaccctcagtgtccgtcgggacccccgggnagagggtctccatctcttgttctgggancagctccgacgtcggaaattagttgtctactggtaccagcagcctacccgaagaaccgccccaagctcctcatctataggatgatcagccgccctagacggactacttgaccgtattcctcgtcgggctacgtaacgtccgtcgggtccctcccgtcccggcccctcccgtcggccccagttcgacggttcggggccgtccgggtaccgaggtatggacggtctaggggtaaattagttaacgtgtcgtcgtaggtttgggattcgccgtagttccgtggtaacggttcgggttcccggtagggtttcgggtccgggacgggacgggaccgaaggtccgtacggaacccggttcgtacgggaccgtaacggccccgtaaccggg

SEQ ID NO: 311381 - DNA, 555 bp, Homo sapiens
  misc_feature: GZ8MTXP01AVKVU.25.36.D03.1.454.CMB.2.raw
  modified_base (208)..(208): a, c, t, g, unknown or other
  misc_feature (208)..(208): n is a, c, g, or t
  modified_base (260)..(260): a, c, t, g, unknown or other
  misc_feature (260)..(260): n is a, c, g, or t
  modified_base (298)..(298): a, c, t, g, unknown or other
  misc_feature (298)..(298): n is a, c, g, or t
  modified_base (304)..(304): a, c, t, g, unknown or other
  misc_feature (304)..(304): n is a, c, g, or t
  modified_base (341)..(341): a, c, t, g, unknown or other
  misc_feature (341)..(341): n is a, c, g, or t
  modified_base (347)..(347): a, c, t, g, unknown or other
  misc_feature (347)..(347): n is a, c, g, or t
  modified_base (351)..(351): a, c, t, g, unknown or other
  misc_feature (351)..(351): n is a, c, g, or t
tcagactgtacagtcacgaccggtgctcgatttagctgcgtcacgatctctcttggggagcttcagctgtgggtagagaagacaggactcaggacaatctccagcatggccagcttccctctcctcctcaccctcctcactcactgtgcagggtcctgggcccagtctgtgctgtctcagccacctcagtgtcgtcggggcccccggnaggaggtcgacatctcttgttctggaagtcgctccaacgtcggcagtaatgngtaagctggtaccagcaactcccgaggaaccgccccanactccncatgtatgggaatgatcagccgccctcgacgggtccngaccgnttcnctgccctcacgtctgcacctcacgccctccgtggccagtccggtggcctcaatctgaggatggacggggcgtatttagtagttgagcaggcggtggataggacgaagggtaaagtaacggttagtcggttacgttacggtaagttcgggaaccttaagggtcctacccgtcgtacgggtccacgtaaccccgaacggaaccccc

SEQ ID NO: 311382 - DNA, 703 bp, Homo sapiens
  misc_feature: GZ8MTXP01C5HFJ.25.36.D03.1.454.CMB.2.raw
  modified_base (301)..(301): a, c, t, g, unknown or other
  misc_feature (301)..(301): n is a, c, g, or t
tcagactgtacagtcacgaccggtgctcgatttagctgcgtcacgatctctcttggggagcttcagctgtgggtagagaagacaggactcaggacaatctccagcatggccagcttccctctcctcctcaccctcctcactcactgtgcagggtcctgggcccagtctgtgctgtctcagccaccctcagtgtcgtcggggcccccgggcagagggtcgacatctcttgttctggaagtcgctccaacgtcggcagtaatagtgtaagctggtaccagcaacctccaggaaccgcccccanacctcctcatgtatgggaatgatcacgccgcccccgtccgacggggtcctgaccgtattcctctcgccctccacgtcctcggccacctcacgtccctcccgtcggccctacgttcccgggtggggtaccccttaccaaacgttccgtagggaagggtaacgttacgggaacgggggtaccccggttaaattttaagtttagtttggttcgaccgtaagggtccgggttaggggaacgttaggaaaccggaaaggggtaaacggtaaacgggtttagttacgggtttacgtttaacggggtaaagtttaccgggggaaccgttaaaacgggttccccgtaacccggttcccgtttaacggggtacccaaccgggtaacccccgaaaccgggggtaaccccccc

SEQ ID NO: 311383 - DNA, 718 bp, Homo sapiens
  misc_feature: GZ8MTXP01D8I7Y.25.36.D03.1.454.CMB.2.raw
  modified_base (213)..(213): a, c, t, g, unknown or other
  misc_feature (213)..(213): n is a, c, g, or t
  modified_base (304)..(304): a, c, t, g, unknown or other
  misc_feature (304)..(304): n is a, c, g, or t
  modified_base (312)..(312): a, c, t, g, unknown or other
  misc_feature (312)..(312): n is a, c, g, or t
tcagactgtacagtcacgaccggtgctcgatttagctgcgtcacgatctctcttggggagcttcagctgtgggtagagaagacaggactcaggacaatctccagcatggccagcttccctctcctcctcaccctcctcactcactgtgcagggtcctgggcccagtctgtgctgtctcagcccaccctcagtgtccgtcgggggccccccggnaggaggtcgacatctcttgttctggaatcgctccaacgtcgacagtaatagtgtaagctggtacagcaactcccgaggaacccgcccccanactcctanatgtatgggaatgatcacgccgcccctcgacggggtcctgacccgtattcctctcgccctccgacgtctcggccacctcacgccctcccgtacggcctacgtcccggtacgggcctaccgtaatccgtagaacggtagtacggacggggtaccgttaattttaacgtttagttggtacgcgtaacgggtcgggttaggggaagttagggaaaccggtaaagggggtaaaacggttaaaaccggggtttagtttaccggggtttacggtttaaaccgggggtaaaacgggtttaccgggggaaacccgttaaacgggggttaaccccgtaaccccgggtttaacccggttaaaccggggttccggaaacccgggtaaccccccggaaaaccggggtaaacccccccc

SEQ ID NO: 311384 - DNA, 585 bp, Homo sapiens
  misc_feature: GZ8MTXP01DPJ8C.25.36.D03.1.454.CMB.2.raw
  modified_base (217)..(217): a, c, t, g, unknown or other
  misc_feature (217)..(217): n is a, c, g, or t
  modified_base (345)..(345): a, c, t, g, unknown or other
  misc_feature (345)..(345): n is a, c, g, or t
  modified_base (355)..(355): a, c, t, g, unknown or other
  misc_feature (355)..(355): n is a, c, g, or t
  modified_base (363)..(363): a, c, t, g, unknown or other
  misc_feature (363)..(363): n is a, c, g, or t
  modified_base (404)..(404): a, c, t, g, unknown or other
  misc_feature (404)..(404): n is a, c, g, or t
  modified_base (415)..(415): a, c, t, g, unknown or other
  misc_feature (415)..(415): n is a, c, g, or t
  modified_base (423)..(423): a, c, t, g, unknown or other
  misc_feature (423)..(423): n is a, c, g, or t
tcagactgtacagtcacgaccggtgctcgatttagctgcgtcacgatctctcttggggacccaaaaaccacacccctccttgggagaatcccctagatcacagctcctcaccatggactggacctggagcatccttttcttggtggcagcagcaacaggtgcccactcccaggttcaactggtgcagtctggacctgaggtgaagagccgtgggctnagtgaaggtctcctgcaggcttctggttacacctttagcagctagtggcatcagcgtgggtcgcgacgacggcccctaggacgaaggggtcttggagtggatgggactagtggatcacgtccttaacntcggtatcanagactaancgcacgaagggtactccgaggggcagacgtcactagaccanacgacactacnccaacganaccaacacgacctaacggacgtcggaacccgaggaacggacgccgtaggaacgacgtcgacgaaccgaccgaaccggtccgttaattaacgttcgtaggtacggacggttagttacgttaacgtattaagtcgtacgttaccgttccggttcgttaaccccg

SEQ ID NO: 311385 - DNA, 587 bp, Homo sapiens
  misc_feature: GZ8MTXP01AXEAL.25.36.D03.1.454.CMB.2.raw
  modified_base (187)..(187): a, c, t, g, unknown or other
  misc_feature (187)..(187): n is a, c, g, or t
  modified_base (207)..(207): a, c, t, g, unknown or other
  misc_feature (207)..(207): n is a, c, g, or t
  modified_base (222)..(222): a, c, t, g, unknown or other
  misc_feature (222)..(222): n is a, c, g, or t
  modified_base (233)..(233): a, c, t, g, unknown or other
  misc_feature (233)..(233): n is a, c, g, or t
  modified_base (571)..(571): a, c, t, g, unknown or other
  misc_feature (571)..(571): n is a, c, g, or t
tcagactgtacagtcacgaccggtgctcgatttagctgcgtcacgatctctcttggggagcttcagctgtggtagagaagacaggattcaggacaatctccagcatggccggcctccctctcctcctcaccctcctcactcactgtgcagggtcctgggcccagtctgtgctgactcagccaccctnagtgtctcgggacccccggnagaggtctccatctnttgtctgggancagctccgagtcggaaatagttgtctactggtaccagcagctcccaagaacccggccccaagctcctcatctagtaggatgactcgagccgccctgacggactacgtgaccgtattctcgtggctacgtaagtcctcggcctccgtcccggccctcccgtggccctagtcgaggtcgggccctccgggtccgaggtactcggagtctaggggtaaattacgttacgtggtcgtcgtaggtttagggatcgtacccgtggttccgtgggtaacggttcggttcggtacggttggttcgggacggggttacggccaggtcgtcgtcccgtcgtacgggcnccggttcccgtaacgg

SEQ ID NO: 311386 - DNA, 544 bp, Homo sapiens
  misc_feature: GZ8MTXP01BJD27.25.36.D03.1.454.CMB.2.raw
  modified_base (227)..(227): a, c, t, g, unknown or other
  misc_feature (227)..(227): n is a, c, g, or t
  modified_base (242)..(242): a, c, t, g, unknown or other
  misc_feature (242)..(242): n is a, c, g, or t
tcagactgtacagtcacgaccggtgctcgatttagctgcgtcacgatctctcttgggggggtctcaggaggcagcgctctcgggacgtctccaccatggcctgggctctgctgttcctcaccctcctcactcagggcacagggtcctgggcccagtctgccctgactcagcctgcctccgtgtctgggactcctggacagtcggtcaccatctctgcactggaaccngccgtgacattggtncttataactatgtctctggtcccaacaacacccaggcaacggcccccaaactcatcatttatgatgtcagtcatccggcctcgtggagtttcctggtcgtcttctctggctcaagtctggcaacgtcgcctcctgacatcgtcgggctcgaggctgaggacgagctacgttattattgtctatttcatacagagacaacctaacgtagtcgtggtcgttcgggcgggtagggaccgtaaagttcgaccggttccgttcggtaaccgacgtcccgaaggcccgttcgtcccccgttgggtccc

SEQ ID NO: 311387 - DNA, 530 bp, Homo sapiens
  misc_feature: GZ8MTXP01A1UKE.25.36.D03.1.454.CMB.2.raw
  modified_base (228)..(228): a, c, t, g, unknown or other
  misc_feature (228)..(228): n is a, c, g, or t
  modified_base (243)..(243): a, c, t, g, unknown or other
  misc_feature (243)..(243): n is a, c, g, or t
  modified_base (260)..(260): a, c, t, g, unknown or other
  misc_feature (260)..(260): n is a, c, g, or t
  modified_base (304)..(304): a, c, t, g, unknown or other
  misc_feature (304)..(304): n is a, c, g, or t
  modified_base (445)..(445): a, c, t, g, unknown or other
  misc_feature (445)..(445): n is a, c, g, or t
tcagactgtacagtcacgaccggtgctcgatttagctgcgtcacgatctctcttgggggggtctcaggaggcagcgctctcgggacgtctccaccatggcctgggctctgctgttcctcaccctcctcactcagggcacagggtcctgggcccagtctgccctgactcagcctgcctccgtgtctgggactcctggacagtcggtcaccatctcctgcactggaaccngccgtgacattggtncttataactatgtctcnggtcccaacaacacccaggcaaggcccccaaactcatcatttangatgtcagtcatcggcctctggtatttcctggtcgcttctctggctccaagtctggcaactcggcctccctgacccatcgtcggggctccgaggctgaggacgagctacttatatgctatttcatacagacgacacctaanagtctggtgttcggacgggagggacctaaaggtcgaccgttccgttcggaacacgcccgtaaggccttgtcccccgttcggtccc

SEQ ID NO: 311388 - DNA, 694 bp, Homo sapiens
  misc_feature: GZ8MTXP01BEDV4.25.36.D03.1.454.CMB.2.raw
  modified_base (319)..(319): a, c, t, g, unknown or other
  misc_feature (319)..(319): n is a, c, g, or t
  modified_base (366)..(366): a, c, t, g, unknown or other
  misc_feature (366)..(366): n is a, c, g, or t
tcagactgtacagtcacgaccggtgctcgatttagctgcgtcacgatctctcttggggagctctgagagcggagccccagccccagaattcccaggtgttttcatttggtgatcagcactgaacacagaggactcaccatggagtttgggctgagcttgggttttccttgttgttatttagaaggtgtccagtgtgaggtgcagttggaggagtcgtgggggagcgttgggtccgaggccggggggtcctgagactctcctgtgcagcctcgtggtatcgtagtttagctagtagttttggatgagcgtcggggtcccnccgacggccccgagggggaggggcgtgggtggtagggtacaccaaanacgtaacaccggaagagtgggaaggtagaaaagaaatcgtaagtcgggacgggtactcgtagggtacggaaacggggcccgtaagttaccaaccctaagtcccgttacccgaaacggggtaaaccctaaacctaacccaaaactaacctacctaaagttaactacttacgttaggaaacctaaagtagaaaccgttggtccgtaaggacgtacgggacgaacgggacgaacggtcttggttacgttacgtttcggtgttggccggaaggtaacggttacccggaacccccggtaagttcccttaaacgtaaccggttaaccccttaag

SEQ ID NO: 311389 - DNA, 790 bp, Homo sapiens
  misc_feature: GZ8MTXP01BZ9U5.25.36.D03.1.454.CMB.2.raw
  modified_base (215)..(215): a, c, t, g, unknown or other
  misc_feature (215)..(215): n is a, c, g, or t
  modified_base (258)..(258): a, c, t, g, unknown or other
  misc_feature (258)..(258): n is a, c, g, or t
tcagactgtacagtcacgaccggtgctcgatttagctgcgtcacgatctctcttggggagcttcagctgtggtagagaagacaggattcaggacaatctccagcatggccggcctccctctcctcctcaccctcctcactcactgtgcagggtcctgggcccagtctgtgctgactcacgcccaccctcagtcgtccgtcggggaccccccgggngaggtacggtcctcctattccttcgtttcgttcggtggggacncgacggtcccgtaccggacggttaaacggtaaagtttacggtttcgtactacgtacggtaaccacgaccacgccctaacccgaaacgaaccccggaccccaagtccctacctactatactaagtaaggaatcgactcgacggccgacctacggaaccggtactacgtacgtacccgtattcgtaccgtcggtacgtaacggtacggttccgtccggtccccttccccgtccccgtccccttacccgtccggaccctacgtccggtacgggtccgggtacccgtaccggggtacggaaggtacgtagggtacgttacgttaacgggttaaacgttttaagttacgttcggttacggtacgtttagggtttacggacgttccggtacgttacggtcggttagggtaacgggttcggggttacccgggttacggggttcgggttaccggggaacgggttaaccgggttacgttaacgggtccgttacccggtaacccggttacggaccgggttaccgaacccgttcccggtaacg

SEQ ID NO: 311390 - DNA, 629 bp, Homo sapiens
  misc_feature: GZ8MTXP01EYV51.25.36.D03.1.454.CMB.2.raw
  modified_base (211)..(211): a, c, t, g, unknown or other
  misc_feature (211)..(211): n is a, c, g, or t
  modified_base (242)..(242): a, c, t, g, unknown or other
  misc_feature (242)..(242): n is a, c, g, or t
  modified_base (374)..(374): a, c, t, g, unknown or other
  misc_feature (374)..(374): n is a, c, g, or t
  modified_base (387)..(387): a, c, t, g, unknown or other
  misc_feature (387)..(387): n is a, c, g, or t
tcagactgtacagtcacgaccggtgctcgatttagctgcgtcacgatctctcttggggagcttcagctgtggtagagaagacaggattcaggacaatctccagcatggtcggcctccctctcctcctcaccctcctcactcactgtgcagggtcctgggcccagtctgtgctgactcagcccaccctcagtgtccgtcggggacccccggnagacgggtctccatcttcttgttcgtgggancagcctccgacgtacggaaattagtttgtctacgtggtacccagcacgcctaccccgaacggaaaccccggcccccaaagccctcctcaatctaataggaatgactcgacgccgccctagacgggactacgngacccgtattccncgtggctacgacgtcgtggtcctcccgtccggccctaccgtcggcagtcgaggtcgggccttccgggcgaaggctggaggctaagggaaatttacgttacgtggtgtacgtagggtttgggattcgcctaggtcgtaggtggttcgggttaccggtcgggttggtaccgggacggggaacgggacccaggtcccgtacggtaaccccgttccggaggttccaacccgggttcccgaaccggg

SEQ ID NO: 311391 - DNA, 637 bp, Homo sapiens
  misc_feature: GZ8MTXP01CFDZS.25.36.D03.1.454.CMB.2.raw
  modified_base (228)..(228): a, c, t, g, unknown or other
  misc_feature (228)..(228): n is a, c, g, or t
  modified_base (245)..(245): a, c, t, g, unknown or other
  misc_feature (245)..(245): n is a, c, g, or t
  modified_base (266)..(266): a, c, t, g, unknown or other
  misc_feature (266)..(266): n is a, c, g, or t
  modified_base (310)..(310): a, c, t, g, unknown or other
  misc_feature (310)..(310): n is a, c, g, or t
  modified_base (331)..(331): a, c, t, g, unknown or other
  misc_feature (331)..(331): n is a, c, g, or t
tcagactgtacagtcacgaccggtgctcgatttagctgcgtcacgatctctcttggggggggtctcaggaggcagcgctctcgggacgtctccaccatggcctgggctctgctgttcctcaccctcctcactcagggcacagggtcctgggcccagtctgccctgactcagcctgcctccgtgtctgggactcctggacagtcggtcacatctcctgcactggaaccngccgtgactattgggtntacttataactatcgtctccncggtcccaacaacacccaggcaaacggccccaatcatcatttangatgtcagtcactcggccctntggtatttccgtcggtcgtcttctctcgggctccaaagtctgggccaacgtccgccctccctcgacctagtcgtcggggcctcgaggtctggagacgaggtacttacttaagttattcggacttatttccaattaacgagaacgtaaacccaccgtaaacgtacgttcgttgggtcgtttacggggaccgggtaacggggaacccttaaaggttccggttaaccccggttccgttacccgggttccgaacccggtccccgtaacgggtccccgttaccggtcccccccgttcgggtttaacccccg

SEQ ID NO: 311392 - DNA, 500 bp, Homo sapiens
  misc_feature: GZ8MTXP01EAFEP.25.36.D03.1.454.CMB.2.raw
  modified_base (374)..(374): a, c, t, g, unknown or other
  misc_feature (374)..(374): n is a, c, g, or t
  modified_base (380)..(380): a, c, t, g, unknown or other
  misc_feature (380)..(380): n is a, c, g, or t
  modified_base (400)..(400): a, c, t, g, unknown or other
  misc_feature (400)..(400): n is a, c, g, or t
  modified_base (433)..(433): a, c, t, g, unknown or other
  misc_feature (433)..(433): n is a, c, g, or t
tcagactgtacagtcacgaccggtgctcgatttagctgcgtcacgatctctcttgggggggtctcaggaggcagcactctcgggacgtctccaccatggcctgggctctgctcctcctcagcctcctcactcagggcacaggatcccgggctcagtctgccctgactcagcctcgctcagtgtccgggtctcctggacagtcagtcaccatctcctgcactggaaccagaagtgatcttggtgcttatgacactgtctcctggcaccagttttaccccaggaaaacgcccccagagtcatccttatgatgtcaggagcggcctcaggggtccctgatcgcttctctgggtccaaatctggcaacacggcctccngaccanctctgggctccgagctgagntgaggctgtattattattgctgttcattagtgnacgctaactgttagtttggttgtcggcgcgcggttacgtaagtcgtccgtcgtcggcgcgccgaagg

SEQ ID NO: 311393 - DNA, 594 bp, Homo sapiens
  misc_feature: GZ8MTXP01B4COP.25.36.D03.1.454.CMB.2.raw
  modified_base (187)..(187): a, c, t, g, unknown or other
  misc_feature (187)..(187): n is a, c, g, or t
  modified_base (207)..(207): a, c, t, g, unknown or other
  misc_feature (207)..(207): n is a, c, g, or t
  modified_base (232)..(232): a, c, t, g, unknown or other
  misc_feature (232)..(232): n is a, c, g, or t
  modified_base (441)..(441): a, c, t, g, unknown or other
  misc_feature (441)..(441): n is a, c, g, or t
tcagactgtacagtcacgaccggtgctcgatttagctgcgtcacgatctctcttggggagcttcagctgtggtagagaagacaggattcaggacaatctccagcatggccggcctccctctcctcctcaccctcctcactcactgtgcagggtcctgggcccagtctgtgctgactcagccaccctnagtgtctcgggacccccggnagaggtctcatctcttgtctgggancagctccgacgtacggaaattaagtttgctactggtaccagcagcctcccgaagaaacccggcccccaagcctcctcatctatagaatgatcagccggccctacgacgggactacgtgaccgtattcctctgggctacggaaacgttccgtgggcctccccgtccggccctcccgtcggcccatcgaggtcggccgtccggtccgaggntcggagtcgtaggtaaattattacgtgttgcgtaggtttgggatcgtccgtgtctggtaacggtggttccggacggttcggttcgggcgggttaacgggcccgaaagtccgtacggaacccgtccgttacggccgtaaccgcccgtaaacggg

SEQ ID NO: 311394 - DNA, 793 bp, Homo sapiens
  misc_feature: GZ8MTXP01DTJFV.25.36.D03.1.454.CMB.2.raw
  modified_base (243)..(243): a, c, t, g, unknown or other
  misc_feature (243)..(243): n is a, c, g, or t
tcagactgtacagtcacgaccggtgctcgatttagctgcgtcacgatctctcttggggggggtctcaggaggcagcgctctcgggacgtctccaccatggcctgggctctgctgttcctcaccctcctcactcagggcacagggtcctgggcccagtctgccctgactcagcctgcctccgtgtctgggactcctggacagtcgtcacatctctgcactggaaccagccgtgactagttggtnacttaataactatgtctcctggtacccaacaacacccaggaccaacggaccccaaatcatctatttatgatgtcagtcacgtccggccttcgtggtacgttttcccgtcgggttctctttccgtcgtacgggtccttcccgtaaagttccgttacgggaccctaaaccgttccggggtaccccttcccgttacggaaccctacggttccggtccggggtccttacccgaacgggtcgttacgggaacgggaaccgggtaacgggttaccgtttaaaccgttttaatttaacggttttacgggtaccgtttaaacgtttttaccgaaacgtttaaacctaacgggtaaaccgaaaccccgtaaaccctaaaaccgttaacgggttacccgttgggggtttaacgggtttacccgggggaacgggggtaaccggggttaaaccgttaaaacgggtttcccggttaacccgggttcccgttaccgggtaacgtaacccggaaccccgtaaacggggccccttacccgggtccccccgttaacggggttccccg

SEQ ID NO: 311395 - DNA, 731 bp, Homo sapiens
  misc_feature: GZ8MTXP01DA7OJ.25.36.D03.1.454.CMB.2.raw
  modified_base (188)..(188): a, c, t, g, unknown or other
  misc_feature (188)..(188): n is a, c, g, or t
  modified_base (210)..(210): a, c, t, g, unknown or other
  misc_feature (210)..(210): n is a, c, g, or t
  modified_base (236)..(236): a, c, t, g, unknown or other
  misc_feature (236)..(236): n is a, c, g, or t
tcagactgtacagtcacgaccggtgctcgatttagctgcgtcacgatctctcttggggagcttcagctgtggtagagaagacaggattcaggacaatctccagcatggccggcctccctctcctcctcaccctcctcactcactgtgcagggtcctgggcccagtctgtgctgactcagcccaccctnagtgtccgtcgggacccccggnagaggtctccatctcttgtctgggancagcctccgagtcgaaatagttgtctactggtaccagcaacctccccaaggaaccgcccccacacctcctcatgtatgggaatgatcacgccgcccctcgaccggggtcccccctacggaccgtatttcctcgtccgccctcccgaccgtccgtcggcccaccctcacgcccctcccgtcggccctacgtcccggtcgggccctaccgtaagtccgtaggaggtacgttcgggaacgggtacccggttaattttaacgtttagtttcggtggtacgtacgggtcgggtaggggtaacgtaggaaccggtaaaggggtaaaggttaaaccggggttttaagtcgggtttaccggtttaacgggggttaaacgttttaaccgggggaacccgttaaaacgggggttccccgttaaacccgggtttaacccgttaaacgggtcccgtaacccgggacccccgttaaaccgggaacccccttaaaccccccgttaaccg

SEQ ID NO: 311396 - DNA, 518 bp, Homo sapiens
  misc_feature: GZ8MTXP01E065S.25.36.D03.1.454.CMB.2.raw
  modified_base (187)..(187): a, c, t, g, unknown or other
  misc_feature (187)..(187): n is a, c, g, or t
  modified_base (208)..(208): a, c, t, g, unknown or other
  misc_feature (208)..(208): n is a, c, g, or t
  modified_base (235)..(235): a, c, t, g, unknown or other
  misc_feature (235)..(235): n is a, c, g, or t
tcagactgtacagtcacgaccggtgctcgatttagctgcgtcacgatctctcttggggagcttcagctgtggtagagaagacaggattcaggacaatctccagcatggccggcctccctctcctcctcaccctcctcactcactgtgcagggtcctgggcccagtctgtgctgactcagccaccctnagtgtctgggaccccccgggnagagggtctccatctcttgtctgggancagctccgacgtcggaaataagtttgtctactggtaccagcagctcccagaacggcccccaagctcctcatctataggaatgatcagcggccctcacgggatacctgacccgattctctggctcgaagtctggctcctcggccctccctggccatcagtgggctccggtccgaggatgagctgggaatattactgtgctagtttgggatgccagtctgaagtggttccgacgggttgttcgggcgagggccaggctgcccgtcaggttcaacgcccgaacggg

SEQ ID NO: 311397 - DNA, 752 bp, Homo sapiens
  misc_feature: GZ8MTXP01AIM6C.25.36.D03.1.454.CMB.2.raw
tcagactgtacagtcacgaccggtgctcgatttagctgcgtcacgatctctcttggggagcttcagctgtggtagagaagacagaattcaggacaatctccagcatggccggcctccctctcctcctcaccctcctcactcactgcacagggtcctgggcccagtctgtactgacgcacgcccgccctcgagtcgtccgtcgggggccccagggcgagacgggtcaccatctcctgcacgtggggactagttccaagtagtcggggcaccttataatgttcactggtatcaaacacttcaggacacgaccccaaatcgtcattcatgctagataaacaactccgtaccctctacggtctcccgtagacccgtaactttcccgtcccggtcctacccgtaaacgttccgtcgggcccaacccgttccgaccgtcccgttcccctgggtacctaacgttcccgtacggttcgggaccttacccgaaggtacccgttagggaagggtaacgtagggggtaaacggttcggtaaactttaccgtaacgtcgtacccgtacgttacccgtaagtccgtaaaccgaaaccgcggtcccggttcgggttccggggtttcggggtttttaccggggtcccggggttttacccggggggcccgggggttaccgggggttaaccccgttaaagggggtcccgttaacccggtttacccgggttacccgttaaacgggttcccgaaccgggtaacccccgggg

SEQ ID NO: 311398 - DNA, 572 bp, Homo sapiens
  misc_feature: GZ8MTXP01D1DGU.25.36.D03.1.454.CMB.2.raw
  modified_base (211)..(211): a, c, t, g, unknown or other
  misc_feature (211)..(211): n is a, c, g, or t
  modified_base (227)..(227): a, c, t, g, unknown or other
  misc_feature (227)..(227): n is a, c, g, or t
  modified_base (301)..(301): a, c, t, g, unknown or other
  misc_feature (301)..(301): n is a, c, g, or t
tcagactgtacagtcacgaccggtgctcgatttagctgcgtcacgatctctcttggggagcttcagctgtgggtagagaagacaggactcaggacaatctccagcatggccagcttccctctcctcctcaccctcctcactcactgtgcagggtcctgggcccagtctgtgctgtctcagcccaccctcagtgtcgtcggggccccccggnaggaggtcgacatctnttgttctggaagtcgctccaacggtcggctagtaatagtgtaagctggtaccagcaactccagaaccgccccanactctcatgtatgggaatgatcagccgcccctcgacggggtcctgacccgtattccgctcgacccttcccgacgttcctgggacctaccctcacgtccctcccgtggcccagttcccggtagggcctaccaatccgtagaggaatggacggggtccgtaagttttattagttcgtagcgagcggtggtgtagacgaggaagtaacggttagtgttgttacgtagttaggttacgacgtaacgacgtcgtacgtcgacgccgaacgaacccg

SEQ ID NO: 311399 - DNA, 641 bp, Homo sapiens
  misc_feature: GZ8MTXP01A7Z3J.25.36.D03.1.454.CMB.2.raw
  modified_base (189)..(189): a, c, t, g, unknown or other
  misc_feature (189)..(189): n is a, c, g, or t
  modified_base (212)..(212): a, c, t, g, unknown or other
  misc_feature (212)..(212): n is a, c, g, or t
  modified_base (242)..(242): a, c, t, g, unknown or other
  misc_feature (242)..(242): n is a, c, g, or t
  modified_base (365)..(365): a, c, t, g, unknown or other
  misc_feature (365)..(365): n is a, c, g, or t
  modified_base (372)..(372): a, c, t, g, unknown or other
  misc_feature (372)..(372): n is a, c, g, or t
  modified_base (488)..(488): a, c, t, g, unknown or other
  misc_feature (488)..(488): n is a, c, g, or t
tcagactgtacagtcacgaccggtgctcgatttagctgcgtcacgatctctcttggggagcttcagctgtggtagagaagacaggattcaggacaatctccagcatggccggcctccctctcctcctcaccctcctcactcactgtgcagggtcctgggcccagtctgtgctgactcacgcccaccctnagtcgtccgtcgggaccccgggnaggacggtctccattctcttgtcgtgggancagccgtccgacgtacggaaattagttgtctacgtcggtaccagcacgcctacccgaagaacccggcccccaagcctccacactactagtaggaatgactcgacgcgcctagacggactacgngaccgtnttctcgtgctagacgtcgtcgcctcctcggccctcccgcggcctagtccgtagggtccgggtacccgttcgggaccgggagtcgtgggacggtactaaggtaagttactttacggngttacggtcgtagggtttaggacgttcgaaccgttggtcggtggtaacggtccgggttacggggtacggttcgggttaccgggacggttaaccggggaccaacggtccgtacggtaaccccgtcggtcgaaccgtccggaacccgtaaccggg

SEQ ID NO: 311400 - DNA, 644 bp, Homo sapiens
  misc_feature: GZ8MTXP01EXHA5.25.36.D03.1.454.CMB.2.raw
  modified_base (210)..(210): a, c, t, g, unknown or other
  misc_feature (210)..(210): n is a, c, g, or t
  modified_base (228)..(228): a, c, t, g, unknown or other
  misc_feature (228)..(228): n is a, c, g, or t
  modified_base (245)..(245): a, c, t, g, unknown or other
  misc_feature (245)..(245): n is a, c, g, or t
tcagactgtacagtcacgaccggtgctcgatttagctgcgtcacgatctctcttggggggggtctcaggaggcagcgctctcgggacgtctccaccatggcctgggctctgctgttcctcaccctcctcactcagggcacagggtcctgggcccagtctgccctgactcagcctgcctccgtgtctgggactcctggacagtcgtcaccntctcctgcactggaaccngccgtgactattgggtntacttataactatgtctcctgtacccaacaacaccaggcaacggccccaaactcatcatttatgatgtcagtcacgtccgccctcgtggtacgtttccgtggttcgtctttctccgtcgggtcctccgtaagtccgtcgggacctaaccgttcccgggtccccttcccgtacggtacctaacgttccggtccggggccttccgaacggcgttagggacggacgtacggtacttaacgtttattagttcgtacttactttacaactacgagaacgaccaacctaacgtacgtccgtgggtcgttcgggacgggtaacggttaccgtaaggttcggacccgttcgttaccggttaacgaccgaacccgtaacggtcccgttccgtccccgttcgggtcccg

SEQ ID NO: 311401 - DNA, 651 bp, Homo sapiens
  misc_feature: GZ8MTXP01CCSVS.25.36.D03.1.454.CMB.2.raw
  modified_base (187)..(187): a, c, t, g, unknown or other
  misc_feature (187)..(187): n is a, c, g, or t
  modified_base (241)..(241): a, c, t, g, unknown or other
  misc_feature (241)..(241): n is a, c, g, or t
  modified_base (497)..(497): a, c, t, g, unknown or other
  misc_feature (497)..(497): n is a, c, g, or t
tcagactgtacagtcacgaccggtgctcgatttagctgcgtcacgatctctcttggggagcttcagctgtggtagagaagacaggattcaggacaatctccagcatggccggcctccctctcctcctcaccctcctcactcactgtgcagggtcctgggcccagtctgtgctgactcagcccacctnagtgtcgtcgggaccccggaggagggtcctccatccttcttgttcgtggggacncgacgccgtaccggacggtacggtaaattagtttgtactacgtgtactcgagcacgcctacccgaacggaaaccccgccccaagtcctcctactaacttacgtaagtaaggtaatcgactacgacggcccggtaccgtacgaacgggtactaccgtacgacccgttaacttccgtcgtcggtacgtacgtacgtcgtcggtcctcccgtccgccctccgcgccagtcgacggtcgggccgtccggacgagtagtgngtacgtagtaacgttagtacgtgtgtacgttaggttggactcgtccgtagtggtcgggtcgggttcgggtccgggttcggggtcgggtacggggaccgggacggaccgtaacggcgtaaccggtacccgtcggttacggtaacgccggtaaccg

SEQ ID NO: 311402 - DNA, 560 bp, Homo sapiens
  misc_feature: GZ8MTXP01CJPYA.25.36.D03.1.454.CMB.2.raw
  modified_base (284)..(284): a, c, t, g, unknown or other
  misc_feature (284)..(284): n is a, c, g, or t
  modified_base (302)..(302): a, c, t, g, unknown or other
  misc_feature (302)..(302): n is a, c, g, or t
  modified_base (308)..(308): a, c, t, g, unknown or other
  misc_feature (308)..(308): n is a, c, g, or t
  modified_base (319)..(319): a, c, t, g, unknown or other
  misc_feature (319)..(319): n is a, c, g, or t
  modified_base (365)..(365): a, c, t, g, unknown or other
  misc_feature (365)..(365): n is a, c, g, or t
tcagactgtacagtcacgaccggtgctcgatttagctgcgtcacgatctctcttggggtgtgggctcagaagcagagttctggggtgtctccaccatggcctggacccctctctggctcactctcctcactctttgcataggttctgtggtttcttctgaactgactcaggaccccgctgtgtctgtggccttgggacagacagtcaggatcacatgccaaggagacagcctcagaacttattatgcatccctggtacccagcagaagccgggacaggcccctntacttgtcttctacggtnaaaacnccccgcccctnagggatctcagaccgattccctctcggctcccgcctcagggaaccncacgcttccttgaccatccactggggctcgagcgcaagatgaggctgacttattacctggtttcccgtcccggggacaccgagtggtaagcgacggttgtggtcttcggcgggaagggaccgaagggtgacccggtaccgtggttcgcgcccgtaagggcttcgccccccgtcgttccgtaaccgttcgttcccg

SEQ ID NO: 311403 - DNA, 650 bp, Homo sapiens
  misc_feature: GZ8MTXP01B4IOZ.25.36.D03.1.454.CMB.2.raw
  modified_base (293)..(293): a, c, t, g, unknown or other
  misc_feature (293)..(293): n is a, c, g, or t
tcagactgtacagtcacgaccggtgctcgatttagctgcgtcacgatctctcttggggggggtctcaggaggcagcactctcgggacgtctccaccatggcctgggctctgctcctcctcagcctcctcactcagggcacaggatcccgggctcagtctgccctgactcagcctcgctcagtcgtccggtctccgtggacagtcagtccacatctcctgcactggaaccagaagtgattcgttggtgtcttatgacactgtctcctggcacctacgtttacccaaggaaaccnccccagacgtcattcctttatgatgtacgaggaacgccggccctcgaccgggtccctgactcgcttctcgtcgggtacctaaagtcgtacggaccaaccgtccgggacccctcccgtacgtaccctacgttccgtccgtcggggtccctacccgaagggtccgtggaacggagttgggaacggtcgttaggttaatttagttagttggtcttgttacgtattagtcgtacgtacggacttaaacgttaacgtttggttttacgggttggtttaccgggcgttaccggttacgggttaccgtaacggttcggtaaccccgttcggtacgggttaccgaaccggttcccgtaacccggg

SEQ ID NO: 311404 - DNA, 593 bp, Homo sapiens
  misc_feature: GZ8MTXP01ERN26.25.36.D03.1.454.CMB.2.raw
  modified_base (218)..(218): a, c, t, g, unknown or other
  misc_feature (218)..(218): n is a, c, g, or t
  modified_base (272)..(272): a, c, t, g, unknown or other
  misc_feature (272)..(272): n is a, c, g, or t
  modified_base (349)..(349): a, c, t, g, unknown or other
  misc_feature (349)..(349): n is a, c, g, or t
tcagactgtacagtcacgaccggtgctcgatttagctgcgtcacgatctctcttggggacccaaaaaccacacccctccttgggagaatcccctagatcacagctcctcaccatggactggacctggagcattccttttcttggtggcagcagcaacaggtgcccactcccaggttcaactggtgcagtctggacctgaggtgaagagcctgggcctnagtgaagtctctgcagcttctggttacacttagcagctatggcatcagctgggncgacgacggccctggacagggtctggagtgatggcagtggatcacgtaccttaacgatcggtatacacgagactaancgaacaagaagggtaacttaccggagggtacaagtacgtacctacgttacggaacccacgaacgaacaacctacgacccgaacggacgaccaaacgacgaccccttaaggacggttacgggaacctagggaacggacgccgtagacgtactcgacggaacgacgaacgggtaccttagtacttacgtgtacggacgttagagtcgtattaacgtcgtccgttaccgtccggttaacgtaacccg

SEQ ID NO: 311405 - DNA, 781 bp, Homo sapiens
  misc_feature: GZ8MTXP01CGNWM.25.36.D03.1.454.CMB.2.raw
  modified_base (223)..(223): a, c, t, g, unknown or other
  misc_feature (223)..(223): n is a, c, g, or t
tcagactgtacagtcacgaccggtgctcgatttagctgcgtcacgatctctcttggggggggtctcaggaggcagcactctcgggacgtctccaccatggcctgggctctgctcctcctcagcctcctcactcagggcacaggatcccgggctcagtctgccctgactcagcctcgctcagtcggtccggtctccgtgacagtcagtccacctactccttccncgcacgtacggaaaccaaggtaagtgtacgttcgttggtcgtacttagtacgaacctacgttcgtcccttccgtcggtacctaaccgtttaaccggtttaaacccgaaacggtaaaacccgcccccgaaggtacgtactaactttacctttagtagtacgttcggtacggaaacgggaaccgggtccggtaccccgtacggggtaacccccgggggttccctaggtaccgtccgttcccgtttccgttcgggttccggggtaaaccctaaagttccggtaccggaaccgtaacccggtacccgggtccccttacccgtaccgtaacctcgttccgtccggtcggtaccgtaccggacgtcgtagggagtagtaggacgttgttagttaatttattacgttcgttacgttgttactagttacgacgtacgtaacggtaccttaaaccgtttacgtttagggttttcgggttcggttaccgggacgttaccgggaaccgggttacgttaacggtccggtaaccgttcgggtcgttaccgaaccgttaacccgtaaccggg

SEQ ID NO: 311406 - DNA, 595 bp, Homo sapiens
  misc_feature: GZ8MTXP01DWAJG.25.36.D03.1.454.CMB.2.raw
  modified_base (267)..(267): a, c, t, g, unknown or other
  misc_feature (267)..(267): n is a, c, g, or t
  modified_base (310)..(310): a, c, t, g, unknown or other
  misc_feature (310)..(310): n is a, c, g, or t
  modified_base (382)..(382): a, c, t, g, unknown or other
  misc_feature (382)..(382): n is a, c, g, or t
  modified_base (398)..(398): a, c, t, g, unknown or other
  misc_feature (398)..(398): n is a, c, g, or t
  modified_base (420)..(420): a, c, t, g, unknown or other
  misc_feature (420)..(420): n is a, c, g, or t
  modified_base (424)..(424): a, c, t, g, unknown or other
  misc_feature (424)..(424): n is a, c, g, or t
  modified_base (429)..(429): a, c, t, g, unknown or other
  misc_feature (429)..(429): n is a, c, g, or t
  modified_base (505)..(505): a, c, t, g, unknown or other
  misc_feature (505)..(505): n is a, c, g, or t
tcagactgtacagtcacgaccggtgctcgatttagctgcgtcacgatctctcttggggagctctgagagcggagccccagccccagaattcccaggtgttttcatttggtgatcagcactgaacacagaggactcaccatggagtttgggctgagcttgggttttctgttgttattttccaggtgtccagagtgaggtgcagttggtggagtcgtgggggagcttggtccagccgtggagggtccgtgagagtctctgtgcagcctntggattcatcttcagtcgaccatacagtggactcggggtcccncgaggctaccgagggggagggctgggaggtgggtcgacccgtattaagaaataagctaaaagattaacacanagaactaccgcgcgtngtagaaagtcagattacattanctanaaganatagattacaaaacgtactacaacgttgtactcgtagaaacctaaagtcgaaacacgacctaaaggaaaacccggngggaacccgttaacgggtcccgtttagttaaactttcgttggtggaaccgttaaggttccagttaccgttaaccgggttaacttaacccc

SEQ ID NO: 311407 - DNA, 516 bp, Homo sapiens
  misc_feature: GZ8MTXP01DI4OO.25.36.D03.1.454.CMB.2.raw
  modified_base (207)..(207): a, c, t, g, unknown or other
  misc_feature (207)..(207): n is a, c, g, or t
  modified_base (235)..(235): a, c, t, g, unknown or other
  misc_feature (235)..(235): n is a, c, g, or t
  modified_base (260)..(260): a, c, t, g, unknown or other
  misc_feature (260)..(260): n is a, c, g, or t
  modified_base (299)..(299): a, c, t, g, unknown or other
  misc_feature (299)..(299): n is a, c, g, or t
  modified_base (430)..(430): a, c, t, g, unknown or other
  misc_feature (430)..(430): n is a, c, g, or t
tcagactgtacagtcacgaccggtgctcgatttagctgcgtcacgatctctcttggggagcttcagctgtggtagagaagacaggattcaggacaatctccagcatggccggcctccctctcctcctcaccctcctcactcactgtgcagggtcctgggcccagtctgtgctgactcagccaccctcagtgtctcgggacccccggnagagggtctccatctcttgttctgggancagcctccgacgtcggaataagttntctactggtaccagcagctcccagaacgccccaagctcncatctatagatgatcagcgcctcacgggactactgacccgtattcctctggctcgaagtctcggctccgtcggccctccgtggccatccgagtcgggctccggtcgaggatcggagctagggaatattacngtgcgtgtttgggatcgctagtctgaagtggacgtcgggttgtcgggcggagggccagcgtgaaccgtcaggttcaacgccgaagg

SEQ ID NO: 311408 - DNA, 602 bp, Homo sapiens
  misc_feature: GZ8MTXP01DQYWP.25.36.D03.1.454.CMB.2.raw
  modified_base (245)..(245): a, c, t, g, unknown or other
  misc_feature (245)..(245): n is a, c, g, or t
tcagactgtacagtcacgaccggtgctcgatttagctgcgtcacgatctctcgttggggggggtctcaggaggcagcgctctcgggacgtctccaccatggcctgggctctgctgttcctcaccctcctcactcagggcacagggtcctgggcccagtctgccctgactcagcctgcctccgtgtctgggactcctggacagtcgtcaccatctcctgcactggaaccagaagtgatcgttggtntcttatgacactgtctcctggccacctagtttacccaaggaaaaccgccccagacgtctatcctttaatgtaatgtcaggaacgcggccctcgacggggtccctgactcgtcttctcgtcggtaaccaaatcgtaggaccaaaccgaccggtcccctcccgtacgaccctactctcggtcgggtcctaccgaggcgtaggaggtagtaggaggtctagttaatttatttagttgtcttgttactatatgacgagtactaactacttagtttggtcggttcggcgacgtaacgggtacgttaaggttcggacccgttcgtggtaaccacggacccgacggtcccgttccggtcccccg

SEQ ID NO: 311409 - DNA, 712 bp, Homo sapiens
  misc_feature: GZ8MTXP01CDJ5L.25.36.D03.1.454.CMB.2.raw
tcagactgtacagtcacgaccggtgctcgatttagctgcgtcacgatctctcttggggacccaaaaaccacacccctccttgggagaatcccctagatcacagctcctcaccatggactggacctggagcatccttttcttggtggcagcagcaacaggtgcccactcccaggttcaactggtgcagtctggacctgaggtgaagagccgtgggctcagtgaaggtctcctgacaaggtcttcgtggttacacctttagcagctatggcatcagcgtgggtcgcgacacggccccgtggacgaaggggtcttaggagtggagtggctagtggatcgaacgtaccttaaacgagttacggtactacgaacgtagtaacgtaaacgtcgaacctaacgtaaacggggtaaacttacccgggaaggggtactaacgggtaacgttacccgtaacccgttacggaaacccctaacgaacggaacccaaccgtaaccgtaccccgaaacgggaccgacctaaaccgacggtaccccttaaacggacggttacgggtaacccgtagggaacgggaccgtccgttaaggaacgtacgtaccgtacggaacccgaccgtaaccggggttaccttaaagtttacttacggtcggttacggaccgttaggttacggttaacgtattaacgtcgtaccgttacgtccggttcgttaaccccgg

SEQ ID NO: 311410 - DNA, 642 bp, Homo sapiens
  misc_feature: GZ8MTXP01ANMXL.25.36.D03.1.454.CMB.2.raw
  modified_base (208)..(208): a, c, t, g, unknown or other
  misc_feature (208)..(208): n is a, c, g, or t
  modified_base (234)..(234): a, c, t, g, unknown or other
  misc_feature (234)..(234): n is a, c, g, or t
  modified_base (439)..(439): a, c, t, g, unknown or other
  misc_feature (439)..(439): n is a, c, g, or t
tcagactgtacagtcacgaccggtgctcgatttagctgcgtcacgatctctcttggggagcttcagctgtggtagagaagacaggattcaggacaatctccagcatggccggcctccctctcctcctcaccctcctcactcactgtgcagggtcctgggcccagtctgtgctgactcagccaccctcagtgtcctcgggacccccggnagaggtctccatctcttgtctgggancagctccgacgtcggaaataagttgtctactggtacagcagctcccaagaaccggccccaagcctcctcatctataggatgatcacgcggccctacgacgggactaccgtacgacccgtattcctcgtcgggctacggaagttcgtcgggcctcccgtccggcccttcccgtggccagtcgaggtcgggccttccgggccgaggntggacgtacgtagggtaaattacgttacgttggtacgcgtagggttttcgggaattcgcccgtaaggtcctgggtaacggttcgggttcccggtaacggggttggttcccggggcgggggaacgggaacccgttaaacgggccgttacgggaaccccggtttaccggaacggggttcccaaccgggttccccggtaaaccggg

SEQ ID NO: 311411 - DNA, 810 bp, Homo sapiens
  misc_feature: GZ8MTXP01C6ROY.25.36.D03.1.454.CMB.2.raw
  modified_base (243)..(243): a, c, t, g, unknown or other
  misc_feature (243)..(243): n is a, c, g, or t
  modified_base (314)..(314): a, c, t, g, unknown or other
  misc_feature (314)..(314): n is a, c, g, or t
tcagactgtacagtcacgaccggtgctcgatttagctgcgtcacgatctctcgttggggggggtctcaggaggcagcgctctcgggacgtctccaccatggcctgggctctgctgttcctcaccctctcactcagggcacagggtcctgggcccagtctgccctgactcagcctgcctcgtgtctggactcctggacagtcggtcacatctcctgcactggaaccagccgtgactagttggtntacttataactatcgtctcctggtacccaacaaccacccaggaccaacggaccccaaatcaatctatttangatgtcagtcacgtccggcctcgtggtacgtttcccgtcggtcgtctttcgtccgttcgggtcccttccgaaacggttccgtacgggtaccctaaacccgttcccgggtccccttaccccgttacgaaccctacgtccccgggttccgggggccccttacccgggaacgggtcccgtagggtaaacggggtaacccgacgggttacctttaaaccgttttaattttaaacggggtttcgtaaccctttagttttaacccgaaatttaaacccgaaacgggtaacgtaaaacccgaaacccctaaagtaacggtttcccggttaaggggttcggtttaacccgggggacggggtaaacggggttaacccgttaaaacggggtttcccggttaaccccggtttccggttaacccgggttccggaaacccggttaacccccggaaacggggtcccctttaaccccgggtccccccgtttaaccggggttttaaaccccc

SEQ ID NO: 311412 - DNA, 541 bp, Homo sapiens
  misc_feature: GZ8MTXP01BDE7A.25.36.D03.1.454.CMB.2.raw
  modified_base (315)..(315): a, c, t, g, unknown or other
  misc_feature (315)..(315): n is a, c, g, or t
  modified_base (336)..(336): a, c, t, g, unknown or other
  misc_feature (336)..(336): n is a, c, g, or t
  modified_base (348)..(348): a, c, t, g, unknown or other
  misc_feature (348)..(348): n is a, c, g, or t
  modified_base (399)..(399): a, c, t, g, unknown or other
  misc_feature (399)..(399): n is a, c, g, or t
  modified_base (469)..(469): a, c, t, g, unknown or other
  misc_feature (469)..(469): n is a, c, g, or t
  modified_base (492)..(492): a, c, t, g, unknown or other
  misc_feature (492)..(492): n is a, c, g, or t
tcagactgtacagtcacgaccggtgctcgatttagctgcgtcacgatctctcttggggggggtctcaggaggcagcgctctcgggacgtctccaccatggcctgggctctgctgttcctcaccctcctcactcagggcacagggtcctgggcccagtctgccctgactcagcctgcctccgtgtctgggactcctggacagtcggtcaccatctcctgcactggaaccagccgtgactattggtgtacttataactatgtctcctggtacccaacaaccacccaggaccaacggacccccaaatcatctatttangatgtcagtcactcggccctntggtatttccgnggtcgtcttctctggcctcaagtctgggctaacgtcggcctccctgacctntcgtcgggacttccgaggtctgaacggacgacggtctaacgttattatcgacttatttacataccgaganacaacctagagtctggtgtcggnggaggactagtcgacgttcgttcgcagccaggccttacgcccttcggtc

SEQ ID NO: 311413 - DNA, 666 bp, Homo sapiens
  misc_feature: GZ8MTXP01AK6VL.25.36.D03.1.454.CMB.2.raw
  modified_base (178)..(178): a, c, t, g, unknown or other
  misc_feature (178)..(178): n is a, c, g, or t
  modified_base (226)..(226): a, c, t, g, unknown or other
  misc_feature (226)..(226): n is a, c, g, or t
  modified_base (287)..(287): a, c, t, g, unknown or other
  misc_feature (287)..(287): n is a, c, g, or t
  modified_base (312)..(312): a, c, t, g, unknown or other
  misc_feature (312)..(312): n is a, c, g, or t
  modified_base (346)..(346): a, c, t, g, unknown or other
  misc_feature (346)..(346): n is a, c, g, or t
tcagactgtacagtcacgaccggtgctcgatttagctgcgtcacgatctctcttggggtgtgggctcagaagcagagttctggggtgtctccaccatggcctggacccctctctggctcactctcctcactctttgcataggttctgtggtttcttctgaactgactcaggaccccgntgtgtctgtggccttgggacagacagtcaggatcacatgaccaagganacagcctacaagtaactttatatcgcatcctggaccagcagaacgccggacacggcccctntacttgtctcgtacggtacaaaccnccccgccctgaggctctacacgaccgtacttccnctcggcctcccgcctacgaacggaaccacgacgtcctttacccgtagaaccctagttacccgacggttcggggccttacggaacgggtccgaacgaaacggtgttacgggacggtacttacgaacttacgttaccgttcgggttaccccgtacccggggactaccggtaggttacggtaacgtcggtacgggttgtcgggttcgttacggggacgggtaacgggaaccgttacggggtcgacccggtacgtacggttaccgacggttacccgaagggtccgtccgacccccgttcgggcctaaccgttccgttaaccccg

SEQ ID NO: 311414 - DNA, 610 bp, Homo sapiens
  misc_feature: GZ8MTXP01AV6WH.25.36.D03.1.454.CMB.2.raw
  modified_base (235)..(235): a, c, t, g, unknown or other
  misc_feature (235)..(235): n is a, c, g, or t
  modified_base (273)..(273): a, c, t, g, unknown or other
  misc_feature (273)..(273): n is a, c, g, or t
  modified_base (311)..(311): a, c, t, g, unknown or other
  misc_feature (311)..(311): n is a, c, g, or t
  modified_base (429)..(429): a, c, t, g, unknown or other
  misc_feature (429)..(429): n is a, c, g, or t
  modified_base (477)..(477): a, c, t, g, unknown or other
  misc_feature (477)..(477): n is a, c, g, or t
tcagactgtacagtcacgaccggtgctcgatttagctgcgtcacgatctctcttggggagcttcagctgtggtagagaagacaggattcaggacaatctccagcatggccggcctccctctcctcctcaccctcctcactcactgtgcagggtcctgggcccagtctgtgctgactcagccaccctcagtgtcgtcgggacccccggcagagggtctccatctcttgtctgggancagctccgacgtacggaaatagttgtctactggtaccngcacgctaccccgagaaacccggcccccaagcctcctnatctaataggaatgactcacgccggccctgacgggactacgtgacccgtattccgtctcgggctacgaagttccgtcgggtccctccgtccgggccctcccgtagggccctagtccgnggtcgggccttccgggacgaggctggacggctagggaattgtttacgngtacgtgttggttcggatcgccgtagtcggtgggtcggtccgggttccgggtacgggttcgggtaccggggacgggaacggccgaggtccgtacggtaacccgtacggacgttaccgccggaacccggtaacg

SEQ ID NO: 311415 - DNA, 633 bp, Homo sapiens
  misc_feature: GZ8MTXP01CIDYM.25.36.D03.1.454.CMB.2.raw
  modified_base (188)..(188): a, c, t, g, unknown or other
  misc_feature (188)..(188): n is a, c, g, or t
  modified_base (209)..(209): a, c, t, g, unknown or other
  misc_feature (209)..(209): n is a, c, g, or t
  modified_base (239)..(239): a, c, t, g, unknown or other
  misc_feature (239)..(239): n is a, c, g, or t
  modified_base (266)..(266): a, c, t, g, unknown or other
  misc_feature (266)..(266): n is a, c, g, or t
  modified_base (500)..(500): a, c, t, g, unknown or other
  misc_feature (500)..(500): n is a, c, g, or t
  modified_base (583)..(583): a, c, t, g, unknown or other
  misc_feature (583)..(583): n is a, c, g, or t
tcagactgtacagtcacgaccggtgctcgatttagctgcgtcacgatctctcttggggagcttcagctgtggtagagaagacaggattcaggacaatctccagcatggcccggcctccctctcctcctcaccctcctcactcactgtgcagggtcctgggcccagtctgtgctgactcagccaccctnagtgtcgtcgggacccccggnaggaggtcctccatcttcttgttctgggancagcctccgacgtacggaaattagttntctactggtaccagcagcctacccgaagaaacccggcccccaagcctcctcatctataggaatgactcgacgccggccctgacgggactaccgtgaccgtattccgtcgtcggctacgtaacgtcctcgggtcctccgtcccggtacccttcccgtcggacctacgtccgagggtcgggtcccgttccgggccgaggtacgtggacggtctaaggggtaactttaagtttccgnggtaggtcgttaagggtttggaacgtcgtccgtaggttccgtgggtaacggttcgggttaccggtacgggttggtaccggggnggttacggacttacgcgtacgtccgtcgtagccgaaccgttccgaaccgg

SEQ ID NO: 311416 - DNA, 567 bp, Homo sapiens
  misc_feature: GZ8MTXP01AEVVJ.25.36.D03.1.454.CMB.2.raw
  modified_base (353)..(353): a, c, t, g, unknown or other
  misc_feature (353)..(353): n is a, c, g, or t
  modified_base (488)..(488): a, c, t, g, unknown or other
  misc_feature (488)..(488): n is a, c, g, or t
tcagactgtacagtcacgaccggtgctcgatttagctgcgtcacgatctctcttggggagcttcagctgtggtagagaagacaggattcaggacaatctccagcatggccggcctccctctcctcctcacccctcctcactcactgtgcagggtcctgggcccagtctgtgctgactcagccaccctcagtgtctgggacccccggcagagggtctccatctcttgtctgggagcagctccgacgtcggaaatagttgtctactggtacagcacgctacccaacgaaccggcccccaaagcctcctcatctataggaatgatcagcgcctcgacggactactgacccgattcncgtggctacgaagtcgtcgggtctccgtccgggccctcccgtcggacctacgtccgaggttcgggccttacccggccggagggacgaggcgtaggaagttaatcgtgtgctagttgggattcgcctagtcgttgnggtcggtaccggcggtcggttcggcgggacgggacgagcgtggtaccgtccgttacggcgaacgtcccgaacggtcccg

SEQ ID NO: 311417 - DNA, 616 bp, Homo sapiens
  misc_feature: GZ8MTXP01DGTT2.25.36.D03.1.454.CMB.2.raw
  modified_base (275)..(275): a, c, t, g, unknown or other
  misc_feature (275)..(275): n is a, c, g, or t
  modified_base (301)..(301): a, c, t, g, unknown or other
  misc_feature (301)..(301): n is a, c, g, or t
  modified_base (318)..(318): a, c, t, g, unknown or other
  misc_feature (318)..(318): n is a, c, g, or t
  modified_base (412)..(412): a, c, t, g, unknown or other
  misc_feature (412)..(412): n is a, c, g, or t
  modified_base (517)..(517): a, c, t, g, unknown or other
  misc_feature (517)..(517): n is a, c, g, or t
tcagactgtacagtcacgaccggtgctcgatttagctgcgtcacgatctctcttggggagctctgagagcggagccccagccccagaattcccaggtgttttcatttggtgatcagcactgaacacagaggactcaccatggagtttgggctgagcttgggttttccttgttgttattttccaggtgtccagagtgaggtgcagttggtggagtcgtgggggagtcttggtccagccgtgggagggtccgtgagagtcctccgtgtgcagcctcnggattcatcttcagtcgaccactacngtcggactcgggtcccncgaggctcccggaagggggagggggctagggtaggttggggttcggaccccgttaagttaaagaaataaagctaaaaaagagttaaccaccaanaagaactaccgccgcgtctgtagaaacggcaagtattacaatttacgtctaacgaagagtatagaactttacgaaaaacgtactacactagttactcagtaaaanaagtagaacacgaaccgtaaacggaaaccgaggaccgacggtacgttattacgttgttacgtgtacgtcgacgacgttaccgtaacggttaactaaccc

SEQ ID NO: 311418 - DNA, 665 bp, Homo sapiens
  misc_feature: GZ8MTXP01AX59D.25.36.D03.1.454.CMB.2.raw
  modified_base (230)..(230): a, c, t, g, unknown or other
  misc_feature (230)..(230): n is a, c, g, or t
  modified_base (247)..(247): a, c, t, g, unknown or other
  misc_feature (247)..(247): n is a, c, g, or t
  modified_base (320)..(320): a, c, t, g, unknown or other
  misc_feature (320)..(320): n is a, c, g, or t
tcagactgtacagtcacgaccggtgctcgatttagctgcgtcacgatctctcttgggggggggtctcaggaggcagcgctctcgggacgtctccaccatggcctgggctctgctgttcctcaccctcctcactcagggcacgagggtcctgggcccagtctgccctgactcagcctgcctccgtgtctgggactccgtggacagtcggtcacatctctgcactggaaccngccgtgactagttggtntacttaataactatcgtctcctggtacccaacaaccacccaggaccaacggacccccaaatcaatctatttangatgtcagtcactccggccctgtggtacgtttccgtcggttcgtctttctcgttcgaccttccgaagttccgtcgggaccctaaccgtcccgggtcccctacccgtcgtaaccctacgtccggtcggggtccctccgacggtcgtaggacgggacgacggtacttaactttacttagttgtacttatttaccaattacgaacgacgtaacctaacctaaacgtacgttcgtgggttcggttacggggacgggtaacgggaaaccgtaacggttccgaacccggttccgttacggtaaccgacgtaacccgaacggtcccttaccggtccccgttcggttaacccg

SEQ ID NO: 311419 - DNA, 703 bp, Homo sapiens
  misc_feature: GZ8MTXP01EXTH3.25.36.D03.1.454.CMB.2.raw
  modified_base (211)..(211): a, c, t, g, unknown or other
  misc_feature (211)..(211): n is a, c, g, or t
  modified_base (302)..(302): a, c, t, g, unknown or other
  misc_feature (302)..(302): n is a, c, g, or t
  modified_base (314)..(314): a, c, t, g, unknown or other
  misc_feature (314)..(314): n is a, c, g, or t
  modified_base (357)..(357): a, c, t, g, unknown or other
  misc_feature (357)..(357): n is a, c, g, or t
tcagactgtacagtcacgaccggtgctcgatttagctgcgtcacgatctctcttggggagcttcagctgtgggtagagaagacaggactcaggacaatctccagcatggccagcttccctctcctcctcaccctcctcactcactgtgcagggtcctgggcccagtctgtgctgtctcagcccaccctcagtgtcgtcggggccccccggnaggagggtcgacatctcttgttctggatcgctccaacgtcggcagtaatagtgtaagctggtaccagcaacctcccaggaaccgcccccanactctcatgtangggaatgatcacgccgccctcgacggggtcctgaccgtattcnctcgccctccgacgtctcggcctaccgtccacgtccctccccgtcgggcccacgttccggtcgggaccctaccgtaaacgtccgtaggacggagttcggaacgggggtcccgttaagttttaaactttacgtttggttcggaccgtaaggtccgggttggggaagttacggaaaccggtaagggggtaaacgtaaacggggtttttataccgggttaccggtttaacgggggtaaaacgttttacgggggaaacccttaacggggtttaacccgtaacccgggttcccggttaaccggggttccttaaacccgggtaaccccgttaaacggggtaaaccccccccg

SEQ ID NO: 311420 - DNA, 654 bp, Homo sapiens
  misc_feature: GZ8MTXP01DXQSC.25.36.D03.1.454.CMB.2.raw
  modified_base (230)..(230): a, c, t, g, unknown or other
  misc_feature (230)..(230): n is a, c, g, or t
  modified_base (236)..(236): a, c, t, g, unknown or other
  misc_feature (236)..(236): n is a, c, g, or t
  modified_base (246)..(246): a, c, t, g, unknown or other
  misc_feature (246)..(246): n is a, c, g, or t
  modified_base (257)..(257): a, c, t, g, unknown or other
  misc_feature (257)..(257): n is a, c, g, or t
  modified_base (264)..(264): a, c, t, g, unknown or other
  misc_feature (264)..(264): n is a, c, g, or t
tcagactgtacagtcacgaccggtgctcgatttagctgcgtcacgatctctcgttgggggggggtctcaggaggcagcgctctcgggacgtctccaccatggcctgggctctgctgttcctcaccctcctcactcagggcacagggtcctgggcccagtctgccctgactcagcctgcctccgtgtctgggactcctggaccagtcgtcaccatctctgcactggaaccngcgtanactgttggtntacttatactntctctcncgaccaacaaccaccgacgaccaaccgaccccaactcatactatttatgtatgtactagtctacgtccgtccttcgtggtacgtttccgtcggtctcttctcgtacgtctcgtagtcgtacgtacctaccgtccgtccctcctacgtacctcgtccggtcggtcctaccggacggtcgtaggacggacggtacgtacttacgtttattacggttctacttacttactaacgtaacgaacgtaacgaaacctaaccgtaacgttacggttacggtcgggttcggttaccgggacgggtaaccggttaaccgtaacggttccgttacccgttccgttaccggtaacgaccgtaacccgtacggtcccgttacccgtccccgttcgtaacccg

SEQ ID NO: 311421 - DNA, 670 bp, Homo sapiens
  misc_feature: GZ8MTXP01B6DC3.25.36.D03.1.454.CMB.2.raw
  modified_base (208)..(208): a, c, t, g, unknown or other
  misc_feature (208)..(208): n is a, c, g, or t
  modified_base (233)..(233): a, c, t, g, unknown or other
  misc_feature (233)..(233): n is a, c, g, or t
  modified_base (616)..(616): a, c, t, g, unknown or other
  misc_feature (616)..(616): n is a, c, g, or t
tcagactgtacagtcacgaccggtgctcgatttagctgcgtcacgatctctcttggggagcttcagctgtggtagagaagacaggattcaggacaatctccagcatggccggcctccctctcctcctcaccctcctcactcactgtgcagggtcctgggcccagtctgtgctgactcagcccaccctcagtgtctcgggacccccggnagaggtctcatctcttgtctgggancagctccgacgtacggaaattagttgtctactggtaccagcagcctcccaagaaaccggcccccaaagcctcctacactctaagtaggatgactacgacggcccggtaccctacggaacggggtacctaccgtacggaccgtacttccgttcgtcgggtcctacggtaacgttccgtcggtccctccccgtcccggtccccttcccgtcggaaccctcgtacgacgggttcccggggtcccgttaccgggtaccgggaggacgttagggacggtccgtacggtaaagtttacgttaccgtggttccgacgtttagggggtttcggacgtccgtacgtcgtcgtggtaacggtccgggttacgggtcgggttcggtaccggggnggttaaccggacacgtcgtaccgtaacccgtcgtacggcaaccggccgtaaccg

SEQ ID NO: 311422 - DNA, 490 bp, Homo sapiens
  misc_feature: GZ8MTXP01C1RB0.25.36.D03.1.454.CMB.2.raw
  modified_base (206)..(206): a, c, t, g, unknown or other
  misc_feature (206)..(206): n is a, c, g, or t
  modified_base (231)..(231): a, c, t, g, unknown or other
  misc_feature (231)..(231): n is a, c, g, or t
  modified_base (301)..(301): a, c, t, g, unknown or other
  misc_feature (301)..(301): n is a, c, g, or t
  modified_base (344)..(344): a, c, t, g, unknown or other
  misc_feature (344)..(344): n is a, c, g, or t
  modified_base (355)..(355): a, c, t, g, unknown or other
  misc_feature (355)..(355): n is a, c, g, or t
  modified_base (360)..(360): a, c, t, g, unknown or other
  misc_feature (360)..(360): n is a, c, g, or t
  modified_base (406)..(406): a, c, t, g, unknown or other
  misc_feature (406)..(406): n is a, c, g, or t
  modified_base (408)..(408): a, c, t, g, unknown or other
  misc_feature (408)..(408): n is a, c, g, or t
  modified_base (431)..(431): a, c, t, g, unknown or other
  misc_feature (431)..(431): n is a, c, g, or t
  modified_base (466)..(467): a, c, t, g, unknown or other
  misc_feature (466)..(467): n is a, c, g, or t
  modified_base (475)..(475): a, c, t, g, unknown or other
  misc_feature (475)..(475): n is a, c, g, or t
  modified_base (482)..(482): a, c, t, g, unknown or other
  misc_feature (482)..(482): n is a, c, g, or t
tcagactgtacagtcacgaccggtgctcgatttagctgcgtcacgatctctcttggggagcttcagctgtggtagagaagacaggattcaggacaatctccagcatggccggcctccctctcctcctcaccctcctcactcactgtgcagggtcctgggcccagtctgtgctgactcagccaccctcagtgtctcgggaccccggnagaggtctcatctcttgtctgggancagctcgacgtcggaaatagttgtctactggtaccagcagtccacccagaaccggccccaaagcctcctnagtcatagaatgatcagcgcctgacggactactgacgtattcnctggctgatcngctcncgcctctgcatcgagtcggctcgtcgagatgagctggaacttatangngtcaggttggatcgacctgttcngtaagtggttccgaggttgtcgggcgagggcacgnngccgtcgnggttacngccgaacg

SEQ ID NO: 311423 - DNA, 782 bp, Homo sapiens
  misc_feature: GZ8MTXP01DLKR0.25.36.D03.1.454.CMB.2.raw
  modified_base (209)..(209): a, c, t, g, unknown or other
  misc_feature (209)..(209): n is a, c, g, or t
  modified_base (232)..(232): a, c, t, g, unknown or other
  misc_feature (232)..(232): n is a, c, g, or t
  modified_base (237)..(237): a, c, t, g, unknown or other
  misc_feature (237)..(237): n is a, c, g, or t
  modified_base (260)..(260): a, c, t, g, unknown or other
  misc_feature (260)..(260): n is a, c, g, or t
  modified_base (545)..(545): a, c, t, g, unknown or other
  misc_feature (545)..(545): n is a, c, g, or t
tcagactgtacagtcacgaccggtgctcgatttagctgcgtcacgatctctcttggggagcttcagctgtggtagagaagacaggattcaggacaatctccagcatggccggcctccctctcctcctcaccctcctcactcactgtgcagggtcctgggcccagtctgtgctgactcacgcccaccctcagtgtcgtcgggaccccggnagaggtcctccatctcttgttcngggancagctacgacgtcgaaatagttnctactggtacagcagcctcccgaagaaccggcccccaagcctcctcatactagtaggaatgatcgacgccggcctacgacggtactaccgtgtaacccgtattccgtctcggcttacgggtaaacgttccgtcgggtccttccccgtcccgggtcccccttcccgtacgggtccccaagttcccgtaacggggttccgggggtccccgttacccgggggtacccggaaggggtaacttgggaaacgggtacccgtttagggggtaaaactttacgttttaaccgngggttacggtaccggttaagggtttttcgggggaatttccggaacccgttaggttccgtttgggtaacggggttccggggtttacccggggtaacggggtttcggggtttacccgggggaccgggggttaaaaccgggggccccgttaaaacggtccccgggttaccggtaacccccgggtttacccggtaaacggggttccccgtaaaccgggaacccccgggttaaaccccgggg

SEQ ID NO: 311424 - DNA, 758 bp, Homo sapiens
  misc_feature: GZ8MTXP01A17ZJ.25.36.D03.1.454.CMB.2.raw
  modified_base (246)..(246): a, c, t, g, unknown or other
  misc_feature (246)..(246): n is a, c, g, or t
tcagactgtacagtcacgaccggtgctcgatttagctgcgtcacgatctctcttggggggggtctcaggaggcagcgctctcgggacgtctccaccatggcctgggctctgctgttcctcaccctcctcactcagggcacagggtcctgggcccagtctgccctgactcagcctgcctccgtgtctgggactccgtggacagtcggtcaccatctcctgcactggaaccagccgtgactattggtntacttataactatgtctcctcgtacccaacaacacccaggacaacggacccccaaatcatctatttatgatgtacagtctagtccggtccctcgtggtacgtttcccgtggtcgtcttcctcgtcgggccttccgaagtccgttacgggacctaaccgtcccgggtaccccttcccgtacgtacccgtacgttcccggtcgggggtcccttcccggaacgggtccgtacgggaacgggaccggtaacgggtacctttaaacgttttagtttacggttacggtacttaacgtttacctaaacgttaaccgtaacgtaaaccggtaaaccgaaccctaaaacgtaacggttccgttacggggttaacgggtttaccggggacggggtaacggggttaacccgttaaacgggttccgggttaaaccccggttccggttacccgggttaaccacccgggtaaccccggtaaaccgggtcccgttaccccgggtcccccgttaaccggggttccccg

SEQ ID NO: 311425 - DNA, 667 bp, Homo sapiens
  misc_feature: GZ8MTXP01B9D5C.25.36.D03.1.454.CMB.2.raw
  modified_base (187)..(187): a, c, t, g, unknown or other
  misc_feature (187)..(187): n is a, c, g, or t
  modified_base (206)..(206): a, c, t, g, unknown or other
  misc_feature (206)..(206): n is a, c, g, or t
  modified_base (232)..(232): a, c, t, g, unknown or other
  misc_feature (232)..(232): n is a, c, g, or t
tcagactgtacagtcacgaccggtgctcgatttagctgcgtcacgatctctcttggggagcttcagctgtggtagagaagacaggattcaggacaatctccagcatggccggcctccctctcctcctcaccctcctcactcactgtgcagggtcctgggcccagtctgtgctgactcagccaccctnagtgtctgggaaccccggnagaggtctccatctcttgtctgggancagcctccgacgtcggaaataagtttgtctactggtaccagcagcctcccagaaccggcccccaagcctcctcatctataggatgatcagccggccctcgacgggactaccgtgacccgtattcctcgtcggctacggaagttccgtcgggtcctcccgttcccggcccttcccgtcgggacccatccgagggttccggggccttcccggggtccggagggtagtcgggaggtccttaggggtaatttacgtttaccgtggtcgtaccgttaggtttcgggagttcgcccgtagtcgtgggtaacggttcggggttcccggtacggggtttggttccgggggcggggttaacggggttacccgaaacgggtcccgttacgggaaccccggtttcccggtagggttccccgaaccgggttccccggtaacccgggg

SEQ ID NO: 311426 - DNA, 611 bp, Homo sapiens
  misc_feature: GZ8MTXP01EZ11F.25.36.D03.1.454.CMB.2.raw
  modified_base (229)..(229): a, c, t, g, unknown or other
  misc_feature (229)..(229): n is a, c, g, or t
  modified_base (246)..(246): a, c, t, g, unknown or other
  misc_feature (246)..(246): n is a, c, g, or t
  modified_base (309)..(309): a, c, t, g, unknown or other
  misc_feature (309)..(309): n is a, c, g, or t
  modified_base (319)..(319): a, c, t, g, unknown or other
  misc_feature (319)..(319): n is a, c, g, or t
tcagactgtacagtcacgaccggtgctcgatttagctgcgtcacgatctctcttggggggggtctcaggaggcagcgctctcgggacgtctccaccatggcctgggctctgctgttcctcaccctcctcactcagggcacagggtcctgggcccagtctgccctgactcagcctgcctccgtgtctgggactcctggacagtcggtcaccatctcctgcactggaaccngccgtgactattgggtntcttataactatgtctctgtacccaacaacacccaggcaacggcccccaaatcatctatttangatgtcagtnacccccccgtggccctgtggtagttttccgtggtcgtcttctcgtcggcctcctaagtctcgggcctaacgtcggccctccctgaaccctgtccgtcggggcctccgaggcgtaggacggacgacggtcttaacgttattagttcgtacttatttacacttaacgacgtaacggaacctaactaaacgtacgttccgttaggggtcggttcggggcgggtaagggttaccctaaggttcgacccgttccgttcgggcacggcccgaaggccttccgtcccccgttcggtccc

SEQ ID NO: 311427 - DNA, 770 bp, Homo sapiens
  misc_feature: GZ8MTXP01DVGFI.25.36.D03.1.454.CMB.2.raw
  modified_base (186)..(186): a, c, t, g, unknown or other
  misc_feature (186)..(186): n is a, c, g, or t
  modified_base (206)..(206): a, c, t, g, unknown or other
  misc_feature (206)..(206): n is a, c, g, or t
  modified_base (233)..(233): a, c, t, g, unknown or other
  misc_feature (233)..(233): n is a, c, g, or t
tcagactgtacagtcacgaccggtgctcgatttagctgcgtcacgatctctcttggggagcttcagctgtggtagagaagacaggattcaggacaatctccagcatggccgcctccctctcctcctcaccctcctcactcactgtgcagggtcctgggcccagtctgtgctgactcagccaccctnagtgtcgtcgggaccccggnaggaggtctcatctcttgttctgggancagcctcgacgtacggtaaattagtttcgtctacgtcggtaccagcagccctacccgaacggaaacccggccccctaaagccctcctacgtaacttactaagtaggaatcgaacgtcgacgccggtccctacgacgggtactaccgtcggacctacgtttcctcgttcggccttacgggaacgttccgtcgggtcccttccccgtcccggtccccgttcccgttcgggccctaacgtcccggtaacggggtccggggttaccccggttcccggggtacccgggtaaggggtagttacgggtaccgggtaccgtttaagggtaaacgttttaacgttttaaccggtggttacggtaccggttaggggttttacgggtaaacgttcggtcccgtaggtttcccgtagggtaacggggttcggggttcccgggtacggggtttcggggttaccggacgggggaaacgggttaccaacgggtcccgtaccgggaaccggtttacccggacgttaccggtaacccgaacccggtaacccggg

SEQ ID NO: 311428 - DNA, 777 bp, Homo sapiens
  misc_feature: GZ8MTXP01CTF2I.25.36.D03.1.454.CMB.2.raw
  modified_base (188)..(188): a, c, t, g, unknown or other
  misc_feature (188)..(188): n is a, c, g, or t
  modified_base (236)..(236): a, c, t, g, unknown or other
  misc_feature (236)..(236): n is a, c, g, or t
tcagactgtacagtcacgaccggtgctcgatttagctgcgtcacgatctctcttggggagcttcagctgtggtagagaagacaggattcaggacaatctccagcatggccgcctccctctcctcctcaccctcctcactcactgtgcagggtcctgggcccagtctgtgctgactcacgcccaccctnagtcgtcgtcgggaccccggagacggtctccatctcttgtcgtgggancagtcctaccgacgtacggtaaattaagtttcgtctacgtggtaccagacacgtcctaccccgaaggaaaccccggccccccaaagccctaccctacaacttacctaagtaacggtaaacttacggaacttaccgaacgggtccccggtaccccgttacggaaacccggggtaaccttaccgtacggtaaacccgtactttcccgtacgtcgggccttacggtaaacggttccgtcgggtcccttcccgtcccgggtccccttcccgtaacggccctaacgtccgtacggggtccgggtcccgttccgggaccgggaggaacgttgggaaacggtcgttaagggttaaatttaacgtttcgtaggttacgtacgttagggtttcggaaccgttcgtaccgttaggttcggtagggtaacgggttcgggttaccggggttacgggttccgggtaccggggaacgggttaaccggaccgttaacggtccgtaccggtaacccggttaccggtacggttaccgaaccgggttaacccgtaacgg

SEQ ID NO: 311429 - DNA, 571 bp, Homo sapiens
  misc_feature: GZ8MTXP01B1268.25.36.D03.1.454.CMB.2.raw
  modified_base (242)..(242): a, c, t, g, unknown or other
  misc_feature (242)..(242): n is a, c, g, or t
  modified_base (306)..(306): a, c, t, g, unknown or other
  misc_feature (306)..(306): n is a, c, g, or t
  modified_base (470)..(470): a, c, t, g, unknown or other
  misc_feature (470)..(470): n is a, c, g, or t
tcagactgtacagtcacgaccggtgctcgatttagctgcgtcacgatctctcttggggggggtctcaggaggcagcgctctcgggacgtctccaccatggcctgggctctgctgttcctcaccctcctcactcagggcacagggtcctgggcccagtctgccctgactcagcctgcctccgtgtctgggactcctggacagtcgtcacatctctgcactggaaccagccgtgactattggtntacttataactatgtctcctggtcccaacaacacccaggcaacggccccaaactcatcatttangatgtcagtcatccggccctctggtagtttcctggttcgctttcctctcggctccaagtctcgggcaacgtccgggcctccctcgacctactcgtcggggcctccgagggtcctggacgggacgaggcttacttactttattcgtactatttacatacaggtanaacactaactagtcgtagggtcgttcgggcgggtacgggacctaaggttcgaccgttcgttagggtcacgcccgaaggccttaccgtccccgttcggtccc

SEQ ID NO: 311430 - DNA, 590 bp, Homo sapiens
  misc_feature: GZ8MTXP01BGKFU.25.36.D03.1.454.CMB.2.raw
tcagactgtacagtcacgaccggtgctcgatttagctgcgtcacgatctctcttggggggggtctcaggaggcagcactctcgggacgtctccaccatggcctgggctctgctcctcctcagcctcctcactcagggcacaggatcccgggctcagtctgccctgactcagcctcgctcagtgtccggtctcctggacagtcagtcaccatctcctgcactggaaccagaagtgattcgttggtgtcttatgacactgtctcctggccacctacgtttaccccaggaaacgcccccagagtcatcctttatgatgtcaggaacgcgccctcgaccggggtccctgtactcgtccttctcgtcgggtacctaaacgtcgtcggaccaacgaccgggtccctcccctgacctactcgtcgtcgggtcctcgacgggctggacggatggacggtcttaggtatttagttattgtacttgttactagtatgactggtactaacgtacttaggtttgggttcgttccgggcgacgttagggacccgtaaggtttcgaacccggttctcgggggttaccaaccgcccgtaaccggg

SEQ ID NO: 311431 - DNA, 515 bp, Homo sapiens
  misc_feature: GZ8MTXP01D3O4R.25.36.D03.1.454.CMB.2.raw
  modified_base (206)..(206): a, c, t, g, unknown or other
  misc_feature (206)..(206): n is a, c, g, or t
  modified_base (233)..(233): a, c, t, g, unknown or other
  misc_feature (233)..(233): n is a, c, g, or t
  modified_base (295)..(295): a, c, t, g, unknown or other
  misc_feature (295)..(295): n is a, c, g, or t
  modified_base (320)..(320): a, c, t, g, unknown or other
  misc_feature (320)..(320): n is a, c, g, or t
  modified_base (452)..(452): a, c, t, g, unknown or other
  misc_feature (452)..(452): n is a, c, g, or t
tcagactgtacagtcacgaccggtgctcgatttagctgcgtcacgatctctcttggggagcttcagctgtggtagagaagacaggattcaggacaatctccagcatggccggcctccctctcctcctcaccctcctcactcactgtgtagggtcctgggcccagtctgtgctgactcagccaccctcagtgtctgggacccccggnagaggtctccatctcttgttctgggancagctccgagtcgaaatagttgtctactggtacagcagctccagaaacgccccaagctcctnatctataggaatgatcagcgccctnaggactacctgaccgattctctgctcgaatctggcctccgtcggccctcccgtggccactcgagtcgggctccggtccgaggattgaggctgaatagttactgtgcgtagtttgggattggcctaggtctgngtcggtaccgcggtgttcggcggaggcccttagctgaccgtcgtaggtcacgcccgaagcccg

SEQ ID NO: 311432 - DNA, 670 bp, Homo sapiens
  misc_feature: GZ8MTXP01B54J3.25.36.D03.1.454.CMB.2.raw
  modified_base (213)..(213): a, c, t, g, unknown or other
  misc_feature (213)..(213): n is a, c, g, or t
  modified_base (246)..(246): a, c, t, g, unknown or other
  misc_feature (246)..(246): n is a, c, g, or t
  modified_base (393)..(393): a, c, t, g, unknown or other
  misc_feature (393)..(393): n is a, c, g, or t
tcagactgtacagtcacgaccggtgctcgatttagctgcgtcacgatctctcttggggagcttcagctgtggtagagaagacaggattcaggacaatctccagcatggccggcctccctctcctcctcacccctcctcactcactgtgcagggtcctgggcccagtctgtgctgactcacgcccaccctcagtgtccgtcgggacccccgggnaggagggtcctccattcttcttgttcgtgggancagcctccggacgtacggtaaattagtttgtctactggtaccagcacgcctaccccaaggaaaccccggccccccaagccctcctctatactagtaggaaatggactcgacgccggaccctgaaccgggacttaccgtgaacccgtntttccgtcgtcggctaccggtacgttcgtcggcccttcccgtaccggtccccttccgtcggcctagtccgagggttcggggccttccgggtccggaggatggacgggtcttaggtaaactttacgttcgtggttagcggttagggtttgggaacttcggacctggttcggtgggtaacgggttcgggttacccgggtggggttcggttacggggacggggacgttccgaggtccgtacggaacccggttcgacgggttccaacccgcccgtaaccgg

SEQ ID NO: 311433 - DNA, 536 bp, Homo sapiens
  misc_feature: GZ8MTXP01ANI6N.25.36.D03.1.454.CMB.2.raw
  modified_base (268)..(268): a, c, t, g, unknown or other
  misc_feature (268)..(268): n is a, c, g, or t
  modified_base (306)..(306): a, c, t, g, unknown or other
  misc_feature (306)..(306): n is a, c, g, or t
  modified_base (369)..(369): a, c, t, g, unknown or other
  misc_feature (369)..(369): n is a, c, g, or t
  modified_base (379)..(379): a, c, t, g, unknown or other
  misc_feature (379)..(379): n is a, c, g, or t
  modified_base (383)..(383): a, c, t, g, unknown or other
  misc_feature (383)..(383): n is a, c, g, or t
  modified_base (405)..(405): a, c, t, g, unknown or other
  misc_feature (405)..(405): n is a, c, g, or t
  modified_base (457)..(457): a, c, t, g, unknown or other
  misc_feature (457)..(457): n is a, c, g, or t
  modified_base (476)..(476): a, c, t, g, unknown or other
  misc_feature (476)..(476): n is a, c, g, or t
tcagactgtacagtcacgaccggtgctcgatttagctgcgtcacgatctctcttggggagctctgagagcggagccccagccccagaattcccaggtgtttcatttggtgatcagcactgaacacagaggactcaccatggagtttgggctgagctgggtttccttgttgttattttccaggtgtccagagtgaggtgcagttggtggagtcgtgggggagcttgggtccaggcctgggaggtccgtgagagtctctgtgcagcctcnggattcatcttcagtgaccactacatggactgggtccnccaggctcgagggaggggctgggagtgggttgcccgtatagaaataagctaaagataacacanagaatcgcgngtcngtcgaaaggcagattcattacnctacaagagatcgattacgaaagactcaactgtatctagacaaagtgaaacncgtacccgaagaaaaccgngggaccacggtccggtattattacgttgtggctaaggtcagttactaacgggttgaaccc

SEQ ID NO: 311434 - DNA, 566 bp, Homo sapiens
  misc_feature: GZ8MTXP01D7VKZ.25.36.D03.1.454.CMB.2.raw
  modified_base (200)..(200): a, c, t, g, unknown or other
  misc_feature (200)..(200): n is a, c, g, or t
  modified_base (245)..(245): a, c, t, g, unknown or other
  misc_feature (245)..(245): n is a, c, g, or t
  modified_base (312)..(312): a, c, t, g, unknown or other
  misc_feature (312)..(312): n is a, c, g, or t
  modified_base (348)..(348): a, c, t, g, unknown or other
  misc_feature (348)..(348): n is a, c, g, or t
  modified_base (355)..(355): a, c, t, g, unknown or other
  misc_feature (355)..(355): n is a, c, g, or t
  modified_base (422)..(422): a, c, t, g, unknown or other
  misc_feature (422)..(422): n is a, c, g, or t
  modified_base (469)..(469): a, c, t, g, unknown or other
  misc_feature (469)..(469): n is a, c, g, or t
  modified_base (473)..(473): a, c, t, g, unknown or other
  misc_feature (473)..(473): n is a, c, g, or t
  modified_base (480)..(480): a, c, t, g, unknown or other
  misc_feature (480)..(480): n is a, c, g, or t
  modified_base (482)..(482): a, c, t, g, unknown or other
  misc_feature (482)..(482): n is a, c, g, or t
  modified_base (484)..(484): a, c, t, g, unknown or other
  misc_feature (484)..(484): n is a, c, g, or t
  modified_base (486)..(486): a, c, t, g, unknown or other
  misc_feature (486)..(486): n is a, c, g, or t
  modified_base (493)..(493): a, c, t, g, unknown or other
  misc_feature (493)..(493): n is a, c, g, or t
  modified_base (507)..(507): a, c, t, g, unknown or other
  misc_feature (507)..(507): n is a, c, g, or t
tcagactgtacagtcacgaccggtgctcgatttagctgcgtcacgatctctcttggggggggtctcaggaggcagcgctctcgggacgtctccaccatggcctgggctctgctgttcctcaccctcctcactcagggcacagggtcctgggcccagtctgccctgactcagcctgcctccgtgtctgggactcctggacngtcggtcaccatcctcctgcactggaacccagccgtgacattggngtacttaataactatgtctcctggtcccaacaacacccaggccaacggcccccaaatcatcatttangatgtcacgtcactcggcccttctggtgttttcccngggttcnctttcctcgtcgggtacctcccgtaaagtcctagggtcctaaccgtcgggcccttccctgaaccctnttccggcgggacctccgaggcctggacggcagccttatttatagttntctnttataananananacactanatgtggtggtcggnggacggacgtacgtcgttccgttcgttcgtcgacgcgcgcgttccgtcccgttccgtcg

SEQ ID NO: 311435 - DNA, 641 bp, Homo sapiens
  misc_feature: GZ8MTXP01BDWZS.25.36.D03.1.454.CMB.2.raw
  modified_base (299)..(299): a, c, t, g, unknown or other
  misc_feature (299)..(299): n is a, c, g, or t
tcagactgtacagtcacgaccggtgctcgatttagctgcgtcacgatctctcttggggagcttcagctgtggtagagaagacaggattcaggacaatctccagcatggccggcctccctctcctcctcaccctcctcactcactgtgcagggtcctgggcccagtctgtgctgactcacgcccaccctcagtcgtccgtcgggacccccgggcaggacgggtcctccattcttcgttgttcgtgggacgcacgccttaccgacggtacggtaaaattaagtttgtactacgtggtaccngacacgcctacccgaaggaaacccggcccccaagcctcctacatactagtagatgatcacggcgcctacgacggactacgtcgacctacttcgtcgtggctacggtacgttcgtcggtccctccgtcccggtccctcccgtcggcctacgtcggtacgggtcgggtcccgtcccggggtaccggaggtagtcggacggtacgtagggtaaatttacgttacgtggtcgtacgttaggtttcggattcgtccgtagttcgtgggaaggtcggttacgtgggttcgggtcgggacggagggttccagggtctcggccgtcgtacggaccaacgttcccgaacgg

SEQ ID NO: 311436 - DNA, 553 bp, Homo sapiens
  misc_feature: GZ8MTXP01B3JER.25.36.D03.1.454.CMB.2.raw
  modified_base (245)..(245): a, c, t, g, unknown or other
  misc_feature (245)..(245): n is a, c, g, or t
  modified_base (392)..(392): a, c, t, g, unknown or other
  misc_feature (392)..(392): n is a, c, g, or t
  modified_base (487)..(487): a, c, t, g, unknown or other
  misc_feature (487)..(487): n is a, c, g, or t
  modified_base (514)..(514): a, c, t, g, unknown or other
  misc_feature (514)..(514): n is a, c, g, or t
tcagactgtacagtcacgaccggtgctcgatttagctgcgtcacgatctctcttggggggggtctcaggaggcagcgctctcgggacgtctccaccatggcctgggctctgctgttcctcaccctcctcactcagggcacagggtcctgggcccagtctgccctgactcagcctgcctccgtgtctgggactcctggacagtcggtcaccatctcctgcactggaaccagccgtgacagttggtntacttataactatgtctcctgtacccaacaacaccaggcaacggaccccaaatcatcatttatgatgtcagtcactccggccctcgtggtacgtttcctggtcgtctttctcgtcggctccgaagtctggctacgtccggcctcccngaccatcgtcgggctccgaggctaggaggacgagcttaacgttattagttgtactatttcatacagagaaccaacactagtctgggtcgttcggnggacggaccgtaaagtcgacccgttcncggtcacgccgtaacggccttccgccccgttcggtaacc

SEQ ID NO: 311437 - DNA, 525 bp, Homo sapiens
  misc_feature: GZ8MTXP01AX8IJ.25.36.D03.1.454.CMB.2.raw
  modified_base (245)..(245): a, c, t, g, unknown or other
  misc_feature (245)..(245): n is a, c, g, or t
  modified_base (263)..(263): a, c, t, g, unknown or other
  misc_feature (263)..(263): n is a, c, g, or t
  modified_base (466)..(466): a, c, t, g, unknown or other
  misc_feature (466)..(466): n is a, c, g, or t
  modified_base (509)..(509): a, c, t, g, unknown or other
  misc_feature (509)..(509): n is a, c, g, or t
tcagactgtacagtcacgaccggtgctcgatttagctgcgtcacgatctctcttggggggggtctcaggaggcagcgctctcgggacgtctccaccatggcctgggctctgctgttcctcaccctcctcactcagggcacagggtcctgggcccagtctgccctgactcagcctgcctccgtgtctgggactcctggacagtcggtcaccatctcctgcactggaaccagccgtgacattgggtncttataactatgtctccngtcccaacaacacccaggcaacggcccccaaactcatcatttatgatgtcagtcactcggccctcgtggacgtttccgtggtcgtcttctcgtcggtctccaagtctggctaactcgcctccctgaccatcgtcgggctcgagctgaggacgagctacttatagttgctattcatacagacacacaacagtctggtgtcgggnggaggacgaaagttcgaccgttcgttcgcacgcccgaggtccncgtccccgttcggtcc

SEQ ID NO: 311438 - DNA, 561 bp, Homo sapiens
  misc_feature: GZ8MTXP01A8M2B.25.36.D03.1.454.CMB.2.raw
  modified_base (199)..(199): a, c, t, g, unknown or other
  misc_feature (199)..(199): n is a, c, g, or t
  modified_base (243)..(243): a, c, t, g, unknown or other
  misc_feature (243)..(243): n is a, c, g, or t
  modified_base (304)..(304): a, c, t, g, unknown or other
  misc_feature (304)..(304): n is a, c, g, or t
  modified_base (324)..(324): a, c, t, g, unknown or other
  misc_feature (324)..(324): n is a, c, g, or t
  modified_base (335)..(335): a, c, t, g, unknown or other
  misc_feature (335)..(335): n is a, c, g, or t
  modified_base (340)..(340): a, c, t, g, unknown or other
  misc_feature (340)..(340): n is a, c, g, or t
tcagactgtacagtcacgaccggtgctcgatttagctgcgtcacgatctctcttgggggggtctcaggaggcagcgctctcgggacgtctccaccatggcctgggctctgctgttcctcaccctcctcactcagggcacagggtcctgggcccagtctgccctgactcagcctgcctccgtgtctgggactcctggacngtcgtcaccatctcctgcactggaaccagccgtgactattggtncttataactatgtctcctggtcccaacaacacccaggcaacggccccaaatcatcatttangatgtcagtcatcggccctntggatttcccnggtcncttctctggctcaagtctggcaactcggcctccctgaccatcgtcggggctccgaggccgtggacggacgacggctaactttaattagttgtctatttacataacagacgaacactacgagttcctggtgtcggcggtacgggaccgtaaggttcgacccggttccgttacgggtccgacgccccggaacggtccttacggtcccccgttcgggttccccg

SEQ ID NO: 311439 - DNA, 722 bp, Homo sapiens
  misc_feature: GZ8MTXP01CM2BZ.25.36.D03.1.454.CMB.2.raw
  modified_base (245)..(245): a, c, t, g, unknown or other
  misc_feature (245)..(245): n is a, c, g, or t
tcagactgtacagtcacgaccggtgctcgatttagctgcgtcacgatctctcttgggggggggtctcaggaggcagcgctctcgggacgtctccaccatggcctgggctctgctgttcctcaccctcctcactcagggcacagggtcctgggcccagtctgccctgactcagcctgcctccgtgtctggactccgtggacagtcgtcacatctctgcactcggaaccagccgtgactagttggtntacttaataacttatcgtctccgtcggtaccccaaacaaaccacccgaacggaccaaaccggaccccccaaaactcctaactactaatttatgatgtacagtcacgtccggtcctgtggtagtttccgtggtcgtcttctcgtcggtcctccaagtctcgggactaaccgtccgggtccctccctcgacctacgtccggtccggggcctccggaggtcgtaggacgggacgacggtcttaacgtttattacggttcgtacttactttcaaacttacgaacgtaacgtaaacccaaccgtaaacgtacggttcggttggggtcgggtttaccggggacgggggtaaaccggggttaacccgttaaacgggttccggttaaccccgggtttcccgttaccggggttaacccgaacccgggtaaccccggtaaaccggggtccccgttaccccgggtcccccccgtttcggggttccccc

SEQ ID NO: 311440 - DNA, 628 bp, Homo sapiens
  misc_feature: GZ8MTXP01CHREV.25.36.D03.1.454.CMB.2.raw
  modified_base (508)..(508): a, c, t, g, unknown or other
  misc_feature (508)..(508): n is a, c, g, or t
tcagactgtacagtcacgaccggtgctcgatttagctgcgtcacgatctctcttgggggggggtctcaggaggcagcactctcgggacgtctccaccatggcctgggctctgctcctcctcagcctcctcactcagggcacaggatcccgggctcagtctgccctgactcagcctcgctcagtgtcccggtctccgtggacagtcagtcacatctcctgcacgtggaaccagaagtgattcgttggtgcttatgacactgtctcctggcacctacgtttaacccaaggaaaccgcccccaagagtcacttaccttatgtatcgtacgaggaacggtccggccctcggaccccgggtccctagactcgtacttcctcgtcggtaccaaatcgtcgtaccgaccgacggtccctcccgtacgaccacgttcctccgttcggggtacctccgaaggtctacggaggtaacgtgacggtctagttagtttattagttgtcgttgtctaagtntggacgtaggtacctaacttacgtttagttttcgggttcgtttaccgggcgttaccgttcgggaaccgttaacggttcgtaaccggtccggtacgggttacaacccggcccgtaaccggg

SEQ ID NO: 311441 - DNA, 519 bp, Homo sapiens
  misc_feature: GZ8MTXP01A1KZO.25.36.D03.1.454.CMB.2.raw
  modified_base (226)..(226): a, c, t, g, unknown or other
  misc_feature (226)..(226): n is a, c, g, or t
  modified_base (240)..(240): a, c, t, g, unknown or other
  misc_feature (240)..(240): n is a, c, g, or t
  modified_base (257)..(257): a, c, t, g, unknown or other
  misc_feature (257)..(257): n is a, c, g, or t
  modified_base (300)..(300): a, c, t, g, unknown or other
  misc_feature (300)..(300): n is a, c, g, or t
  modified_base (434)..(434): a, c, t, g, unknown or other
  misc_feature (434)..(434): n is a, c, g, or t
tcagactgtacagtcacgaccggtgctcgatttagctgcgtcacgatctctcttggggggtctcaggaggcagcgctctcgggacgtctccaccatggcctgggctctgctgttcctcaccctcctcactcagggcacagggtcctgggcccagtctgccctgactcagcctgcctcgtgtctgggactcctggacagtcggtcaccatctcctgcactggaaccngccgtgacattggncttataactatgtctcnggtcccaacaacacccaggcaacggccccaaatcatcatttangatgtcagtcatcggccctctcggagtttcctggtcgcttctctggctcaagtctggcaactcggctccctgaccatcgtcggggctccgaggcctggagacgaggctacttattattgctatttcatacaganacacaacagtcctgggtcgttcggcggaggcccaaaggttcgaccgttcttcgggcaggcccaagggcttcgccccgttcggtcc

SEQ ID NO: 311442 - DNA, 623 bp, Homo sapiens
  misc_feature: GZ8MTXP01CKB5A.25.36.D03.1.454.CMB.2.raw
  modified_base (211)..(211): a, c, t, g, unknown or other
  misc_feature (211)..(211): n is a, c, g, or t
  modified_base (242)..(242): a, c, t, g, unknown or other
  misc_feature (242)..(242): n is a, c, g, or t
  modified_base (389)..(389): a, c, t, g, unknown or other
  misc_feature (389)..(389): n is a, c, g, or t
  modified_base (439)..(439): a, c, t, g, unknown or other
  misc_feature (439)..(439): n is a, c, g, or t
  modified_base (446)..(446): a, c, t, g, unknown or other
  misc_feature (446)..(446): n is a, c, g, or t
  modified_base (549)..(549): a, c, t, g, unknown or other
  misc_feature (549)..(549): n is a, c, g, or t
  modified_base (580)..(580): a, c, t, g, unknown or other
  misc_feature (580)..(580): n is a, c, g, or t
  modified_base (604)..(604): a, c, t, g, unknown or other
  misc_feature (604)..(604): n is a, c, g, or t
  modified_base (611)..(611): a, c, t, g, unknown or other
  misc_feature (611)..(611): n is a, c, g, or t
tcagactgtacagtcacgaccggtgctcgatttagctgcgtcacgatctctcttggggagcttcagctgtggtagagaagacaggattcaggacaatctccagcatggccggcctccctctcctcctcaccctcctcactcactgtgcagggtcctgggcccagtctgtgctgactcacgcccaccctcagtgtccgtcgggacccccggnaggacggtctccatcttcgttgtcgtgggancagcctccgaggtacggtaaattagtttgtctactggtaccagcagcctaccccaagaaaccccggcccccaaagtcctcctacactctaagtacggaattgactccgagccgccctacgacgggactactcgtaccgtatttcccncgtggcttacgagttcctgggtcctcccgtccggccccttccgcggcccngtaccgngggtcggcccgttcccggggtacgaggtacgtggaggtccttaggggtaaattacgttacctggtacgtcgtaggttttgggactgtcccgtaggtcgtaggngggtcgggttacgtacgggttggtccggggnggacggacaggtcagcccgtcggngttaccncgccccgtaagg

SEQ ID NO: 311443 - DNA, 696 bp, Homo sapiens
  misc_feature: GZ8MTXP01ANTXI.25.36.D03.1.454.CMB.2.raw
  modified_base (208)..(208): a, c, t, g, unknown or other
  misc_feature (208)..(208): n is a, c, g, or t
  modified_base (237)..(237): a, c, t, g, unknown or other
  misc_feature (237)..(237): n is a, c, g, or t
  modified_base (652)..(652): a, c, t, g, unknown or other
  misc_feature (652)..(652): n is a, c, g, or t
tcagactgtacagtcacgaccggtgctcgatttagctgcgtcacgatctctcttggggagcttcagctgtggtagagaagacaggattcaggacaatctccagcatggccggcctccctctcctcctcaccctcctcactcactgtgcagggtcctgggcccagtctgtgctgactcagccaccctcagtgtcgtcgggacccccggnaggagggtctccatctcttgttctgggancagctccgacgtacggaaattagttgtctacgtggtaccagctaacgccgtaccccaaacggaaaccccggcccccccaaagccccttacccctactacttacctaataaggaattggacttaccgacgccggccccttaccggaaggggtactaaccgtggaaccccgtatttccgtctcggctacggtaagtccgtgggccctccgtcccggccccttccccggccaacgttccgacgggttcggggcccgttcccggggtacccggagggtaagttcgggacgggacctttaggaaatttacgttaaccggttggttcgtaccgttagggttttcgggaattccggcgttcggttctagggcggttcgggtcccggttaggggttcggttcgggacggggtacgggacccgnggttccgtcgtacccgtcgtaggacgccgaaccgaagggtcccc

SEQ ID NO: 311444 - DNA, 672 bp, Homo sapiens
  misc_feature: GZ8MTXP01B6CHG.25.36.D03.1.454.CMB.2.raw
  modified_base (189)..(189): a, c, t, g, unknown or other
  misc_feature (189)..(189): n is a, c, g, or t
  modified_base (212)..(212): a, c, t, g, unknown or other
  misc_feature (212)..(212): n is a, c, g, or t
  modified_base (242)..(242): a, c, t, g, unknown or other
  misc_feature (242)..(242): n is a, c, g, or t
  modified_base (286)..(286): a, c, t, g, unknown or other
  misc_feature (286)..(286): n is a, c, g, or t
tcagactgtacagtcacgaccggtgctcgatttagctgcgtcacgatctctcttggggagcttcagctgtggtagagaagacaggattcaggacaatctccagcatggccggcctccctctcctcctcaccctcctcactcactgtgcagggtcctgggcccagtctgtgctgactcacgcccaccctnagtgtccgtcggggacccccggnaggaggtcctccatctcttgttcgtgggancagcctaccgacgtacggtaaattaagtttgctacgtggtaccngcacgcctacccgaagaacccggcccccaagcctcctacattactagtaaggatggactcgacgtccgccctacgaacggtactacgtgacccgtattcctcgtcgggctacggtaacgtccgtcgggtcccttacccgtcccgggtcccttcccgacgggtcccaagtttccggacgggttccggggtcccgttacccggggccgagggtacgtgggacgtacctaagggtaactttacgttacttgggtcgtacgttagggtttgggactcggtacccgtaggttccgtgggtaacgtcggggttacccggtgggttcggtccggggaagggacgggacacggtcgtaccgaaccgttcgtacggacctcgaacccgtaaccgg

SEQ ID NO: 311445 - DNA, 566 bp, Homo sapiens
  misc_feature: GZ8MTXP01AHZV7.25.36.D03.1.454.CMB.2.raw
  modified_base (187)..(187): a, c, t, g, unknown or other
  misc_feature (187)..(187): n is a, c, g, or t
  modified_base (261)..(261): a, c, t, g, unknown or other
  misc_feature (261)..(261): n is a, c, g, or t
  modified_base (272)..(272): a, c, t, g, unknown or other
  misc_feature (272)..(272): n is a, c, g, or t
  modified_base (369)..(369): a, c, t, g, unknown or other
  misc_feature (369)..(369): n is a, c, g, or t
  modified_base (423)..(423): a, c, t, g, unknown or other
  misc_feature (423)..(423): n is a, c, g, or t
  modified_base (427)..(427): a, c, t, g, unknown or other
  misc_feature (427)..(427): n is a, c, g, or t
  modified_base (431)..(431): a, c, t, g, unknown or other
  misc_feature (431)..(431): n is a, c, g, or t
  modified_base (458)..(458): a, c, t, g, unknown or other
  misc_feature (458)..(458): n is a, c, g, or t
  modified_base (496)..(496): a, c, t, g, unknown or other
  misc_feature (496)..(496): n is a, c, g, or t
  modified_base (526)..(526): a, c, t, g, unknown or other
  misc_feature (526)..(526): n is a, c, g, or t
tcagactgtacagtcacgaccggtgctcgatttagctgcgtcacgatctctcttggggagctctgagagcggagccccagccccagaattcccaggtgttttcatttggtgatcagcactgaacacagaggactcaccatggagtttgggctgagcttgggttttccttgttgttattttccaggtntccagagtgaggtgcagttggtggagtcgtgggggagtcttggtccagcctgggagggtccgtgagagtctccngtgcagcctcnggattcatcttcagtgaccactacagtggactgggtccgcaggcctaccgagggggagggctggagtggggtgcccgtatagaataaagctaaaagngttaacacacagaactaccgcgcgtctagtagaaaggtcaagtattcgaattanctanaagnatgaattacgaaagacttcaactgtanctgaactaaatcgaaactacgccaaaggaaaaccccgngggaccaacgggtccgtaagttacttacgnggtgctaacgggtccaggaccgttaacgggttctaacccc

SEQ ID NO: 311446 - DNA, 668 bp, Homo sapiens
  misc_feature: GZ8MTXP01BNTM9.25.36.D03.1.454.CMB.2.raw
  modified_base (229)..(229): a, c, t, g, unknown or other
  misc_feature (229)..(229): n is a, c, g, or t
  modified_base (247)..(247): a, c, t, g, unknown or other
  misc_feature (247)..(247): n is a, c, g, or t
  modified_base (545)..(545): a, c, t, g, unknown or other
  misc_feature (545)..(545): n is a, c, g, or t
tcagactgtacagtcacgaccggtgctcgatttagctgcgtcacgatctctcttggggggggtctcaggaggcagcgctctcgggacgtctccaccatggcctgggctctgctgttcctcaccctcctcactcagggcacgagggtcctgggcccagtctgccctgactcagcctgcctccgtgtctgggactcctggacagtcgtcaccatctctgctactggaaccngccgtagactagttggtntacttataactatgtctcctcgtacccaaacaaccaccacggaccaacggacccccaatcatactatttatgatgtcaacgtctacgtccgtcctcgttacggtactttcccgtggttcgtcttccgtcgtacggccttcgtaacgtccgtcgggacctaaaccgttcccgggtaccccttcccgtacggtaccctacgttccggtccgggggtaccttacccggtaacgggcttacgggacggtaacggacggttacttaccgtttaagtttactgttacctatttaccatacaganaaccaactagtacttcgtgggtcgttacgggcgggtaacggacgtaaacggtcgttaacccgttcgttaccggaacgcccgtaaccgtaacgggtccttcccgtccccgttaacggttccccg

SEQ ID NO: 311447 - DNA, 679 bp, Homo sapiens
  misc_feature: GZ8MTXP01BSNH5.25.36.D03.1.454.CMB.2.raw
  modified_base (228)..(228): a, c, t, g, unknown or other
  misc_feature (228)..(228): n is a, c, g, or t
  modified_base (244)..(244): a, c, t, g, unknown or other
  misc_feature (244)..(244): n is a, c, g, or t
  modified_base (316)..(316): a, c, t, g, unknown or other
  misc_feature (316)..(316): n is a, c, g, or t
tcagactgtacagtcacgaccggtgctcgatttagctgcgtcacgatctctcttggggggggtctcaggaggcagcgctctcgggacgtctccaccatggcctgggctctgctgttcctcaccctcctcactcagggcacagggtcctgggcccagtctgccctgactcagcctgcctccgtgtctgggactcctggacagtcgtcaccatctcctgcactggaaccngccgtgactattggtntacttataactatgtctcctcggtacccaacaaccaccaggaccaacggacccccaaatccatactatttancgtatcgtcagtcagtccggccctcgtggtacgtttccgtggtcgtcttctcgtcgggtcctccgtaaagtccgtacggtacctaaccgtccgggtcccttccccgtcgaccctacgttcccggtccggggccttaccggacgggtcttacgggaacggacgacggtacttaactttagtttacggttgtacttaatttaccaacttaaccgaagacaacctaaccctaaagtacgttccgtggggttcgggttacgggaccggggtaacggttaaccgtaaggttcggttacccggttccgttaccgggtaacctaccggaacccgtaacggtccttccccggtccccgttcgggtaacccc

SEQ ID NO: 311448 - DNA, 615 bp, Homo sapiens
  misc_feature: GZ8MTXP01CWZSP.25.36.D03.1.454.CMB.2.raw
  modified_base (244)..(244): a, c, t, g, unknown or other
  misc_feature (244)..(244): n is a, c, g, or t
tcagactgtacagtcacgaccggtgctcgatttagctgcgtcacgatctctcttggggggggtctcaggaggcagcgctctcgggacgtctccaccatggcctgggctctgctgttccctcaccctcctcactcagggcacagggtcctgggcccagtctgccctgactcagcctgcctccgtgtctgggactcctggacagtcggtcaccatctctgcactggaaccagccgtgacattggtncttataactatgtctcctggtacccaacgaacacccaggccaacggcccccaaatcatcatttatgatgtcagtcacgtccggtccctgtgtagtttccgtggtcgtcttctcgtcgtcctccaagtctcgggactaaccgtcggccctccctcgacctacgtccggtcgggctcgagtccgtgacggacgtagcttacgttattagttgtacttatttacataacagaagaccaaccgtaagtacgtcgttggtaacgttcgggacggtacggaacccgtaaggttaccggttacccggttcccgttaccgggtcccgaccggaaccccgtaaacggtccgttccccggtccccccgttgggttcccccg

SEQ ID NO: 311449 - DNA, 719 bp, Homo sapiens
  misc_feature: GZ8MTXP01BYCR9.25.36.D03.1.454.CMB.2.raw
  modified_base (209)..(209): a, c, t, g, unknown or other
  misc_feature (209)..(209): n is a, c, g, or t
  modified_base (235)..(235): a, c, t, g, unknown or other
  misc_feature (235)..(235): n is a, c, g, or t
  modified_base (304)..(304): a, c, t, g, unknown or other
  misc_feature (304)..(304): n is a, c, g, or t
tcagactgtacagtcacgaccggtgctcgatttagctgcgtcacgatctctcttggggagcttcagctgtggtagagaagacaggattcaggacaatctccagcatggccggcctccctctcctcctcaccctcctcactcactgtgcagggtcctgggcccagtctgtgctgactcagcccaccctcagtgtcgtcgggacccccggnagaggtctccatctcttgtctgggancagctccgagtacggaaatagttgtctactggtaccagcagcctacccaagaaccgccccaagcctccncatctataggaatgatcacgccgcctacgacggactacgtgacccgtattcctcgtggacctacggaaacgttccgtcgggtccctcccgtcccgggtccccttcccgtcgggacccctagtccgtaacgggttccggggtcccgttccccggggtacccggaaggggtaccttaggggaacggttaccgttaagggggtaaacttttaacgtttaaccgtgggttcggtaacggttaagggttttgggggaacttcggaaccccgtaggttccgtgggtaacggttcggggttaccccgggtgggggttcgggttaccggggacgggggttaacgggttacccgaaagggtcccggtacgggtaacccccgttccggttacgggttcccgaaccgggttccccgtaaaccgggg

SEQ ID NO: 311450 - DNA, 656 bp, Homo sapiens
  misc_feature: GZ8MTXP01EAH7A.25.36.D03.1.454.CMB.2.raw
  modified_base (152)..(152): a, c, t, g, unknown or other
  misc_feature (152)..(152): n is a, c, g, or t
tcagactgtacagtcacgaccggtgctcgatttagctgcgtcacgatctctcttggggggggtctcaggaggcagcactctcgggacgtctccaccatggcctgggctctgctcctcctcagcctcctcactcagggcacaggatcccgggntcagtctgccctgactcacgcctcgctcagtcgtccggtctccgtggacagtcagtcacatctctgcactggaaccagaagtgattcgttggtgtcttatgacactgtctccgtggacctaccgtacgtttacccgaaggtaaaaccgcccccgagacgtctattcctttatgtattgtacgaggacgccggcccgtcggtaccgggtccctgactcgtccttactcgtgggtacctaaagtccgtacggacctaaccgaccggtccctacccgtgaccctactcgtccgtcgggaccttccggaggtccgtaggacggtataggtacggtcgttagttaagtttaagtttagttcggtccttggtttactaagttattacggacgtacggtaacctaaaactttccgttagggttttcggttacggttccggacgttacggttacggttaccgttaaggtccgtaacgtcccggtcggggttcccgtaaccgttcggtccccg

SEQ ID NO: 311451 - DNA, 589 bp, Homo sapiens
  misc_feature: GZ8MTXP01DXLNI.25.36.D03.1.454.CMB.2.raw
  modified_base (541)..(541): a, c, t, g, unknown or other
  misc_feature (541)..(541): n is a, c, g, or t
tcagactgtacagtcacgaccggtgctcgatttagctgcgtcacgatctctcttggggagcttcagctgtggtagagaagataggattcaggacaatctccagcatggccggcctccctctcctcctcaccctcctcactcactgtgcagggtcctgggcccagtctgtgctgactcagccaccctcagtgtcgtcgggaccccggcaggagggtcctccattctcttgttcgtgggagcagcctaccgacgtacggaaattaagtttgtctacgtggtaccagcagcctccccaagaaccggcccccaagcctcctcatctataggatgatcagcgcctcgacggactacgtgaccgtattcctcgtggctacgtaaacgttcctcggtcctccgttcccggcccttcccgtacggccagtccgaggtcgggccgtccgggtccgaggacgtggaaggtcttagggtaaattagtttactggtgcgtaggtttggactgtcctagtctggaaggttcggttccggtaggttggttcgggngggttacggcaagcgtcggaaccgtcgaggttcaacggcccgtaacgg

SEQ ID NO: 311452 - DNA, 641 bp, Homo sapiens
  misc_feature: GZ8MTXP01BOS2B.25.36.D03.1.454.CMB.2.raw
  modified_base (211)..(211): a, c, t, g, unknown or other
  misc_feature (211)..(211): n is a, c, g, or t
tcagactgtacagtcacgaccggtgctcgatttagctgcgtcacgatctctcttggggagcttcagctgtggtagagaagacaggattcaggacaatctccagcatggccggcctccctctcctcctcaccctcctcactcactgtgcagggtcctgggcccagtctgtgctgactcagcccaccctcagtgtccgtcgggacccccgggnaggagggtcctccatctcttgttctgggagcagcctccgacgtacggaaataagtttgtctactggtaccagcacgcctaccccaacggaaacccggcccccaagcctcctcatactagtacggaatgactcgaggccggccctacgacgggactaccgtacgaccgtacttcctcgtggcctacggagtccgtcggcctccgtccggccctcccgtggccagtcgaggtcgggcctccgggtccgaggtctggagtctaggaacttagttactgtcgcgttaggtttgggactcggtacctagtccgtggtaacgggttcggggttaccggtacgggttcggttccgggggacgggttaacggggacccttagggtccgtacgggtaacccgttcccggtaggcccgtaacggaaccccgtaaccgggg

SEQ ID NO: 311453 - DNA, 659 bp, Homo sapiens
  misc_feature: GZ8MTXP01CJAVV.25.36.D03.1.454.CMB.2.raw
  modified_base (227)..(227): a, c, t, g, unknown or other
  misc_feature (227)..(227): n is a, c, g, or t
  modified_base (244)..(244): a, c, t, g, unknown or other
  misc_feature (244)..(244): n is a, c, g, or t
tcagactgtacagtcacgaccggtgctcgatttagctgcgtcacgatctctcttggggggggtctcaggaggcagcgctctcgggacgtctccaccatggcctgggctctgctgttcctcaccctcctcactcagggcacagggtcctgggcccagtctgccctgactcagcctgcctccgtgtctgggactcctggacagtcggtcacatctctgcactggaaccngccgtgactagttggtntacttataacttatgtctcctggtacccaacaaccacccaggccaacggacccccaaactcatactatttatgatgtcagtcagtccggccctcgtggtagtttcccgtggttcgtctttctcgtcggtccctccgaaagtccgttgggcctaaccgtcccgggtccctccccttcgaccctacgttccgtcccgggggccttcccgacgggtcgtacggacgggaaccggaggtaccttaacgtttaatttaacgttgtaccttaacttttacaacgttaaccaaggtaacaacctaaccaaactagtccgttgggttcggttcggggacgggaacgggttaccgtaaaggttcgacccgttccgttaccgggtcacggcccaacgggtccgcccgtcccccgttcgggtcccc

SEQ ID NO: 311454 - DNA, 738 bp, Homo sapiens
  misc_feature: GZ8MTXP01D3LVX.25.36.D03.1.454.CMB.2.raw
  modified_base (189)..(189): a, c, t, g, unknown or other
  misc_feature (189)..(189): n is a, c, g, or t
  modified_base (211)..(211): a, c, t, g, unknown or other
  misc_feature (211)..(211): n is a, c, g, or t
  modified_base (244)..(244): a, c, t, g, unknown or other
  misc_feature (244)..(244): n is a, c, g, or t
  modified_base (425)..(425): a, c, t, g, unknown or other
  misc_feature (425)..(425): n is a, c, g, or t
tcagactgtacagtcacgaccggtgctcgatttagctgcgtcacgatctctcttggggagcttcagctgtggtagagaagacaggattcaggacaatctccagcatggccggcctccctctcctcctcaccctcctcactcactgtgcagggtcctgggcccagtctgtgctgactcacgcccaccctnagtgtcgtccgggacccccggnaggacggtcctccattcttcttgttcgtgggancagccgtaccgacggtacggaaaattagtttgtactacgtcggtacccagccacgcctaccccgaaaggaaaccccggcccccaaagtcccctacctactaattactaaagttaacggaaatttcgaactaccgaacggcccggaccctacggaacgggaccttaaccgtgtaacccgttnttcccgtcgtcggtacctaacgggtacgttccgtccgggtcccttcccgtccggtaccccttccgtcggacctacgttccggtacgggttccgggtcccgttacccggggtacgaggtacgtacggacgtacgttaaggttaaactttacgtttacgtggttacgtcgttagggtttacggaacgtcgtaccgtaggttccgtagggtaacgggttccgggttaccggtacgggttcggtacggggaacggttaacggaccacggtccgtacgtccggttacgtacggttaccgtaacggttaacccgtaagg

SEQ ID NO: 311455 - DNA, 724 bp, Homo sapiens
  misc_feature: GZ8MTXP01AJ97Y.25.36.D03.1.454.CMB.2.raw
  modified_base (212)..(212): a, c, t, g, unknown or other
  misc_feature (212)..(212): n is a, c, g, or t
  modified_base (240)..(240): a, c, t, g, unknown or other
  misc_feature (240)..(240): n is a, c, g, or t
tcagactgtacagtcacgaccggtgctcgatttagctgcgtcacgatctctcttggggagcttcagctgtggtagagaagacaggattcaggacaatctccagcatggtcggcctccctctcctcctcaccctcctcactcactgtgcagggtcctgggcccagtctgtgctgactcacgcccaccctcagtgtccgtcggggacccccggnagagggtctccatctcttgtcgtgggancagctccgacgtacggaaattaagtttgtctacgtggtaccagcacgcctacccgaacggaaacccggcccccaagcctcctcatactaagtacggaatgactcgacgcccggcccctagaaccgggtactaccgtaggtaacccgtattcctcgtcgggtacctaccgggtaacgttccgtcggggtccccttccccgttcccgggtccccttaccccgtcgggtcccaacggttcccggaaggggttcccggggtcccgttaccccggggtacccggaagggaagttcgggaagggtaccttaaggggtaaacttcgtttacgtgggtcggtaccgttaggtttaggggacttcggaccctagggttccgtagggtaacgggtcggggttacccggtcggggttcggttaccgggggacgggaacggaccgacggtcgtacggaaccccggttacgtacgggacaaccggcccggtaacggg

SEQ ID NO: 311456 - DNA, 710 bp, Homo sapiens
  misc_feature: GZ8MTXP01DXTVK.25.36.D03.1.454.CMB.2.raw
  modified_base (227)..(227): a, c, t, g, unknown or other
  misc_feature (227)..(227): n is a, c, g, or t
  modified_base (244)..(244): a, c, t, g, unknown or other
  misc_feature (244)..(244): n is a, c, g, or t
tcagactgtacagtcacgaccggtgctcgatttagctgcgtcacgatctctcttggggggggtctcaggaggcagcgctctcgggacgtctccaccatggcctgggctctgctgttcctcaccctcctcactcagggcacagggtcctgggcccagtctgccctgactcagcctgcctccgtgtctgggactcctggacagtcgtcaccatctctgcactggaaccngccgtgactattgggtntcttataactatgtctcctcggtacccaacaaccacccaggaccaacggacccccaaactcatctatttatagatgtcagtcactccgccctgtggtacgtttccgtcggtcgtcttctcgtcgggtcctccgaaagtcgttcgggacctaaccgtccgggtcccttcccgtacgaccctacgtccggtccgggggtccttcccgaggtcgtacggacgggtacgacggtactttaacgttagtttaacgttcgtacttactttactaacttaacgaacggtacgaaaccctaacctaaacgtacggttcgttcggggttaacgggtttaccggggaccgggggtaacgggttaaccgtaaacgggttcccggttaaccccggttcccggttacccgggttaaccgacccggaaccccggttaacgggccccgttccccggtcccccccgttcgggttaacccccg

SEQ ID NO: 311457 - DNA, 544 bp, Homo sapiens
  misc_feature: GZ8MTXP01CHPR3.25.36.D03.1.454.CMB.2.raw
  modified_base (309)..(309): a, c, t, g, unknown or other
  misc_feature (309)..(309): n is a, c, g, or t
  modified_base (354)..(354): a, c, t, g, unknown or other
  misc_feature (354)..(354): n is a, c, g, or t
  modified_base (372)..(372): a, c, t, g, unknown or other
  misc_feature (372)..(372): n is a, c, g, or t
  modified_base (383)..(383): a, c, t, g, unknown or other
  misc_feature (383)..(383): n is a, c, g, or t
  modified_base (461)..(461): a, c, t, g, unknown or other
  misc_feature (461)..(461): n is a, c, g, or t
  modified_base (519)..(519): a, c, t, g, unknown or other
  misc_feature (519)..(519): n is a, c, g, or t
tcagactgtacagtcacgaccggtgctcgatttagctgcgtcacgatctctcttggggagctctgggagaggagcccagcactagaagtcggcggtgtttccattcggtgatcagcactgaacacagaggactcaccatggagtttgggctgagctgggttttcctcgttgctcttttaagaggtgtccactgtcaggtgcacctggtggagtcgtgggggagcgtggtccagcctgggagtccctgagactctcctgtgaagcctctggtatttagttcagtggttctggcatgcacgtggggtcccnccgaggcctccgagggcaagggggccgaggtggttggctagttangcacatgatggaaagttntagaatattangcagactcgtgaagggccgattcacatcaccagacgactaagttcccgggaatgttgtaggtacttggaaatggtacngtacctggagaggtcgaaggttctcggctcgttagttacgttcgttgtaagcgtaagnggtcggggaggtggttaagttaagg

SEQ ID NO: 311458 - DNA, 605 bp, Homo sapiens
  misc_feature: GZ8MTXP01BXFX7.25.36.D03.1.454.CMB.2.raw
  modified_base (358)..(358): a, c, t, g, unknown or other
  misc_feature (358)..(358): n is a, c, g, or t
tcagactgtacagtcacgaccggtgctcgatttagctgcgtcacgatctctcttggggacccaaaaaccacacccctccttgggagaatcccctagatcacagctcctcaccatggactggacctggagcatccttttcttggtggcagcagcaacaggtgcccactcccaggttcaactggtgcagtctggacctgaggtgaagaagcctggggcctcagtgaaggtctcctgcaaggcttctggttacacctttagcagctatggcatcagctgggtgcgacgacggcccctggacaaggggcttggagtggatggcagtggatcagtccttaaacatcggtatcaacagactaangcagaggtaacttccgagggcagtacgtctacgttcgaccacacgacacgactaccacgagacacgagacccttacgacgtacggtaccctaggacgggacgcccgttagacgtactcgtacggaaccgacgtaaccgggtccgttaaagttaacgttaaccgtggtacggacgggttaacggttacggttaaccgtagtttaacgttcggtaccgtttaaccgtcccggggttcgttaacccccgg

SEQ ID NO: 311459 - DNA, 738 bp, Homo sapiens
  misc_feature: GZ8MTXP01ADRG1.25.36.D03.1.454.CMB.2.raw
  modified_base (244)..(244): a, c, t, g, unknown or other
  misc_feature (244)..(244): n is a, c, g, or t
  modified_base (389)..(389): a, c, t, g, unknown or other
  misc_feature (389)..(389): n is a, c, g, or t
tcagactgtacagtcacgaccggtgctcgatttagctgcgtcacgatctctcttggggagcttcagctgtggtagagaagacaggattcaggacaatctccagcatggccggcctccctctcctcctcaccctcctcactcactgtgcagggtcctgggcccagtctgtgctgactcacgcccaccctcagtcgtcgtcggggacccccggcaggacgggtcctccatctcttgttcgtgggancagctccgacgtacggtaaattagttgtactacgtcggtaccagcacgcctacccgaacggaaaccccggcccccaaagtcctcctacatactaagtaaggtaatgactcacggccgcctacgaacgggactcgtacggaacctnttccgtcgtaacggtcctacggtaaacggttccgtcgggtccccttcccgtccccgggtccccttaccccggtcgggtacccctaacgttccgtaaggggttccgggggtaccccttccccgggggtacccgaacggggttagttacgggacgggtaccttaagggtaaacgttttagttaaccggttagggtcgttaccgttaggggttttcgaacgttccgaccgtagttccgtagggtaaggttcggggttaaacccggtgggttcgggttacggggacgggttaaccgggacaacgggttcgacccgtaaccgttcggaacgggttcctaaccggccgtaaccgg

SEQ ID NO: 311460 - DNA, 605 bp, Homo sapiens
  misc_feature: GZ8MTXP01B53CE.25.36.D03.1.454.CMB.2.raw
  modified_base (244)..(244): a, c, t, g, unknown or other
  misc_feature (244)..(244): n is a, c, g, or t
  modified_base (313)..(313): a, c, t, g, unknown or other
  misc_feature (313)..(313): n is a, c, g, or t
tcagactgtacagtcacgaccggtgctcgatttagctgcgtcacgatctctcttgggggggtctcaggaggcagcgctctcgggacgtctccaccatggcctgggctctgctgttcctcaccctcctcactcagggcacagggtcctgggcccagtctgccctgactcagcctgcctccgtgtctgggactcctggacagtcggtcaccatctcctgcactggaaccagccgtgacattgggtncttataactatcgtctcctgtacccaacaacaccaggcaacggaccccaaatcatctatttatgatgtnagtcatcgcctctgtagttcgtggtcgtcttctctcgtctctaacgtcgtcgacaacgtccggtccctccctcgtaccactcgtcgggccgtccgacggcgtgaggacggacggtacgtaacttaatttagtttagtctatttactactaacacgaacgaacaacctaaaccaacgtacgtggttggttcgggttcgggtacgggaccggtaaacggttacggttaccggttcccgttccggtaaccgtacgaacccgaaccggtaccgttaccgtccccgttcccggtccg

SEQ ID NO: 311461 - DNA, 795 bp, Homo sapiens
  misc_feature: GZ8MTXP01DLGL3.25.36.D03.1.454.CMB.2.raw
  modified_base (225)..(225): a, c, t, g, unknown or other
  misc_feature (225)..(225): n is a, c, g, or t
  modified_base (242)..(242): a, c, t, g, unknown or other
  misc_feature (242)..(242): n is a, c, g, or t
  modified_base (307)..(307): a, c, t, g, unknown or other
  misc_feature (307)..(307): n is a, c, g, or t
tcagactgtacagtcacgaccggtgctcgatttagctgcgtcacgatctctcttggggggggtctcaggaggcagcgctctcgggacgtctccaccatggcctgggctctgctgttcctcaccctcctcactcagggcacagggtcctgggcccagtctgccctgactcagcctgcctccgtgtctggactcctggacagtcgtcacatctctgcactggaaccngccgtgactagttggtntacttataactatgtctcctgtacccaacaacacccaggacaacggcccccaaatcatcatttangatgtcagtcactcggcctcgtggtagtttccgtggtcgtctttctcctgggtcctccgaaagtccgtacgggcctaaccgtccgggtcccttaccccgtcgtacccgtacgttccggtccgggggcccttacccgaagggtcccttagggaacgggaccggtaacgggtacctttaaaccgttttaacgtttaaacgttttcggtaccttttaaactttttacccgaaactttaaaccgtaacggtaaacggtaaaccccaaacccctaaaaccgtaacggtttaacccgtttaaggggttaaccggggttttaaccgggggaccgggggttaaacggggttaaacccgttaaaacggggtttttcccggaaacccccgggttttcccggttacccggggtttaacccgtaaacccgggaacccccggttaaacgggggaccccttacccgggtcccccccccggtttaacggggtttaaccccccg

SEQ ID NO: 311462 - DNA, 655 bp, Homo sapiens
  misc_feature: GZ8MTXP01AC7UT.25.36.D03.1.454.CMB.2.raw
  modified_base (246)..(246): a, c, t, g, unknown or other
  misc_feature (246)..(246): n is a, c, g, or t
tcagactgtacagtcacgaccggtgctcgatttagctgcgtcacgatctctcttggggggggtctcaggaggcagcgctctcgggacgtctccaccatggcctgggctctgctgttcctcaccctcctcactcagggcacagggtcctgggcccagtctgccctgactcagcctgcctccgtgtctgggactcctggacaggtccgtcaccatctcctgcactggaaccagccgtgactagttggntcttaataactatgtctcctggtacccaacaacacccaggaccaacggacccccaaatcatcatttatgatgtacagtcagtccggccctgtcggtagtttcccgtggttcgtctttcctcgtgggccctccgaagtccgtgggaccctaaccgtcgggccccttccccgtacgaccctacgttccggtcccgggggtccttacccgaagggtccgttaggacggggaaccgtacgggtaccttaacgtttaactttaagttcgtacttatttaccctaaagtaccagaaataccaacctaacgtagtccgtgggtggttaccgggacgggtacggaccgtagttaccggacccgttccggttaccgtcgacgcccgacggcccgttaccggtccccgttcggtaaccc

SEQ ID NO: 311463 - DNA, 619 bp, Homo sapiens
  misc_feature: GZ8MTXP01BV7NS.25.36.D03.1.454.CMB.2.raw
  modified_base (303)..(303): a, c, t, g, unknown or other
  misc_feature (303)..(303): n is a, c, g, or t
tcagactgtacagtcacgaccggtgctcgatttagctgcgtcacgatctctcttggggctgggagacgagcccagcactggaagtcgccggtgttgccattcggtgatcagcactgaacacagaggactcaccatggagtttgggctgagctgggttttcctcgttgctcttttaagaggtgtccagtgtcaggtgcagctggtgcagtcgtgggggagcgtggtccaccgtgggagtccctgagactctcctgtgcagcctctggattcatcttcaacactatgacaatgcacgtgggtccncagggctcgaggcaagggggctgggacggtggggtgctagtttatttacattgtgaactagggaaacttaaagtaaaaagtgtagttagacgtccggtgggcgggtcgattaccacgtctaccagagacagactaccggaagaagacggtgtactcctacaaatccaaactaaccgtgaacgacgtaacccggaaggttaccgaaccggggttcgttacggttaacgtttaacgttcgttacgggttaacgggaccgggtaacgggtaacgggtaccggggttccgggggtaaccgggttaaccgggtaaccgggg

SEQ ID NO: 311464 - DNA, 643 bp, Homo sapiens
  misc_feature: GZ8MTXP01EZTY0.25.36.D03.1.454.CMB.2.raw
  modified_base (207)..(207): a, c, t, g, unknown or other
  misc_feature (207)..(207): n is a, c, g, or t
  modified_base (234)..(234): a, c, t, g, unknown or other
  misc_feature (234)..(234): n is a, c, g, or t
  modified_base (256)..(256): a, c, t, g, unknown or other
  misc_feature (256)..(256): n is a, c, g, or t
  modified_base (268)..(268): a, c, t, g, unknown or other
  misc_feature (268)..(268): n is a, c, g, or t
tcagactgtacagtcacgaccggtgctcgatttagctgcgtcacgatctctcttggggagcttcagctgtggtagagaagacaggattcaggacaatctccagcatggccggcctccctctcctcctcaccctcctcactcactgtgcagggtcctgggcccagtctgtgctgactcagccaccctcagtgtctcgggacccccggnagagggtctccatctcttgtctgggancagctcgacgtcggaatagttntcactggtaccngcagcctacccagaaaccggcccccaagcctcctcatctatagaatgatcagccgcctcgacgggactacctgaccgtattctcgtggctacggaagttcctgggtccctccgtccggcccttcccgcggccactccgagggttcgggacccgttcccgggtaccggagggacgtggaagggtccgttaggggaaactttacgttaaccgtggtacgtccgttaagggttttggggaacttcggcccgtaggttccgtggtaacggttcggggttacccgggtacgggtttcgggttccggggacggggaacgggacccgaaggtccgtacggtaacccgttcccgtagggttacccaacggccccgtaaccggg

SEQ ID NO: 311465 - DNA, 547 bp, Homo sapiens
  misc_feature: GZ8MTXP01BNWTN.25.36.D03.1.454.CMB.2.raw
  modified_base (229)..(229): a, c, t, g, unknown or other
  misc_feature (229)..(229): n is a, c, g, or t
  modified_base (247)..(247): a, c, t, g, unknown or other
  misc_feature (247)..(247): n is a, c, g, or t
  modified_base (296)..(296): a, c, t, g, unknown or other
  misc_feature (296)..(296): n is a, c, g, or t
  modified_base (452)..(452): a, c, t, g, unknown or other
  misc_feature (452)..(452): n is a, c, g, or t
  modified_base (456)..(456): a, c, t, g, unknown or other
  misc_feature (456)..(456): n is a, c, g, or t
  modified_base (468)..(468): a, c, t, g, unknown or other
  misc_feature (468)..(468): n is a, c, g, or t
tcagactgtacagtcacgaccggtgctcgatttagctgcgtcacgatctctcgttggggggggtctcaggaggcagcgctctcgggacgtctccaccatggcctgggctctgctgttcctcaccctcctcactcagggcacagggtcctgggcccagtctgccctgactcagcctgcctccgtgtctgggactcctggacagtcgtcaccatctcctgcactggaaccngccgtgactagttgggtntacttataactatgtctcctgtcccaacacaccagcaacggcccccaancatctatttatgatgtcagtcagtccgccctctggtacgtttcctggtcgtcttctctcggctcaagtctggcctaaccgtccggcctccctgacctgtccgcggggctcgaggctggacggacgagcttacgttattagtcgtctatttcatacngtanacactaatgtcnggtcgtcggcggtacggactaagtcgacccgttcgttccggtcacgcccgaacggtccttcccgtccccgttcggtccc

SEQ ID NO: 311466 - DNA, 654 bp, Homo sapiens
  misc_feature: GZ8MTXP01DTSHV.25.36.D03.1.454.CMB.2.raw
  modified_base (208)..(208): a, c, t, g, unknown or other
  misc_feature (208)..(208): n is a, c, g, or t
  modified_base (223)..(223): a, c, t, g, unknown or other
  misc_feature (223)..(223): n is a, c, g, or t
  modified_base (235)..(235): a, c, t, g, unknown or other
  misc_feature (235)..(235): n is a, c, g, or t
tcagactgtacagtcacgaccggtgctcgatttagctgcgtcacgatctctcttggggagcttcagctgtggtagagaagacaggattcaggacaatctccagcatggccggcctccctctcctcctcaccctcctcactcactgtgcagggtcctgggcccagtctgtgctgactcacgccaccctcagtgtcgtcgggaccccggnagaggtctccatctnttgtcgtgggancagctccgacgtacggaaattaagttgtctacgtggtaccagcacgcctacccaagaacccgccccaagcctcctacatctataggaatgatcacgcgccctcgacggactacgtgacctattcctcgtgggcctaggtaacgtcgtcggtccctccgtcccggccctcccgtggcctacgtcgaggtccggggcccgtccgggtaccggtaggacgtaggacggtacgtagggtaaatttagttacgttcggtggtaccgttagggtttacggggactcggtcccgtaagttccgtgggtaacggtttcggggttaccgggtcggggtttcgggttaccggggacgggttaacgggaccgttaacggccggttacggcccgttaccggtaggttacccgaacggttcccgtaaccggg

SEQ ID NO: 311467 - DNA, 642 bp, Homo sapiens
  misc_feature: GZ8MTXP01A9ZOD.25.36.D03.1.454.CMB.2.raw
  modified_base (287)..(287): a, c, t, g, unknown or other
  misc_feature (287)..(287): n is a, c, g, or t
  modified_base (315)..(315): a, c, t, g, unknown or other
  misc_feature (315)..(315): n is a, c, g, or t
  modified_base (565)..(565): a, c, t, g, unknown or other
  misc_feature (565)..(565): n is a, c, g, or t
tcagactgtacagtcacgaccggtgctcgatttagctgcgtcacgatctctcttggggagctctgagagcggagccccagccccagaattcccaggtgttttcatttggtgatcagcactgaacacagaggactcaccatggagtttgggctgagcttgggttttccttgttgttattttagaaggtgtccagtgtgaggtgcagttggaggagtcgtgggggagtcgttggtccgaggccggggggtcctggagctctcctgtgcagcctctggtatctagtttanctagtatttggatgagtcgtggggtccnccgacgggccccgagggggagggcgtgggtggtgggggtacaccaaacagtaacgaaccggaagagtagggaggtagaaaacgaaatctagtggaccggtactcgtagggtagggaaacgggcccgtaattccaacctagtacccgtaccgaacgggaaccaaacctacccaaacaacttacgaattatacgtctagaacctaaagtgtaaagtggttacaggaagtacggaccgaaggtcaacgggttnttagtagtttcgttcgtgttacggcgacgtaacggtacccgaacccgtactaccgttacgtaaccgttaaccgtaag

SEQ ID NO: 311468 - DNA, 751 bp, Homo sapiens
  misc_feature: GZ8MTXP01CMHEO.25.36.D03.1.454.CMB.2.raw
  modified_base (248)..(248): a, c, t, g, unknown or other
  misc_feature (248)..(248): n is a, c, g, or t
  modified_base (343)..(343): a, c, t, g, unknown or other
  misc_feature (343)..(343): n is a, c, g, or t
tcagactgtacagtcacgaccggtgctcgatttagctgcgtcacgatctctcgttggggggggtctcaggaggcagcgctctcgggacgtctccaccatggcctgggctctgctgttcctcaccctcctcactcagggcacgagggtcctgggcccagtctgccctgactcagcctgcctcgtgtctggactccgtggacagtcgtcacatctcctgcacgtggaaccagccgtagactagtttgggntactttaataacttatcgttctcccgtacggtacccaaacaaaccaacccgaaggaccaaaccggtacccccaaaactcaactactaagtttaangtaatcgtacacgtcacgtccggcctcgtggtacgtttccgtcggttctctttctcgtaggtaccctctaaacgttcgtacgggacctaaccgtcccgggtccccttaccccgtacgtaaccctacgttcccgggtaccggggccttcccggaaagggttcccgtagggggtaaaccgggaacccggtaaagggttacccttaaacgtttttaagtttagtttacccggtactttaattttaccggaaacgttaaacgaacgaaacgtaaaccgtaaaccgtaaaccgtaacggttacggttcgggttaacgggttacgggttacggggtaacgggttaacggtaacggtacgttaccgttccgttacggtaacgacgaaccgacgtcgttccgtcccgttccgtccg

SEQ ID NO: 311469 - DNA, 782 bp, Homo sapiens
  misc_feature: GZ8MTXP01C0B69.25.36.D03.1.454.CMB.2.raw
  modified_base (265)..(265): a, c, t, g, unknown or other
  misc_feature (265)..(265): n is a, c, g, or t
tcagactgtacagtcacgaccggtgctcgatttagctgcgtcacgatctctcttggggggggtctcaggaggcagcgctctcgggacgtctccaccatggcctgggctctgctgttcctcaccctcctcactcagggcacagggtcctgggcccagtctgccctgactcagcctgcctccgtgtctgggactcctggacagtcggtcaccatctctgcacgtggaaccagccgtgacattggtgtcttaataactatcgtctccncgtacccaacaacaccagacaacgaccccaatcatcatttatgatgtacagtcacgtccggccctacgtggtacgtttcccgtggtcgtcttccgtcttcgggtccttccgaaacgttccgtacggggtacctaaccgtcccgggtaccccttaccccgtacgtaaacccgtcggttcccggtaccgggggtcccttacccggaaggggtcccgttaggggaaaccggggtacggtaaaccgggttaacctttaaaccgttttaattttaacggtttacggtaacttttaacgtttttacccaaaacgtttaacccgaaaggtaaccggtaaaccctaaaccgtaaaaaccgttcggttacccggttaggggtttccgggtttacggggaaacggggtaaacggggttaaaccccgttaaacgggttcccgttaaaccccgttccggttaccgggttaaccgaaaccggtaaccccggaagggttccccgttaccggtcccccgttaaccgttcccg

SEQ ID NO: 311470 - DNA, 731 bp, Homo sapiens
  misc_feature: GZ8MTXP01DT4NE.25.36.D03.1.454.CMB.2.raw
tcagactgtacagtcacgaccggtgctcgatttagctgcgtcacgatctctcttggggacccaaaaaccacacccctccttgggagaatcccctagatcacagctcctcaccatggactggacctggagcattccttttcttggtggcagcagcaacaggtgcccactcccaggttcaactggtgcagtctggacctgaggtgaagagccgtgggctgagtgaaggtctcctgacaaggtcttcgtggttactacctttagcagtctagtggcatcgagtcgtgggtgcgacgtacggccccgtggaacgaagggtcttggaggtggatggacagtggactcgacgtaccttaaacgagttcggtatacaacgaagtacctaagtcgaacaaacgtaaacgggtaaactttcccggaaggggtacaaagggtaaccgttaccgtaaacccgtttaccggaaacccgaacaacggaaacctaaccaaccgttaaccccgaacgggaaaccgacccgttaaaccaaccgtaccccttaaacggtaacgtaaccggggtaacccgttagggaaacggaaccgtcccggttaaggaacgtaccgttagtaccggaaaccgtaaccggtaaccgggtaaccgtttaattaacgtttaccgtaggtcggacgttaggttaccggttaattaatttaacgttcgtaccgtttacggttcccggttcgtttaaccccgg

SEQ ID NO: 311471 - DNA, 656 bp, Homo sapiens
  misc_feature: GZ8MTXP01D032J.25.36.D03.1.454.CMB.2.raw
  modified_base (271)..(271): a, c, t, g, unknown or other
  misc_feature (271)..(271): n is a, c, g, or t
  modified_base (508)..(508): a, c, t, g, unknown or other
  misc_feature (508)..(508): n is a, c, g, or t
  modified_base (592)..(592): a, c, t, g, unknown or other
  misc_feature (592)..(592): n is a, c, g, or t
  modified_base (621)..(621): a, c, t, g, unknown or other
  misc_feature (621)..(621): n is a, c, g, or t
  modified_base (650)..(650): a, c, t, g, unknown or other
  misc_feature (650)..(650): n is a, c, g, or t
tcagactgtacagtcacgaccggtgctcgatttagctgcgtcacgatctctcttggggagctctgagagcggagccccagccccagaattcccaggtgttttcatttggtgatcagcactgaacacagaggactcaccatggagtttgggctgagcttgggttttccttgttgttattttccaggtgtccagagtgaggtgcagttggtggagtcgtgggggagcttggtccagccgtgggagggtccgtgagagtctctgtgcagcctcnggattcatcttcagtcgaccactacagtcggacgtcggggtcccgccgagggcctaccggaagggggaacgggggcgttaggggaggttgggggttcggaccccgttaagttaaagaaaagtaaagccgttaaaaaagtacgtttaaccgaaacccaaacgaaaggtaaactacccggccggtcgttactagggttaagaaaacgggtcaaaggtactttactaatttactcctaanaaaggatatagaattaccgaaaagtactcaacgttgtaatctagaaactaaagtacggaaacacggccctaaaaggaaaaccgnggaaaccacgggtccttagttaacttcgngtcgacgtaaggtcaggttacttcggttntaaccc

SEQ ID NO: 311472 - DNA, 605 bp, Homo sapiens
  misc_feature: GZ8MTXP01B3BGM.25.36.D03.1.454.CMB.2.raw
  modified_base (269)..(269): a, c, t, g, unknown or other
  misc_feature (269)..(269): n is a, c, g, or t
  modified_base (311)..(311): a, c, t, g, unknown or other
  misc_feature (311)..(311): n is a, c, g, or t
  modified_base (356)..(356): a, c, t, g, unknown or other
  misc_feature (356)..(356): n is a, c, g, or t
  modified_base (519)..(519): a, c, t, g, unknown or other
  misc_feature (519)..(519): n is a, c, g, or t
  modified_base (558)..(558): a, c, t, g, unknown or other
  misc_feature (558)..(558): n is a, c, g, or t
tcagactgtacagtcacgaccggtgctcgatttagctgcgtcacgatctctcttggggagctctgggagaggagcccagcactagaagtcggcggtgtttccattcggtgatcagcactgaacacagaggactcaccatggagtttgggctgagctgggttttcctcgttgcttcttttaagaggtgtccactgtcaggtgcacctggtggagtcgtgggggaggcgtggtccagccgtgggagtccctgagactctctgtgaagcctnggtatttgttcagtggttctggcagtgctacgtggggtcccnccgaggcctccgagggcgaagggggccgaggtggtggctagttanagcacagtagaagttcggaagtttctagtaattagttatcgactaagtacgttccggaggacgggtcctaattaccgacctataccgtaccgaagacgtaactaacgttaccccggggaaatgttgtacgtaacgttggaaatcggtacagtccgtaggacgnggtaacggacgttacgttcggcttcgtgttaacgttcgnggtggcgtaaggtacggtcggggttagggttggttaacggtttaagg

SEQ ID NO: 311473 - DNA, 659 bp, Homo sapiens
  misc_feature: GZ8MTXP01DOWNH.25.36.D03.1.454.CMB.2.raw
tcagactgtacagtcacgaccggtgctcgatttagctgcgtcacgatctctcttggggggggtctcaggaggcagcactctcgggacgtctccaccatggcctgggctctgctcctcctcagcctcctcactcagggcacaggatcccgggctcagtctgccctgactcagcctcgctcagtgtccggtctcctggacagtcagtcacatctcctgcactggaaccagaagtgattcgttggtgtcttatgacactgtctcctggcacctacgtttaccaaggaaacgcccccagacgtcacttcctttatgtatgtacgaggaacgccggcctcgtaccgggtccctgacgtccgtcttccgtcgtcgggtacctaaactcgtacggaccaaccgaccgggtccctcccgtacgaaccctctccgtcgtcgggtccttaccgacggtcctaggaggtgtaggacggtcttagttaatttattagttcgtccttgttactaaatgttacgacgtaacgggtacctaaaccgttacgtttaggtttttcgggttcggtttaccgggcggttaaccggttaacggggttaaacccgtaaagggtttccgtaacccggtttccggtacgggttaccgaacccggttccccggtaaacccggg

SEQ ID NO: 311474 - DNA, 611 bp, Homo sapiens
  misc_feature: GZ8MTXP01BF5QV.25.36.D03.1.454.CMB.2.raw
  modified_base (284)..(284): a, c, t, g, unknown or other
  misc_feature (284)..(284): n is a, c, g, or t
  modified_base (351)..(351): a, c, t, g, unknown or other
  misc_feature (351)..(351): n is a, c, g, or t
  modified_base (362)..(362): a, c, t, g, unknown or other
  misc_feature (362)..(362): n is a, c, g, or t
tcagactgtacagttcacgaccggtgctcgatttagctgcgtcacgatctctcttggggacccaaaaaccacacccctccttgggagaatcccctagatcacagctcctcaccatggactggacctggagcatccttttcttggtggcagcagcaacaggtgcccactcccaggttcaactggtgcagtctggacctgaggtgaagaagccgtgggggcctcgagtgaaggttctcctgcaaggcttctggttacactttagcagctatggcatcagctgggtncgacgacggcccctagggaccaaggggtctttggagtggatgggcagtggatcagtccttaaaccgntcggtatcganagactaatgcacgaggaacttccgagggcagacgtccacgttcaaccgacagaccaactacacccgacgacgacaaccgtagaccctaacggacgtacgggtaccgagggaaccggaacgccgttaggaacggtacttaccgtacggaacccgacgtaaccgggtacccgttaaagttacttaccgttgggacgcggttaagttacggtaacgtattaagtcgtaccttacgtccggttaacgtccccg

SEQ ID NO: 311475 - DNA, 567 bp, Homo sapiens
  misc_feature: GZ8MTXP01BQQMD.25.36.D03.1.454.CMB.2.raw
  modified_base (360)..(360): a, c, t, g, unknown or other
  misc_feature (360)..(360): n is a, c, g, or t
  modified_base (390)..(390): a, c, t, g, unknown or other
  misc_feature (390)..(390): n is a, c, g, or t
  modified_base (407)..(407): a, c, t, g, unknown or other
  misc_feature (407)..(407): n is a, c, g, or t
tcagactgtacagtcacgaccggtgctcgatttagctgcgtcacgatctctcttggggacccaaaaaccacacccctccttgggagaatcccctagatcacagctcctcaccatggactggacctggagcatccttttctggtggcagcagcaacaggtgcccactcccaggttcaactggtgcagtctggacctgaggtgaagaagcctgggcctcagtgaaggtctctgcaggtcttcgtggttacacctttagcagctagtggcatcagcgtgggtgcgacacggcccctggacgaagggtctggagtggatggcagtggatcagtacctacagtggtactcacagactaatgcganaggaattccgaggcagagtcactcgaacanagacacgactacacganacaacacgacctagagtcggaccgtaggacgggaacgccgtagagtacgtacgtcggaaccgaacggaaccggtaccgttaattaacgttccgtaggtacgacggttaggttacgttcgtagttaagtcggtaccttaggtcccgttaacgttaaccccg

SEQ ID NO: 311476 - DNA, 746 bp, Homo sapiens
  misc_feature: GZ8MTXP01DXRTL.25.36.D03.1.454.CMB.2.raw
  modified_base (202)..(202): a, c, t, g, unknown or other
  misc_feature (202)..(202): n is a, c, g, or t
  modified_base (212)..(212): a, c, t, g, unknown or other
  misc_feature (212)..(212): n is a, c, g, or t
  modified_base (218)..(218): a, c, t, g, unknown or other
  misc_feature (218)..(218): n is a, c, g, or t
  modified_base (230)..(230): a, c, t, g, unknown or other
  misc_feature (230)..(230): n is a, c, g, or t
  modified_base (238)..(238): a, c, t, g, unknown or other
  misc_feature (238)..(238): n is a, c, g, or t
  modified_base (243)..(243): a, c, t, g, unknown or other
  misc_feature (243)..(243): n is a, c, g, or t
tcagactgtacagtcacgaccggtgctcgatttagctgcgtcacgatctctcttgggggggggtctcaggaggcagcgctctcgggacgtctccaccatggcctgggctctgctgttcctcaccctcctcactcagggcacagggtcctgggcccagtctgccctgactcagcctgcctccgtgtctgggactccgtggacngtcgtcaccntcctcngcactggaaccngcctgacnttggntacttataactatgtctctgcccaacaacaccagcaacggccccaatcatctatttatgatgtcagtcactccggtcccctgtggtacttttccgtggttcgctttcctcgtacggtcttccgaagttccgtacggacctaaccgttccgggtccccttcccgtacggtaaaccctcgttcccgggtaccggggtccttaccccggaaggggtcccttagggaaccggggttaacggaaccgggtactttaaaccggttttaattttagggtttaacggttcctttaaacgttttttcccgaaatttaaccccgaaggtaaaccggtaaaccccaacccgtaaactaacggtttcccgttagggggttaacggtttacccggggacgggaaccggggttaaaccgttaaacgggtttccggaaccccggtttcgttaccgggtaaccgtaaccggaacccgtaacggggtcccttacccgtcccccggttaaccggttccccg

SEQ ID NO: 311477 - DNA, 796 bp, Homo sapiens
  misc_feature: GZ8MTXP01BEROG.25.36.D03.1.454.CMB.2.raw
  modified_base (230)..(230): a, c, t, g, unknown or other
  misc_feature (230)..(230): n is a, c, g, or t
  modified_base (246)..(246): a, c, t, g, unknown or other
  misc_feature (246)..(246): n is a, c, g, or t
  modified_base (323)..(323): a, c, t, g, unknown or other
  misc_feature (323)..(323): n is a, c, g, or t
tcagactgtacagtcacgaccggtgctcgatttagctgcgtcacgatctctcttgggggggggtctcaggaggcagcgctctcgggacgtctccaccatggcctgggctctgctgttcctcaccctcctcactcagggcacagggtcctgggcccagtctgccctgactcagcctgcctccgtgtctgggactcctggacagtcggtcaccatctcctgcactggaaccngccgtgactattggtntacttaataactatgtctcctcggtacccaacaaccacccaggaccaaaccggacccccaaactcaatctatttacngtaatcgtcagtctacgtccggtcccttcgtggtacgttttccgtcggttcgtctttcctccgttacgggtcccttccgtaaagttccgtacgggtacccctaaaccgttccccgggtcccctttccccgtacgaacccctacgttccccgggtccgggggtcccttacccggaacggggtccgttacgggaacggggtaccgtaacgggttacctttaaaccgttttagtttacttacggttaccttaaacgttttaccaaagttaaacccaagggtaaaccgaaaacccctaaacccgtaaactaacgggttccggttaggggtttaacgggttccgggggaaacggggtaaacggggttaaaccccgtaaaagggtttcccggttaaaccccgggttcccgttacgggtaaccgacccggtaacccgaaaccggggtccttaccccggtccccccgttcgggttaacccc

SEQ ID NO: 311478 - DNA, 662 bp, Homo sapiens
  misc_feature: GZ8MTXP01AK6F2.25.36.D03.1.454.CMB.2.raw
  modified_base (253)..(253): a, c, t, g, unknown or other
  misc_feature (253)..(253): n is a, c, g, or t
  modified_base (270)..(270): a, c, t, g, unknown or other
  misc_feature (270)..(270): n is a, c, g, or t
  modified_base (314)..(314): a, c, t, g, unknown or other
  misc_feature (314)..(314): n is a, c, g, or t
  modified_base (465)..(465): a, c, t, g, unknown or other
  misc_feature (465)..(465): n is a, c, g, or t
  modified_base (469)..(469): a, c, t, g, unknown or other
  misc_feature (469)..(469): n is a, c, g, or t
tcagactgtacagtcacgaccggtgctcgatttagctgcgtcacgatctctcttggggagctctgagagcggagccccagccccagaattcccaggtgttttcatttggtgatcagcactgaacacagaggactcaccatggagtttgggctgagcttgggttttccttgttgttatttttccaggtgtccagagtgaggtgcagttggtggagtcgtgggggagcttggtccagcctggagggtccgtgagngtctctgtgcagcctcnggattcatcttcagtcgaccatacagtcggacgtcggggtcccncgaggccgtaccgaagggggaagggggctgggaggttggggtcggacccgttaagttaagaaaagtaaagacgtaaaagacgttaaccaacctaacgaaggaactaccggccgtacgtactagtaggaaaaggcaagtattactaatttanctanaaggataatgtaattacgaaaagacttacaacttagtactctagaactaaagtcgaaacgacgtaccgtaaaggaaaacccggagggaaaccttaaccggggtacccgttaaggttaacgttaaccgttggtaaccggttacgtaacgggttacccaagggttacccgtaacggggttaaccgttaaaccccg

SEQ ID NO: 311479 - DNA, 620 bp, Homo sapiens
  misc_feature: GZ8MTXP01DDNU6.25.36.D03.1.454.CMB.2.raw
tcagactgtacagtcacgaccggtgctcgatttagctgcgtcacgatctctcttggggagcttcagctgtggtagagaagacaggattcaggacaatctccagcatggccggcctccctctcctcctcaccctcctcactcactgtgcagggtcctgggcccagtctgtgctgactcacgcccaccctcagtgtcgtcgggaccccggcaggacggtcctccatcttcgttgttcgtgggagcagcctaccgacgtacggaaataagtttgtctacgtgtaccagcagcctacccaagaacccggccccagcctcctcatactatagaatgatcacgcgcctacgacggactacgtgaccgtattctcgtggctacgaacgtcgtcggctccgtccggccctcccgtcgccatcgacggtcgggtccgtcccggtccggaggcgtggagtcgtaggtaacttagttacgtgtcgtcgtaggttggtacgtcgtccgtagtccgtggtaacgggttcgggttaaccgggttcgggttcggggttaccggggcgggaaacgggaccgttaaaggtccgtacggtcccggtacgttacggacgtaaccggcccgtaacccggg

SEQ ID NO: 311480 - DNA, 636 bp, Homo sapiens
  misc_feature: GZ8MTXP01EI5SX.25.36.D03.1.454.CMB.2.raw
  modified_base (189)..(189): a, c, t, g, unknown or other
  misc_feature (189)..(189): n is a, c, g, or t
  modified_base (210)..(210): a, c, t, g, unknown or other
  misc_feature (210)..(210): n is a, c, g, or t
  modified_base (240)..(240): a, c, t, g, unknown or other
  misc_feature (240)..(240): n is a, c, g, or t
  modified_base (366)..(366): a, c, t, g, unknown or other
  misc_feature (366)..(366): n is a, c, g, or t
  modified_base (378)..(378): a, c, t, g, unknown or other
  misc_feature (378)..(378): n is a, c, g, or t
tcagactgtacagtcacgaccggtgctcgatttagctgcgtcacgatctctcttggggagcttcagctgtggtagagaagacaggattcaggacaatctccagcatggccggcctccctctcctcctcaccctcctcactcactgtgcagggtcctgggcccagtctgtgctgactcacgcccaccctnagtgtcgtcgggacccccggnaggacggtctccattctcttgtcgtgggancagcctccgacgtacggaaattagttgtctacgtggtaccagcacgcctacccgaacgaaaccccgcccccaagccctcctacatactaagtaggaatgactcgacgccgcctagacggactacgngaccgtattccncgtcggctacggaacgttccgtcggtccctcccgtcccggtcccttcccgtcggccctaagtccgagggttccgggtccgttcccgggaccggagacgtggaacgggtccttaggggaaactttacgttacgtggtacgcggttaaggtttggaacttcgaccgtagtcgtgggtaacggttcgggacccggtaggttcggtcgggacgggttacggacacggtcgtacgccgtcgaggttccaacggcccgtaacgg

SEQ ID NO: 311481 - DNA, 569 bp, Homo sapiens
  misc_feature: GZ8MTXP01DMSGS.25.36.D03.1.454.CMB.2.raw
  modified_base (234)..(234): a, c, t, g, unknown or other
  misc_feature (234)..(234): n is a, c, g, or t
tcagactgtacagtcacgaccggtgctcgatttagctgcgtcacgatctctcttggggagcttcagctgtggtagagaagacaggattcaggacaatctccagcatggccggcctccctctcctcctcaccctcctcactcactgtgcagggtccgtggcccagtctgtgctgactcacgccaccctcagtgtctcgggaccccggcagaggtcctccatctcttgtctgggancagcctcgacgtacggaaataagttgtctactggtaccagcacgcctacccaagaacccgaccccaagcctctccatctatagatgatcgacgccgcctcgacgggactacgtgaccgtattcctctggctcgtaacgttcgtcggccttccgtcggtccctccgtcgcctatcgtggtcggccgttccggccggaggagtgagtctaggtaacttattacgtgtgcgtgttggagtgtccgtagtccgtggtaaggtcggttccggtggttcggttacgggcgggacgggcgacgtcgtacgccggttcgcggttactaaccggcccgtaacgg

SEQ ID NO: 311482 - DNA, 642 bp, Homo sapiens
  misc_feature: GZ8MTXP01BA4P5.25.36.D03.1.454.CMB.2.raw
  modified_base (245)..(245): a, c, t, g, unknown or other
  misc_feature (245)..(245): n is a, c, g, or t
tcagactgtacagtcacgaccggtgctcgatttagctgcgtcacgatctctcttggggggggtctcaggaggcagcgctctcgggacgtctccaccatggcctgggctctgctgttcctcaccctcctcactcagggcacagggtcctgggcccagtctgccctgactcagcctgcctccgtgtctgggactcctggacagtcggtcaccatctcctgcactggaaccagccgtgacattgggtnacttataactatgtctcctggtccaacaacacccaggcaacggcccccaaactcatcatttatgatgtcagtcactccggccctcgtggtagtttccgtggtcgtccttctcgtcggtcctccgtaaacgtctgggacctaaccgtccgggtccctccctcgacctacgtcgtcggggccttcggacggtcgtaggacggacgacggtacttacgttatttaggttcgtactatttactaacttacgacgaacgaaccaaccgtaaacgtacgttccgtgggttcggttcggggaccggggtaacggggaccgtaaagggttccggaacccgttccggttccgggtaaccaccggcccgtaaacggggcccttacccgggtcccccgttcggtcccg

SEQ ID NO: 311483 - DNA, 589 bp, Homo sapiens
  misc_feature: GZ8MTXP01BBEXE.25.36.D03.1.454.CMB.2.raw
  modified_base (229)..(229): a, c, t, g, unknown or other
  misc_feature (229)..(229): n is a, c, g, or t
  modified_base (245)..(245): a, c, t, g, unknown or other
  misc_feature (245)..(245): n is a, c, g, or t
  modified_base (263)..(263): a, c, t, g, unknown or other
  misc_feature (263)..(263): n is a, c, g, or t
tcagactgtacagtcacgaccggtgctcgatttagctgcgtcacgatctctcttggggggggtctcaggaggcagcgctctcgggacgtctccaccatggcctgggctctgctgttcctcaccctcctcactcagggcacagggtcctgggcccagtctgccctgactcagcctgcctccgtgtctgggactcctggacagtcggtcaccatctcctgcactggaaccngccgtgacattgggtncttataactatgtctccnggtcccaacaacacccaggcaacggcccccaaatcatcatttactgatgtcagtcagtccggcctcgtggtactttccgtggtcgtcttctcgtggcctcgaaagtctaggccaacgtccggcctcccctagaccatcgtcggggctccgaggctggaggacgaggctacgttattatgtctattcatcagagacacaactagtcgtggtcgttcggcgggtaacgggacccgtaaagggtttcggaacccgttccgttaccgggtaacccgaacggtccccgaaacggggtcccttacccggtccccccgtttcggggttccccg

SEQ ID NO: 311484 - DNA, 633 bp, Homo sapiens
  misc_feature: GZ8MTXP01AEWQI.25.36.D03.1.454.CMB.2.raw
  modified_base (242)..(242): a, c, t, g, unknown or other
  misc_feature (242)..(242): n is a, c, g, or t
tcagactgtacagtcacgaccggtgctcgatttagctgcgtcacgatctctcttggggggggtctcaggaggcagcgctctcgggacgtctccaccatggcctgggctctgctgttcctcaccctcctcactcagggcacagggtcctgggcccagtctgccctgactcagcctgcctcgtgtctgggactcctggacagtcgtcacatctcctgcactggaaccagccgtgactattggtncttataactatgtctctgtacccaacaacacccaggcaacggaccccaactcatctattatgatgtcagtcatcggcctcgtggtagtttcctggtcgtcttctctcggctcgtaagtctaggcctaacctcggcccttcccctagacccacgtccgtccggggtctcccgaggtcgtaggacgggacgaggtacttaacgtttattaacgttgacttaatttacctattaaccgtaagaacgtaaaccaacccgtaaactacggttacgttaggggttcgggttaccgggacggggtaacggggaaaccgtaacggttcggaacccgttccgttccgggtaaccgtacgtaaccccgaaggtcccgttccggtcccccgttcgggtcccg

SEQ ID NO: 311485 - DNA, 719 bp, Homo sapiens
  misc_feature: GZ8MTXP01CACNH.25.36.D03.1.454.CMB.2.raw
  modified_base (212)..(212): a, c, t, g, unknown or other
  misc_feature (212)..(212): n is a, c, g, or t
  modified_base (244)..(244): a, c, t, g, unknown or other
  misc_feature (244)..(244): n is a, c, g, or t
tcagactgtacagtcacgaccggtgctcgatttagctgcgtcacgatctctcttggggagcttcagctgtggtagagaagacaggattcaggacaatctccagcatggccggcctccctctcctcctcaccctcctcactcactgtgcgagggtcctgggcccagtctgtgctgactcacgcccaccctcagtcgtcgtccgggaccccggnaggaggtcctccatcttcttgttcgtgggacncagccgtaccgacgttacggaaattaagtttcgtactacgtaggtaccagtccacgtcctaccccgaaacggaaaccccggacccccaaagccctacctctaatactaagtacggaattcgactcgaacgccggtaccctacgaacgggtactaccgtgacccgtattccgtcgtgggacttacggattcgtacggtccttcccgtcccgcccttcccgtacggtcccaagtccgaggggttcccgggccgttaccgggtccggtagggacttcgggaacgtccttaaggggtaacttttacgtacgttagggtgtaccggtttaaggtttgggaaccttcgtaacccgtggttaccgtggggttaacggttcgggttacccgggttacgggttcgggtaccgggggcggaacggggttaccacggtccggtacgtaacccgtcggtagggttaccaacggttaacccgtaaccg

SEQ ID NO: 311486 - DNA, 656 bp, Homo sapiens
  misc_feature: GZ8MTXP01CE7Q3.25.36.D03.1.454.CMB.2.raw
  modified_base (188)..(188): a, c, t, g, unknown or other
  misc_feature (188)..(188): n is a, c, g, or t
  modified_base (208)..(208): a, c, t, g, unknown or other
  misc_feature (208)..(208): n is a, c, g, or t
  modified_base (235)..(235): a, c, t, g, unknown or other
  misc_feature (235)..(235): n is a, c, g, or t
  modified_base (261)..(261): a, c, t, g, unknown or other
  misc_feature (261)..(261): n is a, c, g, or t
tcagactgtacagtcacgaccggtgctcgatttagctgcgtcacgatctctcttggggagcttcagctgtggtagagaagacaggattcaggacaatctccagcatggccggcctccctctcctcctcaccctcctcactcactgtgcagggtcctgggcccagtctgtgctgactcacgccaccctnagtgtcgtcgggaccccggnagaggtctccatctcttgtcgtgggancagcctccgagtacggaaattagttntctacgtggtaccagcacgcctacccgaagaaccccgacccccaagccctctacactctaataggaatgactcagccgccctgacggactacgtcgacctatcgtctgcctacgacgtcgcgggcctaccgtcgtcccctccgtcggcctagtcgaggtcgggtcccgtccgggtaccggaggtacgtacgggtcgtaacgttaaggggttactttaaccgttaggtggttacgtacgggtttgggtaggtaacccgttcgtaccggttaggttcggaacgggttgggtttacccgggttccgggggttaggtttccgggggtaccggggcgggaacggttacgacgtcggtaccgtcccgtacgggtacgaccggtaaccgaaccgtaacccgg

SEQ ID NO: 311487 - DNA, 702 bp, Homo sapiens
  misc_feature: GZ8MTXP01AZLQW.25.36.D03.1.454.CMB.2.raw
  modified_base (211)..(211): a, c, t, g, unknown or other
  misc_feature (211)..(211): n is a, c, g, or t
  modified_base (241)..(241): a, c, t, g, unknown or other
  misc_feature (241)..(241): n is a, c, g, or t
  modified_base (367)..(367): a, c, t, g, unknown or other
  misc_feature (367)..(367): n is a, c, g, or t
tcagactgtacagtcacgaccggtgctcgatttagctgcgtcacgatctctcttggggagcttcagctgtggtagagaagacaggattcaggacaatctccagcatggccggcctccctctcctcctcaccctcctcactcactgtgcagggtcctgggcccagtctgtgctgactcacgcccaccctcagtgtcgtcggggacccccggnaggagggtctccatctcttgttcgtgggancagctccgacggtacggtaaatacgttgtctacgtcggtacaggcagcctaccccgaacgaacccggcccccaaagcctcctcactctaagtaggaatgatcgacgccggcctgacggactaccgngacctacgttctcgtcggctacggtacgtcgtcggtcctcccgtcccggtcccttcccgtcggacctacgtcgtacggggttccgggtcccgtcccggggtacccggaaggtcgttcgggacggttaccgtaagggggtaaactttacgtttaaccggtgggttacgtaccggttaagggttttgggaacgttcggtaacccgttggtccggttggggtaaccgggttcggggttacccgggtaagggggttcgggttaccgggggacgggttaacgggaccgacgtccgtacggaacccggttcggacggttccgaacggttcccgtaacccgg

SEQ ID NO: 311488 - DNA, 745 bp, Homo sapiens
  misc_feature: GZ8MTXP01C5YHM.25.36.D03.1.454.CMB.2.raw
  modified_base (209)..(209): a, c, t, g, unknown or other
  misc_feature (209)..(209): n is a, c, g, or t
  modified_base (235)..(235): a, c, t, g, unknown or other
  misc_feature (235)..(235): n is a, c, g, or t
tcagactgtacagtcacgaccggtgctcgatttagctgcgtcacgatctctcttggggagcttcagctgtggtagagaagacaggattcaggacaatctccagcatggccggcctccctctcctcctcaccctcctcactcactgtgcagggtcctgggcccagtctgtgctgactcacgcccaccctcagtgtcgtcgggaccccggnagaggtctccatctcttgtctgggancagctccgagtacggaaattagttgtctacgtggtaccagcacgcctaccccgaagaaaccccggcccccaagtcctacctcatactaagtaggaatgaactcgacgccggccctacgacgggtactaccgtagacccgtactttccgtacgttcgggtcctaccgggtaacgttccgtcgggtcccttccccggtcccgggtccccttcccgtcgggaccctagtccgtacgggtcgggtcccgttacccggggtaccgagggtatcgggaacggttccgttaagggttaaaacgtttacgtttaccgttgggttacgtccgttaagggggttttcgggaacgttccggtcccgtaagggttccttagggggtaacggtttacgggggttaaccgggttcggggttacggggttaccgggggcgggttaaacgggggaaccttaaacgggtccgtaacgggtaacccgttccggtaacgggttccgaaccggttaacccccggtaaggg

SEQ ID NO: 311489 - DNA, 698 bp, Homo sapiens
  misc_feature: GZ8MTXP01D2X18.25.36.D03.1.454.CMB.2.raw
  modified_base (227)..(227): a, c, t, g, unknown or other
  misc_feature (227)..(227): n is a, c, g, or t
  modified_base (244)..(244): a, c, t, g, unknown or other
  misc_feature (244)..(244): n is a, c, g, or t
  modified_base (333)..(333): a, c, t, g, unknown or other
  misc_feature (333)..(333): n is a, c, g, or t
tcagactgtacagtcacgaccggtgctcgatttagctgcgtcacgatctctcttggggggggtctcaggaggcagcgctctcgggacgtctccaccatggcctgggctctgctgttcctcaccctcctcactcagggcacagggtcctgggcccagtctgccctgactcagcctgcctccgtgtctgggactcctggacagtcgtcaccatctctgcactggaaccngccgtgactattgggtntacttataactatgtctctcgtacccaacaacaccaggcaacgacccccaaactcatctatttatcgatgtacagtcactcggcccttntcggtacgtttctcggtcgtcttctctcggctcgaagtctcggctaaccgtcggacccttccctcgaccctagtccggtcggggcttcccgaaggccgtaggacgggtaccgtaggtaccttaacgtttatttacgggttacgtactttaacttttaccgaacttaaaccgaacgggtaacgtaaaccaaccctaaacgtaacggtttccgttcgggggttaacgggtttaccgggacgggggttaaacggggttaacccgtaaagggtttccggaaaccccggttccgttaccggggttaacccgacggaaccccgtaaacggggtccccttacccgggtcccccccgttcggggttaaccccc

SEQ ID NO: 311490 - DNA, 613 bp, Homo sapiens
  misc_feature: GZ8MTXP01AXXVW.25.36.D03.1.454.CMB.2.raw
  modified_base (229)..(229): a, c, t, g, unknown or other
  misc_feature (229)..(229): n is a, c, g, or t
  modified_base (246)..(246): a, c, t, g, unknown or other
  misc_feature (246)..(246): n is a, c, g, or t
  modified_base (432)..(432): a, c, t, g, unknown or other
  misc_feature (432)..(432): n is a, c, g, or t
tcagactgtacagtcacgaccggtgctcgatttagctgcgtcacgatctctcttggggggggtctcaggaggcagcgctctcgggacgtctccaccatggcctgggctctgctgttcctcaccctcctcactcagggcacagggtcctgggcccagtctgccctgactcagcctgcctccgtgtctgggactcctggacagtcggtcaccatctcctgcactggaaccngccgtgactagttggtntacttataactatgtctcctggtaccaacaacaccaggcaacggccccaactcatcatttatgatgtcagtcatcgcctcgtggtagtttcctggttcgtcttctcgtcggcctccaagtcctcgggcctaaccgtccgggcccttccctcgaccactcgtcggggctccgaggctggacggacgngcttacttagttattgctattcatacagacgtaacactaacacgttacgtgggtcgttcgggcgggtacgggttaaccgtaacggttcggacccggttccggttacccgggtaacccgtaccgggaacccccggtaaacgggtccccgttacccgggtcccccccgtttcggggtcccccg

SEQ ID NO: 311491 - DNA, 687 bp, Homo sapiens
  misc_feature: GZ8MTXP01CS4ZX.25.36.D03.1.454.CMB.2.raw
  modified_base (198)..(198): a, c, t, g, unknown or other
  misc_feature (198)..(198): n is a, c, g, or t
  modified_base (241)..(241): a, c, t, g, unknown or other
  misc_feature (241)..(241): n is a, c, g, or t
  modified_base (574)..(574): a, c, t, g, unknown or other
  misc_feature (574)..(574): n is a, c, g, or t
tcagactgtacagtcacgaccggtgctcgatttagctgcgtcacgatctctcttggggggggtctcaggaggcagcgctctcgggacgtctccaccatggcctgggctctgctgttcctcaccctcctcactcagggcacagggtcctgggcccagtctgccctgactcagcctgcctcgtgtctggactcctggacngtcgtcaccatctctgcactggaaccagccgtgactattggtntcttataactatgtctccgtcggtaccaacaacacccaggcaacggtccccaaactcatctatttactgatgtcagttcactccggcctctggtacgtttcctggtccgtcttctcgtaacgggtcctccgtaagtccgtagggacctaaccgtcccgggtacccttccccgtacgtaccctaacgtccggtccgggggaccttcccgaacgggtccgtaggaacgggtacgaggtccttaacgtttatttaacgtgtacttaactttccaaattaccgaagtacgaacctaaacgtaaacctaggttccgttggggttaacggttccggggngggtaaacggggaaccgttaaagggttcccggttaacccggttccggttcccggttaaccgacccgtcccggaacgggtccgttaccccggtcccccgttcgggttaaccccg

SEQ ID NO: 311492 - DNA, 706 bp, Homo sapiens
  misc_feature: GZ8MTXP01EUEG4.25.36.D03.1.454.CMB.2.raw
tcagactgtacagtcacgaccggtgctcgatttagctgcgtcacgatctctcttggggggggtctcaggaggcagcactctcgggacgtctccaccatggcctgggctctgctcctcctcagcctcctcactcagggcacaggatcccgggctcagtctgccctgactcagcctcgctcagtcgtccggtctcctggacagtcagtcaccatctcctgcactggaaccagaagtgatcgttggtgtcttatgacactgtctcctggacacctacgtttacccaaggtaaacgcccccagacgtcattacctttatgtatgtacgaggaacgccggccctcgaccggggtccctgactccgtcttcctcgtcgggtacctaaagtccgtacggtaccaaccgacccgggtcccctacccgtacgtacccgtacttccgtccgtcgggtcccttaccgacgggtccgtaggacggacgtacggaaggtccggttagttaacggttttaatttacgttcgtacccgtttggtttacctaaacgtttagtcgtaaccgtaacgggtaccctaaactttaccgtttaaggttttcgggttcggttacccgggtacggttaccggttaaccggggttaaccgttaaacgggttccggtaacccggtttccgggtacgggttaccgtaaccggttaaccccggtaacccgggg

SEQ ID NO: 311493 - DNA, 610 bp, Homo sapiens
  misc_feature: GZ8MTXP01ARDUV.25.36.D03.1.454.CMB.2.raw
  modified_base (207)..(207): a, c, t, g, unknown or other
  misc_feature (207)..(207): n is a, c, g, or t
  modified_base (234)..(234): a, c, t, g, unknown or other
  misc_feature (234)..(234): n is a, c, g, or t
  modified_base (573)..(573): a, c, t, g, unknown or other
  misc_feature (573)..(573): n is a, c, g, or t
tcagactgtacagtcacgaccggtgctcgatttagctgcgtcacgatctctcttggggagcttcagctgtggtagagaagacaggattcaggacaatctccagcatggccggcctccctctcctcctcaccctcctcactcactgtgcagggtcctgggcccagtctgtgctgactcagccaccctcagtgtctgacgacccccggnagaggtctccatctcttgttctgggancagctccgacgtacggaaattagttgctacgtggtaccagcagcctaccccaaggaaacccggcccccaagcctcctcatctataggaactgactcgacgccggccctcgagggtactacccgcgaaccgtacttccgtcgtcgggtaccttacgggtaacgttcgtcgggtcccttccccgtcccgggtccccttaccccgtcggacccctagtcgtacgggtcgggtccgtacccggggtaccgagggtactaggacggtctagtaattacttcgtgtgcgttaggtttggactgaccgtgtctaaggtcgttcgggtaccgttgggtcggtcgggnggttcggacaagcgtcgacgtcgttagtcgcgaaccg

SEQ ID NO: 311494 - DNA, 578 bp, Homo sapiens
  misc_feature: GZ8MTXP01DC8AU.25.36.D03.1.454.CMB.2.raw
  modified_base (231)..(231): a, c, t, g, unknown or other
  misc_feature (231)..(231): n is a, c, g, or t
  modified_base (248)..(248): a, c, t, g, unknown or other
  misc_feature (248)..(248): n is a, c, g, or t
  modified_base (315)..(316): a, c, t, g, unknown or other
  misc_feature (315)..(316): n is a, c, g, or t
  modified_base (499)..(499): a, c, t, g, unknown or other
  misc_feature (499)..(499): n is a, c, g, or t
tcagactgtacagtcacgaccggtgctcgatttagctgcgtcacgatctctcgttggggggggtctcaggaggcagcgctctcgggacgtctccaccatggcctgggctctgctgttcctcacccctcctcactcagggcacagggtcctgggcccagtctgccctgactcagcctgcctccgtgtctgggactccgtggacagtcgtcaccatcctctgcactggaaccngccgtgactattgggtntacttataactatcgtctcctcgtacccaacaaccacccaggccaacggccccaaatcatcatttannatgtcagtcacgttccggtccctgtggtacgtttcctcggttcgtctttctcgtcggacttccgaagtcgtagccactcggccctcctcgactcgtcgcgggtctcgagctggacgcgacgacttactagttagttcgtactatttacagtacagacgtacacctaaatgtctggtgttcggnggtacggttactaaaggtcgttaccgttccgttacgtccgaaccgtccggaacgccgttccgccccgttggtaaccccg

SEQ ID NO: 311495 - DNA, 771 bp, Homo sapiens
  misc_feature: GZ8MTXP01AEC6M.25.36.D03.1.454.CMB.2.raw
  modified_base (189)..(189): a, c, t, g, unknown or other
  misc_feature (189)..(189): n is a, c, g, or t
  modified_base (209)..(209): a, c, t, g, unknown or other
  misc_feature (209)..(209): n is a, c, g, or t
  modified_base (237)..(237): a, c, t, g, unknown or other
  misc_feature (237)..(237): n is a, c, g, or t
  modified_base (283)..(283): a, c, t, g, unknown or other
  misc_feature (283)..(283): n is a, c, g, or t
tcagactgtacagtcacgaccggtgctcgatttagctgcgtcacgatctctcttggggagcttcagctgtgggtagagaagacaggattcaggacaatctccagcatggccggcctccctctcctcctcaccctcctcactcactgtgcagggtcctgggcccagtctgtgctgactcagcccaccctnagtgtctcgggacccccggnagagggtctccatctcttgttctgggancgctccgacgtacggaagtaaagttgtctactgtacgtagcagtcnccacgaaaccggaccccacgactcctcactactacgtagaagtgtatcgacgccggtcccgtacacggggactaccgtacgaccgtacttctacgtcggtcgtacgtaaacgtcgtcggccgttccgtccgggtaaccctccccgttagggaccctaattaccggtacgggttcggggtcccccggtaacccggggttacccggacgggggttaaagtcggtaacgggttaccgtttaagttaaacggtttaacgtttacggttcggttaacggtacggtttagggtttacgggtacgtcgtaccgggttaccgttagttacggggtcgggttaacgggttcccggggttaacgggggtttccgggttaaccgggggtaaccgggggtaaccggttaacccggttaacgttccccgggttaaccggtaacccggtttccccgggtaagggtaccccggttacccgtaaccccgggaaccggttccccg

SEQ ID NO: 311496 - DNA, 618 bp, Homo sapiens
  misc_feature: GZ8MTXP01BMTJH.25.36.D03.1.454.CMB.2.raw
  modified_base (228)..(228): a, c, t, g, unknown or other
  misc_feature (228)..(228): n is a, c, g, or t
  modified_base (245)..(245): a, c, t, g, unknown or other
  misc_feature (245)..(245): n is a, c, g, or t
tcagactgtacagtcacgaccggtgctcgatttagctgcgtcacgatctctcttggggggggtctcaggaggcagcgctctcgggacgtctccaccatggcctgggctctgctgttcctcaccctcctcactcagggcacagggtcctgggcccagtctgccctgactcagcctgcctccgtgtctgggactcctggacagtcggtcaccatctctgcactggaaccngccgtgactagttggtntacttaataactatcgtcctccgtcgtacccaacaaccaccgacggaccaaccggacccccaactcatctattatgtatcgtacacgtctacgtccgtcccttcgtggtacgtttcccgtcggtcgtcttctcgtcggtcctccgtacgtcgtcgcctaccgtccgccctccctcgacctcgtccggtccggggtcctccggacggtcgtaggaacgggacgtacgtacttaactttatttaggttcgtacttacttacaacgtaacgacgaacaaccaacctaacgtagtcgtgggtcggtcgggacgggtacggacgtacggtcgccgttccggttacgcgacgccgacgtccgttcccgtcccgttcgtc

SEQ ID NO: 311497 - DNA, 663 bp, Homo sapiens
  misc_feature: GZ8MTXP01AW3MX.25.36.D03.1.454.CMB.2.raw
  modified_base (260)..(260): a, c, t, g, unknown or other
  misc_feature (260)..(260): n is a, c, g, or t
  modified_base (271)..(271): a, c, t, g, unknown or other
  misc_feature (271)..(271): n is a, c, g, or t
  modified_base (319)..(319): a, c, t, g, unknown or other
  misc_feature (319)..(319): n is a, c, g, or t
  modified_base (364)..(364): a, c, t, g, unknown or other
  misc_feature (364)..(364): n is a, c, g, or t
  modified_base (615)..(615): a, c, t, g, unknown or other
  misc_feature (615)..(615): n is a, c, g, or t
tcagactgtacagtcacgaccggtgctcgatttagctgcgtcacgatctctcttggggagctctggggagaggagcccagcactagaagtcggcggtgttaccattcggtgatcagcactgaacacagaggactcaccatggagtttgggctgagctgggttttcctcgttgctacttttaagaggtgtccactgtcaggtgcaccgtgggtggagtcgtgggggagcgtggtccagcctggggagtccctgagctctcngtgaagccctntggtatttagttcagttggttctaggcagtgctacgtgggggtccccncgacggcctacgaggcggaacgggggcgtaggtggtgactagtanagcatagtacgagtggtaaacttcgtaaagtaaattagttacgcgacctaagtaccgtaccgggtaaggaacgggtaccctaatacccgaacctacgtacctaacgaacgtaacggtaaaccgtaaccgttaccccggggtaaattagtttacgggtacgttaacgttaggtaaacgttcggtacgaacggtccgtaaggacggtacggtaacggtaaggttaccgtcggttcttacgtaggttacttcgnggtaacgagaaggtacgggtaggggttagttaaggttaagttaaccgg

SEQ ID NO: 311498 - DNA, 593 bp, Homo sapiens
  misc_feature: GZ8MTXP01EUYMQ.25.36.D03.1.454.CMB.2.raw
  modified_base (201)..(201): a, c, t, g, unknown or other
  misc_feature (201)..(201): n is a, c, g, or t
  modified_base (229)..(229): a, c, t, g, unknown or other
  misc_feature (229)..(229): n is a, c, g, or t
  modified_base (234)..(234): a, c, t, g, unknown or other
  misc_feature (234)..(234): n is a, c, g, or t
  modified_base (243)..(243): a, c, t, g, unknown or other
  misc_feature (243)..(243): n is a, c, g, or t
  modified_base (255)..(255): a, c, t, g, unknown or other
  misc_feature (255)..(255): n is a, c, g, or t
  modified_base (262)..(262): a, c, t, g, unknown or other
  misc_feature (262)..(262): n is a, c, g, or t
  modified_base (308)..(308): a, c, t, g, unknown or other
  misc_feature (308)..(308): n is a, c, g, or t
  modified_base (469)..(469): a, c, t, g, unknown or other
  misc_feature (469)..(469): n is a, c, g, or t
tcagactgtacagtcacgaccggtgctcgatttagctgcgtcacgatctctcttgggggggggtctcaggaggcagcgctctcgggacgtctccaccatggcctgggctctgctgttcctcaccctcctcactcagggcacagggtcctgggcccagtctgccctgactcagcctgcctccgtgtctgggactcctggacngtcgtcaccatctcctgcactggaaccngcgtnatgttggtntacttataactntctctcncgaccaacaaccaccgacgaccaaccgacccaatctatactattanagtatgtactacgtctacgtccgtcctcgtcggttacgttccgtcgtctcttctcgtcgcctcgtagtcgtacgacctaccgtccgtcctcctcgacctcgtccggtccggtcctacggaggtcgtacgggacggacgtacgtacttaatttattacggtntacttacttacaactacgacgacgaactacgtaagtcgttcgtcggtcggtcgggacggtacgttacgtacgtccggttccgttcgttcggccacgccgacgcccgttcccgtcccgttcgtcc

SEQ ID NO: 311499 - DNA, 587 bp, Homo sapiens
  misc_feature: GZ8MTXP01BR1AL.25.36.D03.1.454.CMB.2.raw
tcagactgtacagtcacgaccggtgctcgatttagctgcgtcacgatctctcttggggggggtctcaggaggcagcactctcgggacgtctccaccatggcctgggctctgctcctcctcagcctcctcactcagggcacaggatcccgggctcagtctgccctgactcagcctcgctcagtgtccggtctcctggacagtcagtcacatctctgcactggaaccagaagtgattctggtgcttatgacactgtctcctggcacctagtttaacccaagaaacgccccagagtcatcttatgatgtcaggacgcggcctcgaccgggtcctgactcgtcttcgtcgtcgggtaccaaagtcgtacgggacctaaccgaccgggtcccctccgtacgaccactccgtcgtcgggcctaccgaggtcctaggagagtaggacggttacgttagtacgtttagttacgttgtcgttcgttagtatagtacgtacgtacgtactaactacgttagttcggttcggtcggtcgttacggttacggttacgtaacgtacgtccgtcggtcggttacgtaaccgaaccgtaacg

SEQ ID NO: 311500 - DNA, 725 bp, Homo sapiens
  misc_feature: GZ8MTXP01DNMS0.25.36.D03.1.454.CMB.2.raw
  modified_base (228)..(228): a, c, t, g, unknown or other
  misc_feature (228)..(228): n is a, c, g, or t
  modified_base (244)..(244): a, c, t, g, unknown or other
  misc_feature (244)..(244): n is a, c, g, or t
tcagactgtacagtcacgaccggtgctcgatttagctgcgtcacgatctctcttgggggggggtctcaggaggcagcgctctcgggacgtctccaccatggcctgggctctgctgttcctcaccctcctcactcagggcacagggtcctgggcccagtctgccctgactcagcctgcctccgtgtctgggactcctggacagtcgtcaccatctctgcactggaaccngccgtgactattggtntacttaataactatgtctcctcggtacccaaacaaccacccaggaccaaccggacccccaaatcatctaatttatgatgtcagtcacgtccggtccctgtggtacgtttccgtggttcgtcttctcgtcggtcctctaagtcgtacgggacctaaccgtcccgggtccctccccgtacgtaccctacgtccggtccggggtccttaccggaacggtccgtagggaacgggacggttacggtacctttaacgtttagtttacgtttacgtacctttaatttaccgaaacttaaccgaacggtaaaccgaacccgttaaaccaaacgttacggttacggttcggggttaacgggtttacccggggacggggtaaaccgggttaaccgtaaacgggtttcccgggttaaccccggtttccggttaccggtccgaacccggcccgtaacggtcccgttaccccgtcccccgttcgggttaacccc

SEQ ID NO: 311501 - DNA, 687 bp, Homo sapiens
  misc_feature: GZ8MTXP01ELZZO.25.36.D03.1.454.CMB.2.raw
  modified_base (187)..(187): a, c, t, g, unknown or other
  misc_feature (187)..(187): n is a, c, g, or t
  modified_base (207)..(207): a, c, t, g, unknown or other
  misc_feature (207)..(207): n is a, c, g, or t
  modified_base (233)..(233): a, c, t, g, unknown or other
  misc_feature (233)..(233): n is a, c, g, or t
tcagactgtacagtcacgaccggtgctcgatttagctgcgtcacgatctctcttggggagcttcagctgtggtagagaagacaggattcaggacaatctccagcatggccggcctccctctcctcctcaccctcctcactcactgtgcagggtcctgggcccagtctgtgctgactcagccaccctnagtgtctcgggacccccggnagaggtctccatctcttgtctgggancagctccgagtcgaaataagttgtctactaggtaccagcacgcctaccccaacggaaacccggccccccaaagtccctaccttcacttacgtaataaggaactagtactcgaacgccggccctacgacggggacttaccgtacggaccgtaatttccgtacgtggaccgttaccggaaacgttccgtacggtccttcccgttccggcccctccgtacggcccagttccgaggttcggggtccgtccggtacggagtactggaacgtctaggggtaaactttacgtttaccgtgtacggtacgttagggtttaggacgttcgcccgtaagttcgtggtaacggttcgggttccggacggtttgggtacccgggacgggttaacggggacccttaaacgggtccttagggaaccccgttccgttacggggttactaaccggaaccccgtaacgggg

SEQ ID NO: 311502 - DNA, 658 bp, Homo sapiens
  misc_feature: GZ8MTXP01A0YJL.25.36.D03.1.454.CMB.2.raw
  modified_base (189)..(189): a, c, t, g, unknown or other
  misc_feature (189)..(189): n is a, c, g, or t
  modified_base (213)..(213): a, c, t, g, unknown or other
  misc_feature (213)..(213): n is a, c, g, or t
  modified_base (378)..(378): a, c, t, g, unknown or other
  misc_feature (378)..(378): n is a, c, g, or t
tcagactgtacagtcacgaccggtgctcgatttagctgcgtcacgatctctcttggggagcttcagctgtggtagagaagacaggattcaggacaatctccagcatggccggcctccctctcctcctcaccctcctcactcactgtgcagggtcctcgggcccagtctgtgctgactcagcccaccctnagtcgtcgtcggggacccccgggnaggacgggtctccattcttcttgttcgtgggagcagctccgagtacggaaataagttctctatcggtacagcacgcctacccgaacgaacccgccccaagtcctcctacatactaagtaggaactgactcgacgccgccgtcgacgggactaccgtcggaacctnttcctcgtgtccgtacggtaagtcgtggtcctaccgttccgggcccttaccgtacgggcctaacgtccggtagggttcgggaccgttcccggggccggaaggtacgttcggaaagggtccttaagggggtaactttaacgttccgtggttaccggtacgttagggttttgggaactttcggaccgttaggtccgagggtaacgggttcggttcccgggtagggttcggtacgggacggaccggattacgcgtacgtcgtacgtcgactcgaacccgccgg

SEQ ID NO: 311503 - DNA, 579 bp, Homo sapiens
  misc_feature: GZ8MTXP01C7MEH.25.36.D03.1.454.CMB.2.raw
  modified_base (269)..(269): a, c, t, g, unknown or other
  misc_feature (269)..(269): n is a, c, g, or t
  modified_base (295)..(295): a, c, t, g, unknown or other
  misc_feature (295)..(295): n is a, c, g, or t
  modified_base (477)..(477): a, c, t, g, unknown or other
  misc_feature (477)..(477): n is a, c, g, or t
  modified_base (516)..(516): a, c, t, g, unknown or other
  misc_feature (516)..(516): n is a, c, g, or t
  modified_base (524)..(524): a, c, t, g, unknown or other
  misc_feature (524)..(524): n is a, c, g, or t
  modified_base (543)..(543): a, c, t, g, unknown or other
  misc_feature (543)..(543): n is a, c, g, or t
tcagactgtacagtcacgaccggtgctcgatttagctgcgtcacgatctctcttgggagatgggtcctgtcccagatgcacctgcaggagtcgggcccaggactggtgaagccttcggagaccctgtccctcacctgcagtgtctctggtgctccgtcagtgcttatactggagctggatccgccagtccggcgggagggactgggagtggattggggctatatatacgaatggattaaccactacaacccctctcagagtcatcacanatcagcgacacgtcaggatcgaggtnttcctgctatctgacttctgcgactgccgccggacacggccctatacctaactgtcgccaggacgtattcggactgacgtacgttagttttacggagtaatttattattcttttgtgttcttttagactagttaggtacgggaaccgggtaacggggacggtaccggtcaccgtctctcacncctcccacgaacggcccaagtccggttcccttcccccgnggtacccncccttccttccgaacgccncgaaccgttcggcgggggaccaacgttcggcccggg

SEQ ID NO: 311504 - DNA, 724 bp, Homo sapiens
  misc_feature: GZ8MTXP01EZY2P.25.36.D03.1.454.CMB.2.raw
  modified_base (210)..(210): a, c, t, g, unknown or other
  misc_feature (210)..(210): n is a, c, g, or t
tcagactgtacagtcacgaccggtgctcgatttagctgcgtcacgatctctcttggggagcttcagctgtgggtagagaagacaggactcaggacaatctccagcatggccagcttccctctcctcctcaccctcctcactcactgtgcagggtcctgggcccagtctgtgctgtctcagccacctcagtgtcgtcggggccccccgggnaggacggtcactattcttcttgttcgtaggtacgtcgcctaccgaacggtcggacaagtaatagtagtaagcgtacggtaccagaccaacctcccgacggaaccccgcccccacacctcctcagtgtagtagggaatgactcgacgccccgtcccccgtccggaccggggtcctacgtacccgtcttcctccgtccgtcccctccgtaccggttccgtcggtaccctacccgtcccgtacccgtcccctccccggtacggtccctaccggttcccgggtaccgggtacccttaccctaacgtcgtagggacggtacgtacggaccggggtacgttaatttacgtttacgttcggtcgacgacgggtcgggtagggtacgtacggaacggtaaaggggtaaacggttaacggtttagtcggttacggttaacgggtaacggttaccggggaaccgttaacgggttcccacccggttaaccgtacggtccgacccgtaaccccgaaccgaaccccg

SEQ ID NO: 311505 - DNA, 726 bp, Homo sapiens
  misc_feature: GZ8MTXP01BM9PO.25.36.D03.1.454.CMB.2.raw
  modified_base (227)..(227): a, c, t, g, unknown or other
  misc_feature (227)..(227): n is a, c, g, or t
  modified_base (244)..(244): a, c, t, g, unknown or other
  misc_feature (244)..(244): n is a, c, g, or t
  modified_base (324)..(324): a, c, t, g, unknown or other
  misc_feature (324)..(324): n is a, c, g, or t
tcagactgtacagtcacgaccggtgctcgatttagctgcgtcacgatctctcttgggggggggtctcaggaggcagcgctctcgggacgtctccaccatggcctgggctctgctgttcctcaccctcctcactcagggcacagggtcctgggcccagtctgacctgactcagcctgcctccgtgtcgtgggactctggacagtcgtcacatctctgcactggaaccngccgtgactgttcggtntacttaataactatcgtcctccgtcggtaccccaacaacccacccgaggaccaacggacccccaaactcactctatttangtataggtaatcacgtccggcccttagtgtacgtttctcggtcgtcttcgtcgtggtaccttaccgaagttccgtcggacccaaccgtccggtccccttccgtaccgacctacgttcccggttccgggggccttacccggagggtacccgtagggaaccggtacgggtaacgttaccgttaaacgttttacttaagttacggtacttacgtttacaacgttaacgacgtaactaaccgaaccctaaagtcggttcgttcggggttcgggttccggggaacggggttaacggggtaacccttaaaggggtttaccgacccggttaccgttacgggttaccgaacccggtacccgtaacgggtcgttccccggaccccccgtttcgggttcccgttaaccccgg

SEQ ID NO: 311506 - DNA, 708 bp, Homo sapiens
  misc_feature: GZ8MTXP01EAAS6.25.36.D03.1.454.CMB.2.raw
  modified_base (221)..(221): a, c, t, g, unknown or other
  misc_feature (221)..(221): n is a, c, g, or t
tcagactgtacagtcacgaccggtgctcgatttagctgcgtcacgatctctcttggggacccaaaaaccacacccctccttgggagaatcccctagatcacagctcctcaccatggactggacctggagcattccttttcttggtggcagcagcaacaggtcgcccactcccaggttcaactggtgcagtctggacctggaggtgaagagccgtgggcctnagtgaagtctccgtgcaggtcttcgtaggttactacctttagcagtctagtggcatcgaggcgtgggcgacggacgacggccccgtagggaaccgtaagggggtctttagggacggtagggtaagttgggacctaaggttagggacttaccgaacggtacccttaaaccgtagtttccggtaactacgaaacgaggtaacctaaacgttcgaaccgaaacggtaaagggttaaaccttcccgggaaacgggggactaacgggtaaccgttaccctaaccgttacggaaacccaacgaaacgaaccaaccgtaacacccgaacggacacccaacgtacgtacccctaaggaacgtacggaccgtaggacggtacgccgtagtaacgtcgtacgaaccggacgaccggtaacggtaccgttagttacttacgtcggtagacgttagacgttaacgtattcgtacgtcgttaccgtccgttcgtaacccg

SEQ ID NO: 311507 - DNA, 640 bp, Homo sapiens
  misc_feature: GZ8MTXP01BYHV5.25.36.D03.1.454.CMB.2.raw
  modified_base (229)..(229): a, c, t, g, unknown or other
  misc_feature (229)..(229): n is a, c, g, or t
  modified_base (240)..(240): a, c, t, g, unknown or other
  misc_feature (240)..(240): n is a, c, g, or t
  modified_base (247)..(247): a, c, t, g, unknown or other
  misc_feature (247)..(247): n is a, c, g, or t
  modified_base (314)..(314): a, c, t, g, unknown or other
  misc_feature (314)..(314): n is a, c, g, or t
  modified_base (346)..(346): a, c, t, g, unknown or other
  misc_feature (346)..(346): n is a, c, g, or t
tcagactgtacagtcacgaccggtgctcgatttagctgcgtcacgatctctcttggggggggtctcaggaggcagcgctctcgggacgtctccaccatggcctgggctctgctgttcctcaccctcctcactcagggcacagggtcctgggcccagtctgccctgactcagcctgcctccgtgtctgggactcctggacagtcggtcaccatctcctgcactggaaccngcccgtgactnttgggtnacttataactatgtctcctggacccaacaaccacccaggaccaacggcccccaaactcatcatttangatgtcagtcatcggcctgtgtacgtttccgnggtcgctttcgtcgtacggccttccgaagtccgtacggacctaaaccgttccggggtccccttccccgtcgacccgtagttcccggtcgggggccttaccggagggtccgtagggaacgggaccgtacgggtacttaccgtttattacggttacgtcgttatttacgacttacacggaactacgaacctaacgtgtacgtgggttcgtcgggacggtacggaccgtaaggttccggttaccgttccgttacgtccgaacgccgaacgtccgttaccgtccccgttcggttcccg

SEQ ID NO: 311508 - DNA, 665 bp, Homo sapiens
  misc_feature: GZ8MTXP01BH8A6.25.36.D03.1.454.CMB.2.raw
  modified_base (209)..(209): a, c, t, g, unknown or other
  misc_feature (209)..(209): n is a, c, g, or t
  modified_base (345)..(345): a, c, t, g, unknown or other
  misc_feature (345)..(345): n is a, c, g, or t
tcagactgtacagtcacgaccggtgctcgatttagctgcgtcacgatctctcttgggggggggtctcaggaggcagcgctctcgggacgtctccaccatggcctgggctctgctgttccctcaccctcctcactcagggcacagggtcctgggcccagtctgccctgactcagcctgcctccgtgtctggactctggacagtcgtcacntctctgcactcggaaccagcccgtgactattgggtagtactttaagtaaccttatcggttcctcctaccggtacccaaaccaaccaaccccgacggaccgaaacccggacccccctaaactcaatacctaatttangtatgtcagtctacgtccggtcctcgttggtatttccgtcggtcgtcttcgtcgtcggtacctcgtacgtcgtacgggacctaccggtccggcccttcccgtacgacctacgttccggcgggtcctaccgagggtctacggacggtacagtaccttagttacttaggtctactacgtttacaattaccgaagtacgaaccacgtaacgtgtcgtggtaacggttcgggacggtaaggttaccgtaaggtttccgacccggtttccgttaccggtccaacggtccccgtaacgccgttacccgtccccgtttcggtaaccc

SEQ ID NO: 311509 - DNA, 609 bp, Homo sapiens
  misc_feature: GZ8MTXP01D2B5M.25.36.D03.1.454.CMB.2.raw
  modified_base (219)..(219): a, c, t, g, unknown or other
  misc_feature (219)..(219): n is a, c, g, or t
  modified_base (291)..(291): a, c, t, g, unknown or other
  misc_feature (291)..(291): n is a, c, g, or t
  modified_base (482)..(482): a, c, t, g, unknown or other
  misc_feature (482)..(482): n is a, c, g, or t
tcagactgtacagtcacgaccggtgctcgatttagctgcgtcacgatctctcttggggacccaaaaaccacacccctccttgggagaatcccctagatcacagctcctcaccatggactggacctggagcatccttttcttggtggcagcagcaacaggtgcccactcccaggttcaactggtgcagtctggacctggaggtgaagagccgtgggcctnagtgaaggtctccgtgacaggcttcgtggttacactttagcagctagtggcatcgagcgtgggtgacggacncggcccctggaacgaagggtctggagtggagtggacagtggactacgacgtaccttaaaccgattacggtacttacgaacgtacggtaacttaaagtcgaaccgtaaacgtaaagggttaaacgttccccggaaggggtacaacgggtacgttaccctaacgttcgaaccgacacgaaacacacacacganaccacgacgacctacgagtcgacgtgagcgctagagtactcgacgacgacgaacggtcttagtcgttacgtggtcgacgttgacgtcgtattcgtcgtaccgttacgtccggttaacgttaaccccg

SEQ ID NO: 311510 - DNA, 579 bp, Homo sapiens
  misc_feature: GZ8MTXP01A9DS1.25.36.D03.1.454.CMB.2.raw
  modified_base (229)..(229): a, c, t, g, unknown or other
  misc_feature (229)..(229): n is a, c, g, or t
  modified_base (245)..(245): a, c, t, g, unknown or other
  misc_feature (245)..(245): n is a, c, g, or t
  modified_base (309)..(309): a, c, t, g, unknown or other
  misc_feature (309)..(309): n is a, c, g, or t
  modified_base (332)..(332): a, c, t, g, unknown or other
  misc_feature (332)..(332): n is a, c, g, or t
  modified_base (478)..(478): a, c, t, g, unknown or other
  misc_feature (478)..(478): n is a, c, g, or t
tcagactgtacagtcacgaccggtgctcgatttagctgcgtcacgatctctcttggggggggtctcaggaggcagcgctctcgggacgtctccaccatggcctgggctctgctgttcctcaccctcctcactcagggcacagggtcctgggcccagtctgccctgactcagcctgcctccgtgtctgggactcctggacagtcggtcaccatctcctgcactggaaccngccgtgactattggtnacttataactatgtctcctggtcccaacaacacccaggcaacggcccccaaatcatctatttangatgtcagtcagtccggtccctntggtacgttttcccgtggtcgtcttcgtctcgggcctccaagtcctgggcctaaccgtcggccctccctgaccatccgcgggctccgaggctaggacggacgagtctacttattagtgactattcatacagacgaaccactaaacngttccgtaggtggttccggacggggaacgggacctaaagggttcgaccgttccgttcgggtcaccggtaacccagggtccttccggcccccgttggtcccc

SEQ ID NO: 311511 - DNA, 613 bp, Homo sapiens
  misc_feature: GZ8MTXP01BJ55V.25.36.D03.1.454.CMB.2.raw
  modified_base (187)..(187): a, c, t, g, unknown or other
  misc_feature (187)..(187): n is a, c, g, or t
  modified_base (208)..(208): a, c, t, g, unknown or other
  misc_feature (208)..(208): n is a, c, g, or t
  modified_base (262)..(262): a, c, t, g, unknown or other
  misc_feature (262)..(262): n is a, c, g, or t
  modified_base (543)..(543): a, c, t, g, unknown or other
  misc_feature (543)..(543): n is a, c, g, or t
tcagactgtacagtcacgaccggtgctcgatttagctgcgtcacgatctctcttggggagcttcagctgtggtagagaagacaggattcaggacaatctccagcatggccggcctccctctcctcctcaccctcctcactcactgtgcagggtcctgggcccagtctgtgctgactcagccaccctnagtgtcgtcgggacccccggnagaggtctccattctcttgtcgtgggagcagcctccgagtacggaaattagttntctatggtaccagcacgcctaccccgaagaaaccccggccccaagtcctcctacattactaagtaggaatgactcgacgccggccctagaaccgggtacttaccgcggtaccgtacttaccttcgtcggtctaccggaacggttcctcgggtcctccgtccggtccctcgtacggcctagtcgagggtcgggtccgtccgggtacggaggtacgtaggacgtcgtagggtaactttacgttacgtggtacgtcgttagggttcgagtcgcgtagtcgtggngtcgggttcgtaggttcggtcgggacggaggaccaggctaggccgtcgtacgggccaaccggcgaaccgg

SEQ ID NO: 311512 - DNA, 711 bp, Homo sapiens
  misc_feature: GZ8MTXP01EJDVA.25.36.D03.1.454.CMB.2.raw
  modified_base (230)..(230): a, c, t, g, unknown or other
  misc_feature (230)..(230): n is a, c, g, or t
  modified_base (236)..(236): a, c, t, g, unknown or other
  misc_feature (236)..(236): n is a, c, g, or t
  modified_base (246)..(246): a, c, t, g, unknown or other
  misc_feature (246)..(246): n is a, c, g, or t
  modified_base (260)..(260): a, c, t, g, unknown or other
  misc_feature (260)..(260): n is a, c, g, or t
  modified_base (265)..(265): a, c, t, g, unknown or other
  misc_feature (265)..(265): n is a, c, g, or t
tcagactgtacagtcacgaccggtgctcgatttagctgcgtcacgatctctcttgggggggggtctcaggaggcagcgctctcgggacgtctccaccatggcctgggctctgctgttcctcaccctcctcactcagggcacagggtcctgggcccagtctgccctgactcagcctgcctccgtgtctgggactcctggacagtcggtcaccatctcctgcactggaaccngccgtnactgttggtntacttataactatntctcncgaccaacacaccagacaacgaccccaatcatactattatgtatcgtacacgtcacgtccgtcctcgtaggttcgtttccgtcggttcgtcttctccgtacggtcctcgtaagtccgtacggtacctaaccgtcccgtcccttcccgtacgacctacgtccggtcgggtacctaccgtagtcgtacggaacgggtaccggtacgttaccttaacgtttatttacggtttcgttacttaactttacgtaactaaaccgtaacgtaacgtaaaccaaaccgtaaacgtacggttacggttggggttcgggttacggggttaccggggtaacgggttaaaccggtaaacggttaccggttacccggttcccggttaccggtaacccggtaccggtaacccggtaaccgggtacccggttaccccggtcccccggttcccgggtaacccg

SEQ ID NO: 311513 - DNA, 548 bp, Homo sapiens
  misc_feature: GZ8MTXP01EZ871.25.36.D03.1.454.CMB.2.raw
  modified_base (303)..(303): a, c, t, g, unknown or other
  misc_feature (303)..(303): n is a, c, g, or t
  modified_base (354)..(354): a, c, t, g, unknown or other
  misc_feature (354)..(354): n is a, c, g, or t
  modified_base (358)..(358): a, c, t, g, unknown or other
  misc_feature (358)..(358): n is a, c, g, or t
  modified_base (420)..(420): a, c, t, g, unknown or other
  misc_feature (420)..(420): n is a, c, g, or t
tcagactgtacagtcacgaccggtgctcgatttagctgcgtcacgatctctcttggggagcttcagctgtggtagagaagacaggattcaggacaatctccagcatggccggcctccctctcctcctcaccctcctcactcactgtgcagggtcctgggcccagtctgtgctgactcagcccaccctcagtgtcgtcggggacccccggcagagggtctccatctcttgtctgggagcagctccgacgtcggaaatagttgtcactggtaccagcagctaccagaaaccgcccccaagctccncatctaatagaatgactcgacgcggaccctcgacgggactactgacccgtnttcncgtcgctacgagtctcgctccgtcggtccctccgtcgccatcgaggtcggcctccggcgagngtgagcgtaggtatagttacgtgtgtgtggttggtgtcgtcgtacgtcgtggtggtcggttcgggtcggttcggtcgggtcgggacggacgacgcgtcgtaaccgtcgtacgacgtaaccgccgaacg

SEQ ID NO: 311514 - DNA, 670 bp, Homo sapiens
  misc_feature: GZ8MTXP01BC5BL.25.36.D03.1.454.CMB.2.raw
  modified_base (215)..(215): a, c, t, g, unknown or other
  misc_feature (215)..(215): n is a, c, g, or t
  modified_base (295)..(295): a, c, t, g, unknown or other
  misc_feature (295)..(295): n is a, c, g, or t
  modified_base (584)..(584): a, c, t, g, unknown or other
  misc_feature (584)..(584): n is a, c, g, or t
  modified_base (638)..(638): a, c, t, g, unknown or other
  misc_feature (638)..(638): n is a, c, g, or t
tcagactgtacagtcacgaccggtgctcgatttagctgcgtcacgatctctcttggggagcttcagctgtggtagagaagacaggattcaggacaatctccagcatggccggcctccctctcctcctcaccctcctcactcactgtgcagggtcctgggcccagtctgtgctgactcacgcccaccctcagtcgtccgtcggggaccccccgggnaggacgggttcctcctattccttcgttgttcgtgggacgcacgtccgtaccggaacggttacggtaaaatttacggtttntactacgtacggtaccagcaacgtccctaccccgaacggaaaccccgacccccaaagtccctcctactacttactaaagtacggtaaactgtaactcgaccggtcccgtccctacggaaccggtacctaccgtcgaaccgttcttccgtcgtcgacgtacgtacgtcgtcggtccctccgtccgacccctcgtcggacctgtccgtgggtccggtcccgttccgggagagatggaggtctaggggtaaatttgcgtgtcgtaactgggtttgcttcgaccttaggtcgngggtaacgtcgggttcggtaccggttgaccggggacggttaagccttaggtccnggtaacccgttgacgggacctccgaaccgtcg

SEQ ID NO: 311515 - DNA, 721 bp, Homo sapiens
  misc_feature: GZ8MTXP01AEGDT.25.36.D03.1.454.CMB.2.raw
  modified_base (191)..(191): a, c, t, g, unknown or other
  misc_feature (191)..(191): n is a, c, g, or t
  modified_base (214)..(214): a, c, t, g, unknown or other
  misc_feature (214)..(214): n is a, c, g, or t
  modified_base (407)..(407): a, c, t, g, unknown or other
  misc_feature (407)..(407): n is a, c, g, or t
tcagactgtacagtcacgaccggtgctcgatttagctgcgtcacgatctctcttggggagcttcagctgtggtagagaagacaggattcaggacaatctccagcatggccggcctccctctcctcctcaccctcctcactcactgtgcgagggtcctgggcccagtctgtgctgactcacgcccacccgtnagtgtcgtccggggacccccggngaggacgggtctcctatccttcgttgttcgtgggacgtcacgccgtaccggacggtacggtaaaattaggtttgtctacgtggtaccaggcacgccctacccgaacgaaaccccggcccccaagtccctacctacagttactaagtagtaatgatcgacggccggccctagacggtactacgtagaacccgtnttacctcgtggacctacggagttccggtcggtcccgtccccgttcccggtccccgttacccgtacgggtaccctaagtcccggtagggtcccgggggtaccccttcccggggtaccgggaagggttcgtacgggacggtacttaaggggttaaacttacgtttcgttaggtcgtaggttagggtttaggacgttcggcccgtaggttccgagggtaacggttcgggttccgggtacggttcgggtcgggaacgggttaccgacgagggtcccgtacgccccggttacgtcgggaccaacccggaacgtcccggg

SEQ ID NO: 311516 - DNA, 712 bp, Homo sapiens
  misc_feature: GZ8MTXP01CE0EL.25.36.D03.1.454.CMB.2.raw
  modified_base (200)..(200): a, c, t, g, unknown or other
  misc_feature (200)..(200): n is a, c, g, or t
  modified_base (227)..(227): a, c, t, g, unknown or other
  misc_feature (227)..(227): n is a, c, g, or t
  modified_base (243)..(243): a, c, t, g, unknown or other
  misc_feature (243)..(243): n is a, c, g, or t
tcagactgtacagtcacgaccggtgctcgatttagctgcgtcacgatctctcgttggggggggtctcaggaggcagcgctctcgggacgtctccaccatggcctgggctctgctgttcctcaccctcctcactcagggcacagggtcctgggcccagtctgccctgactcagcctgcctccgtgtctggactcctggacngtcgtcaccatctctgcactggaaccngcctgactagttggtntcttataactatgtctctcggtacccaacaaccaccaggaccaacggcccccaatcatcatttatgatgtcagtcactccggccctcgtggtacgtttccgtggtcgtcttctcgtacgggtccctccaagttcgtacggtacctaaccggtccccggtccctccccgtacgaccctacgttccggtccgggggtcctccggacgggtccgtagggaacgggtaccggtacgggttaccttacgtttaagtttacgttacgtaccttatttacgaacttaaccgaacgtaacgtaaaccctaccgtaaaccgtcggttccgtaggggttcgggtttccggggacgggggtaaaccgggttaaccgttaaacgggttccggttaaccccgggtttccgttaccgggtaacccaccgggtaaccccgtaacggggtcccttcccggtaaccccccggttcgggtaaccccg

SEQ ID NO: 311517 - DNA, 652 bp, Homo sapiens
  misc_feature: GZ8MTXP01DYU7Q.25.36.D03.1.454.CMB.2.raw
  modified_base (218)..(218): a, c, t, g, unknown or other
  misc_feature (218)..(218): n is a, c, g, or t
tcagactgtacagtcacgaccggtgctcgatttagctgcgtcacgatctctcttggggacccaaaaaccacacccctccttgggagaatcccctagatcacagctcctcaccatggactggacctggagcattcctttttcttggtggcagcagcaacaggtcgcccactcccaggttcaactggtgcagtctggactgaggtgaagagcgtgggctnagtgagtctctgcagcttctggttacacttagcagctagtggcatcgagcgtgggtcgaccgacgacggccccgtaggaaccggtaagggtctttaggaggtagggtagtgggcagttgggactacgtacggtacccttaaacagttaccggtaatacaacgaagtacgtaatacgaacgaaacgtaagggtaaacgttccggaaggggacaacggtaacgtaccctacgttacgaaccaacgacaaacacactaccgaaccgacgacctaagaccgtacctaacggggactacggggacctagggaacggtactccgtaagaacgtctcggaacgaccgtcgaaccgggttacttaagtacgttacgtggtacggagttagttacgtaacgtagttaagtcggttaacttccgggtaacggttcgtaaccccg

SEQ ID NO: 311518 - DNA, 721 bp, Homo sapiens
  misc_feature: GZ8MTXP01AWOU2.25.36.D03.1.454.CMB.2.raw
  modified_base (278)..(278): a, c, t, g, unknown or other
  misc_feature (278)..(278): n is a, c, g, or t
  modified_base (308)..(308): a, c, t, g, unknown or other
  misc_feature (308)..(308): n is a, c, g, or t
tcagactgtacagtcacgaccggtgctcgatttagctgcgtcacgatctctcttggggagctctgagagcggagccccagccccagaattcccaggtgttttcatttggtgatcagcactgaacacagaggactcaccatggagtttgggctgagtcttgggttttccttgttgttattttccaggtgtccagagtgaggtgcgtagttgggtggagtcggtgggggagcttggtccagccgtgggagggtccgtgagagtctcgtgtcgcagcctcnggtacttcatcttcagtcacctacgtacgnggtacgtcgggtccgaccgacggcgtccggagggggtaacgggggcgtgggaggtggggttggacgtaacgttaagaaagtaaagtaccgtaaagaaagttaaccaaccaaacgaacgaaactaccggccgtcggtactggtaagaaaggacagtattaccttaattacttataacagtaagattagaatttaaacgaaacggtaacttactaacctaggttaactactacgtaaactaaacgtaagtaaaccgaaacggtaaccctaaagggaaaaaaccccggttaacggggaaaccggtaccccgggttacggttaacggtttaactttaaaccggttggttacggttaacccggtaggttaaccaacgggtaccggtttaacggtaacgtttaacccctttaacccccg

SEQ ID NO: 311519 - DNA, 732 bp, Homo sapiens
  misc_feature: GZ8MTXP01BMBHK.25.36.D03.1.454.CMB.2.raw
  modified_base (219)..(219): a, c, t, g, unknown or other
  misc_feature (219)..(219): n is a, c, g, or t
tcagactgtacagtcacgaccggtgctcgatttagctgcgtcacgatctctcttggggacccaaaaaccacacccctccttgggagaatcccctagatcacagctcctcaccatggactggacctggagcattccttttcttggtggcagcagcaacaggtgcccactcccaggttcaactggtgcagtctggacctgaggtgaagagccgtgggcctnagtgaaggtctctgcagtcttgtggttacaccttgcagctagtggcatcgagtcgtgggtcacgacgtacggccccgtagggaacgaaggggtcttaggaggtagggagtcggtacgtagtgggtactacgtaacgtaccttaaaccgagttacggtactacaacgagtaaccttaagttacgaaccgaacgtaacgggtaacttcccgaaggggtacaacggtacgtacccgtacctacggaaacccagaaacggacctaacgaccaccgaaacgggaccaccgttaaacaacggtccccctaaagggtacggttacggggtaaccccgtaggggacccggaacgtaccccggttagggaaaccttacccttacgggaaccgggtaaacccgacccggtaaccggggtaaccctttaaagtttaacgtttaccggaggtcggttaccgttaggttacgttcgtaggtttaacctcgggtaccgttaccgggttcccgaacgtttaaccccgg

SEQ ID NO: 311520 - DNA, 589 bp, Homo sapiens
  misc_feature: GZ8MTXP01BEMNV.25.36.D03.1.454.CMB.2.raw
  modified_base (227)..(227): a, c, t, g, unknown or other
  misc_feature (227)..(227): n is a, c, g, or t
  modified_base (243)..(243): a, c, t, g, unknown or other
  misc_feature (243)..(243): n is a, c, g, or t
  modified_base (262)..(262): a, c, t, g, unknown or other
  misc_feature (262)..(262): n is a, c, g, or t
  modified_base (304)..(304): a, c, t, g, unknown or other
  misc_feature (304)..(304): n is a, c, g, or t
  modified_base (324)..(324): a, c, t, g, unknown or other
  misc_feature (324)..(324): n is a, c, g, or t
tcagactgtacagtcacgaccggtgctcgatttagctgcgtcacgatctctcttggggggggtctcaggaggcagcgctctcgggacgtctccaccatggcctgggctctgctgttcctcaccctcctcactcagggcacagggtcctgggcccagtctgccctgactcagcctgcctccgtgtctgggactcctggacagtcgtcacatctcctgcactggaaccngccgtgactattggtnacttataactatgtctccnggtcccaacaacaccagcaacggccccaaactcatcatttangatgtcagtcatcggccctntggtagtttcctggtcgtcttctcgtggctccgaagtcgtcggaccaaccgtccggcccttcccgtgaaccctgtccggtcggggcctccgacggtccgtggacgggacgaggtccttagttacttagttgtctatttcatacagtacaacacctaacgtagtccgtgggttcggttcgggcgggaacgggaccgtaaagggttcgttacccggttccttccgggtcacggtcccacgggccttccggtcccccttcgggttccc

SEQ ID NO: 311521 - DNA, 626 bp, Homo sapiens
  misc_feature: GZ8MTXP01DC614.25.36.D03.1.454.CMB.2.raw
  modified_base (189)..(189): a, c, t, g, unknown or other
  misc_feature (189)..(189): n is a, c, g, or t
  modified_base (210)..(210): a, c, t, g, unknown or other
  misc_feature (210)..(210): n is a, c, g, or t
  modified_base (243)..(243): a, c, t, g, unknown or other
  misc_feature (243)..(243): n is a, c, g, or t
  modified_base (540)..(540): a, c, t, g, unknown or other
  misc_feature (540)..(540): n is a, c, g, or t
tcagactgtacagtcacgaccggtgctcgatttagctgcgtcacgatctctcttggggagcttcagctgtggtagagaagacaggattcaggacaatctccagcatggccgcctccctctcctcctcaccctcctcactcactgtgcgagggtcctgggcccagtctgtgctgactcacgcccaccctnagtgtcgtccgggaccccggnaggacggtcctctatctcgttgttcgtgggacncagcctaccgaacggtacggtaaattagtttcgactacgtggtaccagcacgcctacccgaagaaccccggcccccaagcctacctacactcaagtagatgactcagtccggcctacgacggtactccgtagacccgtattctacgtcgacgtacgacgttctcgggcccttcccgtccggtccctccgtcggacctacgcgtacggtcggaccgttcggacgtaggagcgtaggacttagggtaaactttacgttactggtagtcgttaggtttcgggattcgtccgtagttccgngggtaacggttcggttccgggtaggtttcggcgggaggacgggttacaggcctaggtcccttagacggttcaaccggcgtaacccg

SEQ ID NO: 311522 - DNA, 801 bp, Homo sapiens
  misc_feature: GZ8MTXP01EPFTD.25.36.D03.1.454.CMB.2.raw
tcagactgtacagtcacgaccggtgctcgatttagctgcgtcacgatctctcttgggggggggtctcaggaggcagcactctcgggacgtctccaccatggcctgggctctgctcctcctcagccctcctcactcagggcacaggatcccgggctcagtctgccctgactcagcctcgctcagtgtccggtctcctggacagtcagtcaccatctctgcactaggaaccagaagtgattcgttggtgtcttatcgacactgtcctccgtgtacctacctaacgtttaacccgaacggaaaccgcccccgaagacgttactacgttacctttaagtgtacgttagttaccgaagggtaaaccggtcccggtacccccgtaccgggtaaccccgggggttcccctacggtaccgttccggtccgtttacccgttcccggttaacgggttaaaccctaaaacgttccggtaccgggtaaccccgtaaacccggtaccccgggttacccccttaccccgttaccgtaacccttaacgttcccgttaaccgggttcggggtcccccttaccgggtaacgggtcccgttagggtaaccgggaggttaccgggtaagggtaccgttaagggttttaaacttttacgtttaaacgttggttcctttggtttacctaaagttcgttacgaccgtaaggtacccgttaaacttacggttttaggtttcgggttcggttacgggacgttaaccggttcggaaccgttaaggtaccggtccgttcggcggttaccaaccgttccgtaacccgg

SEQ ID NO: 311523 - DNA, 677 bp, Homo sapiens
  misc_feature: GZ8MTXP01BICLS.25.36.D03.1.454.CMB.2.raw
  modified_base (229)..(229): a, c, t, g, unknown or other
  misc_feature (229)..(229): n is a, c, g, or t
  modified_base (246)..(246): a, c, t, g, unknown or other
  misc_feature (246)..(246): n is a, c, g, or t
  modified_base (325)..(325): a, c, t, g, unknown or other
  misc_feature (325)..(325): n is a, c, g, or t
tcagactgtacagtcacgaccggtgctcgatttagctgcgtcacgatctctcttggggggggtctcaggaggcagcgctctcgggacgtctccaccatggcctgggctctgctgttcctcaccctcctcactcagggcacagggtcctgggcccagtctgccctgactcagcctgcctccgtgtctgggactcctggacagtcgtcaccatctcctgcactggaacccngccgtgactagttggtntacttataactatcgtcctcctcggtacccaacaaccacccgaggaccaaccggacccccaaactcactactatttacngatcgtcagtcacgtccggcccttgtggtacgtttccgtggttcgtcttcgtcgtcgggtcctccgtaacgtcgtacggcctaaccgtccgggcccttccctacgaacccgtcgttccggtccggggtccttaccggacggtcgtacggaacgggtacgaggtaccttacgttacttagttcgacttactttacaacttaccgaagacaaccaacctaaacgtacggttcgtcgggtcggttaccgggagggtaacgggttaaccgtaacggttaccgttacccggttccgttacgggtaaccgaccgaacccgtaacgggtcccttcccggtcccccgttcgggtaacccc

SEQ ID NO: 311524 - DNA, 611 bp, Homo sapiens
  misc_feature: GZ8MTXP01BA6KI.25.36.D03.1.454.CMB.2.raw
  modified_base (207)..(207): a, c, t, g, unknown or other
  misc_feature (207)..(207): n is a, c, g, or t
  modified_base (233)..(233): a, c, t, g, unknown or other
  misc_feature (233)..(233): n is a, c, g, or t
  modified_base (573)..(573): a, c, t, g, unknown or other
  misc_feature (573)..(573): n is a, c, g, or t
tcagactgtacagtcacgaccggtgctcgatttagctgcgtcacgatctctcttggggagcttcagctgtggtagagaagacaggattcaggacaatctccagcatggccggcctccctctcctcctcaccctcctcactcactgtgcagggtcctgggcccagtctgtgctgactcaaccaccctcagtgtctcgggacccccggnagaggtctcatctcttgttctgggancagctccgacgtacggaaattaagtttgtctacgtggtaccagcacgcctaccccgaacggaaaaccggccccctaaagcctaccctcaactcctaattaaggaatgaatccgaacgccggacccctcgaacggggtacctaccgtacgaacccgtaattcctcgtcggccgtaggtaaacgtcgtcgggtcccttcccgtccgggtcccctcccgttacggccctaacgtcgtacggtcgggccgttcccgggtaccgagggatggaacgtcgtagtaattacgttagtgtgcgtaggttggatcgcctagtcgtgaggtcgtcgacggtggttccggngggaggacgagcgtcgcgtcgtagcacgccgaaggccc

SEQ ID NO: 311525 - DNA, 640 bp, Homo sapiens
  misc_feature: GZ8MTXP01CBJE4.25.36.D03.1.454.CMB.2.raw
  modified_base (264)..(264): a, c, t, g, unknown or other
  misc_feature (264)..(264): n is a, c, g, or t
  modified_base (294)..(294): a, c, t, g, unknown or other
  misc_feature (294)..(294): n is a, c, g, or t
  modified_base (317)..(317): a, c, t, g, unknown or other
  misc_feature (317)..(317): n is a, c, g, or t
  modified_base (365)..(365): a, c, t, g, unknown or other
  misc_feature (365)..(365): n is a, c, g, or t
  modified_base (516)..(516): a, c, t, g, unknown or other
  misc_feature (516)..(516): n is a, c, g, or t
tcagactgtacagtcacgaccggtgctcgatttagctgcgtcacgatctctcttggggagctctgggagaggagcccagcactagaagtcggcggtgtttccattcggtgatcagcactgaacacagaggactcaccatggagtttgggctgagcttgggttttcctcgttgcttcttttaagaggtgtccactgtcaggtgcaccgtggtggagtcgtgggggagcgtggtccagccgtgggacgtccctgagcctctcctgngaagtcctgtgtatttagttcagttgttcnggctagtgcacgtcggggtcccnccgaggcctccggagggcgaacgggggccgtaggtggttgctagttanagcactagtagagtgggtaatttcgagtaatattagcgacctagtaccgttcggaggacgggcctaagttaccaccgtatcctacgagaactaacctaacgttaccccgggaaatagtttacgtagttacttaggaaacgtggttaaccgngtaccgtaggacgttacggtaacggtaacgttccgttcggttaccttgttacgggttaattcggttaggtcggtacggtaaggtacgggtggggttaggggttaacgttaagggtttaaccggg

SEQ ID NO: 311526 - DNA, 765 bp, Homo sapiens
  misc_feature: GZ8MTXP01D7ZR7.25.36.D03.1.454.CMB.2.raw
  modified_base (281)..(281): a, c, t, g, unknown or other
  misc_feature (281)..(281): n is a, c, g, or t
tcagactgtacagtcacgaccggtgctcgattttagctgcgtcacgatctctcttggggacccaaaaaccacacccctccttgggagaatcccctagatcacagctcctcaccatggactggacctggagcattccttttcttggtggcagcagcaacaggtgcccactcccaggttcaactggtgcagtctgacctggaggtgaagagcgtgggctgagtgaggtctctgcaggtcttcgtggttactacctttagcagctatggacatcgagcgtgggncgacgacggcccgtggacgagggtcttggagtggagtggacagtggactcgtaacgtacccttaacgagttacggtactacgacgaacgtacgtaagttacgaacgtaaacgtaaacgggtaacgttaccggaacggggtacgtaacgggtaccttacccgtaaccttacgggaaacccctaacggaaccgttaaacccgaaaccttaaccgtaaccccggaaacgggaaccgtaccccgaaacaaaccgggtaccccttaaaacggggtacggttacggggtaaacccctaaggggtaacgggtaaccgccccggttaaggaaacgttccgttaaccgtaaggaaccccggtaacggttaaaccggggtaaccgttaacctttaaggttacccggttaggtaaccggacgaacggttagttaaccggttaaatttcggttacgttaccggttccgggtttcccggttaacgtttaacccccgg

SEQ ID NO: 311527 - DNA, 598 bp, Homo sapiens
  misc_feature: GZ8MTXP01A7SAJ.25.36.D03.1.454.CMB.2.raw
  modified_base (228)..(228): a, c, t, g, unknown or other
  misc_feature (228)..(228): n is a, c, g, or t
  modified_base (233)..(233): a, c, t, g, unknown or other
  misc_feature (233)..(233): n is a, c, g, or t
  modified_base (242)..(242): a, c, t, g, unknown or other
  misc_feature (242)..(242): n is a, c, g, or t
  modified_base (253)..(253): a, c, t, g, unknown or other
  misc_feature (253)..(253): n is a, c, g, or t
  modified_base (260)..(260): a, c, t, g, unknown or other
  misc_feature (260)..(260): n is a, c, g, or t
tcagactgtacagtcacgaccggtgctcgatttagctgcgtcacgatctctcttggggggggtctcaggaggcagcgctctcgggacgtctccaccatggcctgggctctgctgttcctcaccctcctcactcagggcacagggtcctgggcccagtctgccctgactcagcctgcctccgtgtctgggactcctggacagtcgtcaccatctcctgcactggaaccngcgtnatagttgtntacttatactntctctcncgaccaacaaccaccagaccaaccgaccccaactcactactattatgtatcgtactagtctacgtccgtcctgtcggtcgttccgtcggtctcttctcgtacgtctcgtacgtcgtcgacctaccgtccgtcctcctacgtacctcgtcggtcgggcctcgacggtcgtaggacggacgtacgtacttattattacgtgtacttattacaactacgagacgaaccacgtaacgtcgtcgtggtcggtcgggacggtaacggttacgtaacggttcgaccggttccgttacggtcgaccgaaccgtaacggtccgttacccgtccccgttcggtaaccg

SEQ ID NO: 311528 - DNA, 707 bp, Homo sapiens
  misc_feature: GZ8MTXP01DL1N1.25.36.D03.1.454.CMB.2.raw
  modified_base (237)..(237): a, c, t, g, unknown or other
  misc_feature (237)..(237): n is a, c, g, or t
  modified_base (305)..(305): a, c, t, g, unknown or other
  misc_feature (305)..(305): n is a, c, g, or t
  modified_base (380)..(380): a, c, t, g, unknown or other
  misc_feature (380)..(380): n is a, c, g, or t
tcagactgtacagtcacgaccggtgctcgatttagctgcgtcacgatctctcttggggagcttcagctgtggtagagaagacaggattcaggacaatctccagcatggccggcctccctctcctcctcaccctcctcactcactgtgcagggtcctgggcccagtctgtgctgactcagcccaccctcagtgtcgtcgggacccccgggcagagggtctccatctcttgtctgggancagctccgacgtacggaaatagttgtctactggtaccagcagctacccagaaaccgccccaagctccnatctaatagaatgactcagcgccctgacggactacgtgaacccgatttcctcgtgggacttacggaaagtttccncgggtcctcccgtcccgggcccttaccccgtgggccctagtccgagggttcgggccgttcccgggtaccggaggacttacgggaagggtccttaagggggtaaactttaagttttaaccgtgggttacggccgttaaggggttttcggggaatttccgggacccgttaagggttccgttggggtaacgggtttcggggttcccgggtaacgggtttcggggttccggggaccgggggaaacgggggttaccccaaaagggtcccgttacggggtaacccccgtttccggtaacggttcccgtaaaccggttccccccgtaaacgggg

SEQ ID NO: 311529 - DNA, 597 bp, Homo sapiens
  misc_feature: GZ8MTXP01ARP3Y.25.36.D03.1.454.CMB.2.raw
  modified_base (210)..(210): a, c, t, g, unknown or other
  misc_feature (210)..(210): n is a, c, g, or t
  modified_base (239)..(239): a, c, t, g, unknown or other
  misc_feature (239)..(239): n is a, c, g, or t
  modified_base (426)..(426): a, c, t, g, unknown or other
  misc_feature (426)..(426): n is a, c, g, or t
tcagactgtacagtcacgaccggtgctcgatttagctgcgtcacgatctctcttggggagcttcagctgtggtagagaagacaggattcaggacaatctccagcatggccggcctccctctcctcctccaccctcctcactcactgtgcagggtcctgggcccagtctgtgctgactcagcccaccctcagtgtctcggggacccccggnagagggtctccatctcttgttcgtgggancagcctccgacgtacggaaattagttgactactggtaccagcagcctacccaagaacccggcccccaagcctcctcatctaataggaatgatcgacgccgcctagacggtactacgtgacgtacttcgcgtcggcctacgaagtcgtcggtccctccgtcccggtccctaccgtcggacccagtcgngggttcgggccgttccgggaccgagggtacgtggaacgggtctaggggtaacttaagttcgtggtacgtcgtaggtttcggatcgccgtagtcgtggaagttcgggttccggtaggttcggtacgggcggttacggcaggctacggccgtacgtggcaaccggccgaacgg

SEQ ID NO: 311530 - DNA, 578 bp, Homo sapiens
  misc_feature: GZ8MTXP01ATPM9.25.36.D03.1.454.CMB.2.raw
  modified_base (207)..(207): a, c, t, g, unknown or other
  misc_feature (207)..(207): n is a, c, g, or t
  modified_base (237)..(237): a, c, t, g, unknown or other
  misc_feature (237)..(237): n is a, c, g, or t
  modified_base (323)..(323): a, c, t, g, unknown or other
  misc_feature (323)..(323): n is a, c, g, or t
  modified_base (531)..(531): a, c, t, g, unknown or other
  misc_feature (531)..(531): n is a, c, g, or t
  modified_base (545)..(545): a, c, t, g, unknown or other
  misc_feature (545)..(545): n is a, c, g, or t
tcagactgtacagtcacgaccggtgctcgatttagctgcgtcacgatctctcttggggagcttcagctgtggtagagaagacaggattcaggacaatctccagcatggccggcctccctctcctcctcaccctcctcactcactgtgcagggtcctggcccagtctgtgctgactcagccaccctcagtgtcgtcgggacccccggnaggagggtctccatctcttgttcgtgggancagctaccgacgtcggaaatagttgtctactggtaccagcacgcctacccgaacgaaccggcccccaaagtcctcctctatactanaggatgatcgagcgcctgacggactacgtgaccgtattctcgtcggctacgtaagtcgtggccctccgtccggccctcccgtacggccagtccgaggtcgggccgttaccgggtccgaggatggacgtcgtagggtaattactacgtgttgcgtaggttgggactcgcctaggtccgtaggtgtacggttccggtaggttcgtcgggngggacggcaggtcncggtccgtcgacggttcaaccgttccgaaccgg

SEQ ID NO: 311531 - DNA, 768 bp, Homo sapiens
  misc_feature: GZ8MTXP01A3D3X.25.36.D03.1.454.CMB.2.raw
  modified_base (213)..(213): a, c, t, g, unknown or other
  misc_feature (213)..(213): n is a, c, g, or t
tcagactgtacagtcacgaccggtgctcgatttagctgcgtcacgatctctcttggggagcttcagctgtggtagagaagacaggattcaggacaatctccagcatggccggcctccctctcctcctcaccctcctcactcactgtgcagggtcctgggcccagtctgtgctgactcacgcccaccctcagtgtccgtcggggacccccgggnaggacgggtctccattcttcttgttcgtgggagcagcctccgacgtacggaaattagttgtctactggtaccagcacgcctacccgaacgaaacccgcccccaagcctcctacatactaagtaggaatgactcgacgccggccctacgaacgggtactaccgtgaccgtattcctcgtcggtctacggtaagtcgtcgggtccctccgtcccggtcccctcccgtcggccctagtccgtagggttccggggtcccgttcccggggtaccggagggtacgtacgggtaacggtccgttaaggggtaaactttaacgtttaccggttacgggttggtaccggttaaggggttttcggggaacttccggtaccgttaggttccgttggggtaacgggttccgggggttaccccggggttaagggggttccgggggttaaccgggggacggggaacccgggggttaacccgttaacgggtcccgggttacccgggtaaccccgggtttaccccgggtacggggttacccctaaccggggaacccccggtaaccccgggg

SEQ ID NO: 311532 - DNA, 675 bp, Homo sapiens
  misc_feature: GZ8MTXP01DBS49.25.36.D03.1.454.CMB.2.raw
  modified_base (244)..(244): a, c, t, g, unknown or other
  misc_feature (244)..(244): n is a, c, g, or t
  modified_base (341)..(341): a, c, t, g, unknown or other
  misc_feature (341)..(341): n is a, c, g, or t
  modified_base (356)..(356): a, c, t, g, unknown or other
  misc_feature (356)..(356): n is a, c, g, or t
tcagactgtacagtcacgaccggtgctcgatttagctgcgtcacgatctctcttggggggggtctcaggaggcagcgctctcgggacgtctccaccatggcctgggctctgctgttcctcaccctcctcactcagggcacagggtcctgggcccagtctgccctgactcagcctgcctccgtgtctgggactcctggacagtcggtcacatctctgcactggaaccagcccgtgacattgggtnacttaataaactatgtctcctggtacccaaacaaccaacccaggaccaaacggcccccaaaactcatctaattatgatgtcagtcacgtcggccctntggtagttttccccngggttctcttctcgtggacctccaaagtccgtagggaccaaaccgtccgggtccccttaccccgtacgtaaccctacgttccggtccggggtacctaccgaggtcgtacggacgggacggtaacgtacgttaacgtttaacgtttaagttacgttacttaactttactactaacgtaacgaacgaaaccaaacctaaacgtaacgtacgttgggttaacggttacgggttacgggtaacgggaacggtaacggttacgttaccgttccgttaccggtaacgtacgaaccgaccgtccgttcccgtccccgttccgtccg

SEQ ID NO: 311533 - DNA, 709 bp, Homo sapiens
  misc_feature: GZ8MTXP01DL2C0.25.36.D03.1.454.CMB.2.raw
  modified_base (213)..(213): a, c, t, g, unknown or other
  misc_feature (213)..(213): n is a, c, g, or t
  modified_base (535)..(535): a, c, t, g, unknown or other
  misc_feature (535)..(535): n is a, c, g, or t
tcagactgtacagtcacgaccggtgctcgatttagctgcgtcacgatctctcttggggagcttcagctgtggtagagaagacaggattcaggacaatctccagcatggccgcctccctctcctcctcaccctcctcactcactgtgcagggtcctgggcccagtctgtgctgacctcacgcccaccctgagtcgtccgtccggggaccccggnaggacggtcctccattccttcgtttgttcgtggggactcacgtcctacccggacggttaacggtaaaattaggtttgtactacgtcggtaccagaccacgccctaccgaaacgaaccccgaccccaagtcctccacgattactaagtaaggaattgactacgacgccggtcctacggaacggacttactcggtacccttacttccgtcgtcggtacctacggtaaacggttccgtccggtccccttccccgggtaccccgtcccgtttcccgcgaccgtactcggtacgggtccggtccgttaccgggtccggaggttacgnggtacgtacttaaggttaacttacgttagtggtcgtacggttaggttacgtcgtcgtacgttacggtcggtagggtcgggtcgggttacgggtacgggttcgggtacggggacggaacggttcgttaccggtcgtaccggtaaccgtcgtacggaccgtaaccggaaccgtccg

SEQ ID NO: 311534 - DNA, 642 bp, Homo sapiens
  misc_feature: GZ8MTXP01BHWJZ.25.36.D03.1.454.CMB.2.raw
  modified_base (210)..(210): a, c, t, g, unknown or other
  misc_feature (210)..(210): n is a, c, g, or t
  modified_base (270)..(270): a, c, t, g, unknown or other
  misc_feature (270)..(270): n is a, c, g, or t
  modified_base (382)..(382): a, c, t, g, unknown or other
  misc_feature (382)..(382): n is a, c, g, or t
  modified_base (390)..(390): a, c, t, g, unknown or other
  misc_feature (390)..(390): n is a, c, g, or t
  modified_base (399)..(399): a, c, t, g, unknown or other
  misc_feature (399)..(399): n is a, c, g, or t
  modified_base (443)..(443): a, c, t, g, unknown or other
  misc_feature (443)..(443): n is a, c, g, or t
  modified_base (502)..(502): a, c, t, g, unknown or other
  misc_feature (502)..(502): n is a, c, g, or t
tcagactgtacagtcacgaccggtgctcgatttagctgcgtcacgatctctcttggggagcttcagctgtggtagagaagacaggattcaggacaatctccagcatggccggcctccctctcctcctcaccctcctcactcactgtgcagggtcctgggcccagtctgtgctgactcagcccaccctcagtgtccgtcgggacccccggnaggacggtctccattctcttgttcgtgggagcagcctaccgacgttacggaaattagttntctacgtggtaccagcacgcctaccccgaaggaaaccccggcccccaaaggtcccttccgtactactacgtaagtaggaaatgactcacggccggccctagacggactaccngaaccgtnttcgtccgngctacgtagtctcggtcctccgtacccgtccctaccgtcggacngtcgaggtcggcctccgggtaccgagtcttaggacggtctaggggtaacttagttacgnggttgcggttaggtttgggaactcggtccctagttcgaaggtcggttcgggccggttacgggttcgggttacgggacgggaacggttccaaggtccgtacggtcccggttacgtacgggcaaccgttccccggtaaccgg

SEQ ID NO: 311535 - DNA, 727 bp, Homo sapiens
  misc_feature: GZ8MTXP01BJFYD.25.36.D03.1.454.CMB.2.raw
  modified_base (248)..(248): a, c, t, g, unknown or other
  misc_feature (248)..(248): n is a, c, g, or t
  modified_base (321)..(321): a, c, t, g, unknown or other
  misc_feature (321)..(321): n is a, c, g, or t
tcagactgtacagtcacgaccggtgctcgatttagctgcgtcacgatctctcttggggggggtctcaggaggcagcgctctcgggacgtctccaccatggcctgggctctgctgttcctcaccctcctcactcagggcacgagggtcctgggcccagtctgccctgactcagcctgcctccgtgtcgtgggactccgtggacagtcgtcaccatctcctgcacgtgaaccagccgtgactattgggtntacttaataactatgtcctctcggtacccaaacaacacccaggacaaccggaccccaaactcatctatttacngtatgtcagtcacgtccgtcccttgttggggtttactacggtcgtacttcgtaacgtcggtaccttaaccgtaacggtcgtacgggaccaaaccgtacccgggtaccccttaccctaaacgtaacttccgttcgtcgggaccttaccgagggtaccgtaacggaaaggaccgggtacgtaccgtttagttttacggttttcctgggggttcttcggttggtaccttaagttggtaccggtattaaaacggtaaaacttaaggtttcggtaacggtccggtaacggggtaacgggaccgggtaaacccgttaagttaccgggtaacctttacggtttacgacccggaaacggtaccccgtaaaggggttcccctaccgggttaccccccgtgggttcccttccccgg

SEQ ID NO: 311536 - DNA, 723 bp, Homo sapiens
  misc_feature: GZ8MTXP01CGUAX.25.36.D03.1.454.CMB.2.raw
tcagactgtacagtcacgaccggtgctcgatttagctgcgtcacgatctctcttggggacccaaaaaccacacccctccttgggagaatcccctagatcacagctcctcaccatggactggacctggagcattccttttcttggtggcagcagcaacaggtcgcccactcccaggttcaactggtgcagtctggacctggaggtgaagagccgtgggctgagtgaaggtctcctgcagtcttctgttacacttagcagctatggcatcagcgtgggtcgccgacgaccggtcccctaggaaccgaaggggtctttaggaggtgggagtgggcctagtaggactaccgtacggtaccccttaaaccgagtttacgggtactcgaaacgtagtaacttaacgtacgcgaaacgtaaagggtaaccgtttacccggaaggggaccctaaagggtaccgttacccgtacccgtttaacggaaccctaaaccgaaacggaaaccctaaacgtaacctaacccgaacggaacgacccttaaacgacggtaccccttaacgacggttaccgggtaacccgtagggaacggaccgttccgaaggtaacgtacgttcgaaccggaccgaaccggaaccggtccgtttaaatacgtttacgttaggcggttaaccgagttaccggtgtacgttaagtcgtacgtttaccgtccggttaaccgtttaaccccgg

SEQ ID NO: 311537 - DNA, 730 bp, Homo sapiens
  misc_feature: GZ8MTXP01CWAKZ.25.36.D03.1.454.CMB.2.raw
  modified_base (226)..(226): a, c, t, g, unknown or other
  misc_feature (226)..(226): n is a, c, g, or t
  modified_base (232)..(232): a, c, t, g, unknown or other
  misc_feature (232)..(232): n is a, c, g, or t
tcagactgtacagtcacgaccggtgctcgatttagctgcgtcacgatctctcttggggggggtctcaggaggcagcgctctcgggacgtctccaccatggcctgggctctgctgttcctcaccctcctcactcagggcacagggtcctgggcccagtctgccctgactcagcctgcctccgtgtctggactccgtggacagtcgtcacatctctgcacgtgaaccngccgtnactagttggtctacttaatactatcgtctcgtcgtaccaacacaccagacaacgaccccaatcatctattatgatgtcagtcacgtccggccttagtcggtacgtttccgtggtctcttcgtcgtacggcctcgaagttccgtacgggactaaccgtcccggtaccctacccgtacgaacctcgtccggtcgggccttccggaggtccgtagggaacggacgtacggtctttaacgtttatttaacgttcggtaactttacgtttaacccaagttaaacccgaagggtaaccgttaaacccaaacccgtaacgtttaaccggttccgggtttaagggggttccgggttttaccggggaaacgggggttaaaccgggttaacccggttaaacgggtttcccgggttaaccccggtttccgttccgggttaaccggacccggtaaccccgggtaacgggtccccgttccccggtaacccccgtttcggggttaacccccg

SEQ ID NO: 311538 - DNA, 693 bp, Homo sapiens
  misc_feature: GZ8MTXP01BM7YS.25.36.D03.1.454.CMB.2.raw
  modified_base (210)..(210): a, c, t, g, unknown or other
  misc_feature (210)..(210): n is a, c, g, or t
  modified_base (242)..(242): a, c, t, g, unknown or other
  misc_feature (242)..(242): n is a, c, g, or t
  modified_base (317)..(317): a, c, t, g, unknown or other
  misc_feature (317)..(317): n is a, c, g, or t
tcagactgtacagtcacgaccggtgctcgatttagctgcgtcacgatctctcttggggagcttcagctgtggtagagaagacaggattcaggacaatctccagcatggccggcctccctctcctcctcaccctcctcactcactgtgcagggtcctgggcccagtctgtgctgactcagcccaccctcagtgtcgtcgggacccccgggnaggagggtcctccatctcttgttctgggatcngctccgacgtacggaaattagtttgtctacgtggtaccagcagcctaccccaagaacccggcccccaagcctccncatctataggatgatcagccgcctcgacgggactacgtcgaccgtattctcgtggcctacggaagttccgtcggtcccttcccgtcccgggccccttcccgtacggccctaagtccgtacgggtcggggtcccttcccggggtaccggagggtactagggaacggtccgttaagggtaaacgtttaacgtttacgtacggttcggtaccgtttacgggtttgggaacgtttcggacccgtaggttcctgggtaagggttcccgggttaccgggtacggggttcgggtttaccggggcggggttaacgggaccgaaggtccccggtggtaaccccgtttcccggaacggttccccgaaccccggttaaggtcccccg

SEQ ID NO: 311539 - DNA, 651 bp, Homo sapiens
  misc_feature: GZ8MTXP01AP5XS.25.36.D03.1.454.CMB.2.raw
  modified_base (184)..(184): a, c, t, g, unknown or other
  misc_feature (184)..(184): n is a, c, g, or t
  modified_base (200)..(200): a, c, t, g, unknown or other
  misc_feature (200)..(200): n is a, c, g, or t
  modified_base (322)..(322): a, c, t, g, unknown or other
  misc_feature (322)..(322): n is a, c, g, or t
  modified_base (386)..(386): a, c, t, g, unknown or other
  misc_feature (386)..(386): n is a, c, g, or t
  modified_base (426)..(426): a, c, t, g, unknown or other
  misc_feature (426)..(426): n is a, c, g, or t
tcagactgtacagtcacgaccggtgctcgatttagctgcgtcacgatctctcttggggagctctgggagaggagcccagcactagaagtcggcggtgtttccattcggtgatcagcactgaacacagaggactcaccatggagtttgggctgagcttgggttttcctcgttgcttcttttaagngtgtccatgtcaggtncacgtggtggagtcgtgggggagcgtggtccaggccgtgggggaggtcccctgagacttctccgtgtgaagcccttgtggtatttagtttcgagttggttctggcatcgcacgtggggtccnccagggctccgagggcgaacggggggccgtaggtggggttagcctaaggtttacaggcaaacgngttacgggattcgggtaaattctaagtaattatttacggngacgacgtacgtacggagggaccgggtactactaccgacctataccgacgaagactaaccgtacgttacccggggatagttggtagttaactaggacgttggtccgacgtcgtaggacgcgggtaacgacggttcctcggttacttacgtacgttacgttcggttcggtaacggacgggtaaggtagggtacggggttaggtttaacgggttaaacggttaacgg

SEQ ID NO: 311540 - DNA, 696 bp, Homo sapiens
  misc_feature: GZ8MTXP01BD1DD.25.36.D03.1.454.CMB.2.raw
  modified_base (228)..(228): a, c, t, g, unknown or other
  misc_feature (228)..(228): n is a, c, g, or t
  modified_base (244)..(244): a, c, t, g, unknown or other
  misc_feature (244)..(244): n is a, c, g, or t
  modified_base (265)..(265): a, c, t, g, unknown or other
  misc_feature (265)..(265): n is a, c, g, or t
tcagactgtacagtcacgaccggtgctcgatttagctgcgtcacgatctctcttggggggggtctcaggaggcagcgctctcgggacgtctccaccatggcctgggctctgctgttcctcaccctcctcactcagggcacagggtcctgggcccagtctgccctgactcagcctgcctccgtgtctgggactcctggacagtcgtcaccatctcctgcactggaaccngcccgtgactattggntacttaataactatgtctccncggtacccaacaacaccaggccaaccggccccaaactcactactatttatgatgtcagtcacgtccggtccctcgtggtacgtttccgtggtcgtcttctcgtcgtccttcctaacgtcctagggaccctaaccgtcccgggtacccttcccctacgtaccctacgttcccggtccgggggtccttacccggacgggtcgttacgggacggggaaccggtacgggtactttaaccgtttaagtttacgttacgttacttacttttacaacgttaacacgtaacggaacctaaccgaaacgttcggttacgtcgggttcgggtttccgggacggggtaacgggaaccggttaaacggttcgttacccggttccgttaccgggtaaccgtacgaacccgtaacggtccgttccgtccccggttaacgttcccg

SEQ ID NO: 311541 - DNA, 647 bp, Homo sapiens
  misc_feature: GZ8MTXP01A976M.25.36.D03.1.454.CMB.2.raw
  modified_base (192)..(192): a, c, t, g, unknown or other
  misc_feature (192)..(192): n is a, c, g, or t
  modified_base (244)..(244): a, c, t, g, unknown or other
  misc_feature (244)..(244): n is a, c, g, or t
  modified_base (272)..(272): a, c, t, g, unknown or other
  misc_feature (272)..(272): n is a, c, g, or t
  modified_base (566)..(566): a, c, t, g, unknown or other
  misc_feature (566)..(566): n is a, c, g, or t
tcagactgtacagtcacgaccggtgctcgatttagctgcgtcacgatctctcttggggagctttcagctgtggtagagaagacaggattcaggacaatctccagcatggcccggcctccctctcctcctcacccctcctcactcactgtgcagggtcctgggcccagtctgtgctgactcacgcccaccctnagtgtccgtcgggaccccccggaggacggtctccattctcttgtcgtgggancagcctaccgacgtacggaaattagttntctacgtggtaacccagccacgcctaccccgaaaggaaccccggcccccaagcctcctacgatactatacggtatgactcgacgccggtccctacgacgggactacctgtaccctagttcctcgtggcctacggaagttccgtcgggtcctacccgtccgcccttaccgtcggctatccgaggttcgggcccgttccggtccgggaagcgtaggacggtactaggggtaacttacggtttacctgggttacgtccgttaaggtttcgggaacttcggccgtacgttccgtaggnggttccgggttcccggtaggttcggtacggggacgttacggaccgagcgtcggaacgtcgtacgccgaacgcccgtaacgg

SEQ ID NO: 311542 - DNA, 689 bp, Homo sapiens
  misc_feature: GZ8MTXP01B2MJN.25.36.D03.1.454.CMB.2.raw
  modified_base (210)..(210): a, c, t, g, unknown or other
  misc_feature (210)..(210): n is a, c, g, or t
  modified_base (228)..(228): a, c, t, g, unknown or other
  misc_feature (228)..(228): n is a, c, g, or t
  modified_base (245)..(245): a, c, t, g, unknown or other
  misc_feature (245)..(245): n is a, c, g, or t
tcagactgtacagtcacgaccggtgctcgatttagctgcgtcacgatctctcttgggggggggtctcaggaggcagcgctctcgggacgtctccaccatggcctgggctctgctgttcctcaccctcctcactcagggcacagggtcctgggcccagtctgccctgactcagcctgcctcgtgtctgggactcctggacagtcgtcaccntctctgcacgtggaaccngccgtgactagttggtntacttataactatgtcctcctggtacccaacaaccacccaggaccaaccggacccccaaatcatctatttatcgtaatgtcagtcacgtccggtcctcgtgtacgttttcccgtggttcgtctttctcgtacggtcctcgtaagtccgtgggtccctaaccgttccgggtccccttcccgtacgtaaccctcggttccggtccgggggccttcccgaacgggtcgtaggacggtacgacggtcttaactttacgtttagttacgtacttacgttacaacttacgaacggaacaacccgtaacctaacggtacgtttcggtgggtcgggtttacggggacggggtaacgggttaaccgtacgggtttccggttacccggttccgttccggttaacgaccggtccccgttaacggcccgttcccggtccccgttcgggttaacccc

SEQ ID NO: 311543 - DNA, 704 bp, Homo sapiens
  misc_feature: GZ8MTXP01DLD6K.25.36.D03.1.454.CMB.2.raw
  modified_base (227)..(227): a, c, t, g, unknown or other
  misc_feature (227)..(227): n is a, c, g, or t
  modified_base (242)..(242): a, c, t, g, unknown or other
  misc_feature (242)..(242): n is a, c, g, or t
  modified_base (322)..(322): a, c, t, g, unknown or other
  misc_feature (322)..(322): n is a, c, g, or t
tcagactgtacagtcacgaccggtgctcgatttagctgcgtcacgatctctcttggggggggtctcaggaggcagcgctctcgggacgtctccaccatggcctgggctctgctgttcctcaccctcctcactcagggcacagggtcctgggcccagtctgccctgactcagcctgcctccgtgtctgggactcctggacagtcgtcacatctcctgcactggaaccngccgtgacattggtntacttaataactatcgtctcctggtacccaacaaccacccgaggaccaaaccggacccccaaactcacttctaatttacngatgtacagttccacgttccggaccccttgtaggtacttttccgcggggttcctctttccgtcgtcgggaccttccgtaaagtcctcgggtacctaaaccgtccgggccctcccgtagacccgtagtccggtcggggtccttacccggaggtcctggaacgggtaccgaggtaccctttaaacgtttatttacggttacggtacctttaagtttaccaaattaaccgaaaggtaacaaaccctaaaccctaaagtacggttccgttcgggggttaacggtttcccggggaggggttacgaacccgtaaacgggtttcgaaccccgtttccgttacgggtcaaccggaacccgtaggcccgttaccgtcccccgttggtcccc

SEQ ID NO: 311544 - DNA, 737 bp, Homo sapiens
  misc_feature: GZ8MTXP01CABNB.25.36.D03.1.454.CMB.2.raw
  modified_base (190)..(190): a, c, t, g, unknown or other
  misc_feature (190)..(190): n is a, c, g, or t
  modified_base (211)..(211): a, c, t, g, unknown or other
  misc_feature (211)..(211): n is a, c, g, or t
  modified_base (238)..(238): a, c, t, g, unknown or other
  misc_feature (238)..(238): n is a, c, g, or t
  modified_base (534)..(534): a, c, t, g, unknown or other
  misc_feature (534)..(534): n is a, c, g, or t
tcagactgtacagtcacgaccggtgctcgatttagctgcgtcacgatctctcttggggagcttcagctgtggtagagaagacaggattcaggacaatctccagcatggcccggcctccctctcctcctcaccctcctcactcactgtgcagggtcctgggcccagtctgtgctgactcacgcccaccctnagtgtccgtcgggaccccggnagagggtctctatctcttgtctgggancacgctccgacgtacggaaattagttgtactacgtcggtaccagcacgcctaccccgaacgaaccccggcccccaaagccctcctacattactaagtacggaattgactcgacgccggccctacggacggtactaccgtagacccgtattcctcgtggtacctacggtaacgttccgtcggtcccgtccccgtcccggtccccttcccgtacggccctacgtcggacggtccgggtcccgtcccgggtccggaggtacgtcgggacgtacgttaagggtaaactttacgtttacgnggttagtcggttaagggttttgggaacttcggtaaccggttgttccgggtaagggtcggggtttccgggttcccggggttacgggggttcgggttacccgggggcggggttaaaccgggggacccttaacggggttcccggtaccggtaacccggtttcccgggtaaaggttcccgaacccgggttaacccggtaaccccggg

SEQ ID NO: 311545 - DNA, 611 bp, Homo sapiens
  misc_feature: GZ8MTXP01E0XRR.25.36.D03.1.454.CMB.2.raw
  modified_base (187)..(187): a, c, t, g, unknown or other
  misc_feature (187)..(187): n is a, c, g, or t
  modified_base (208)..(208): a, c, t, g, unknown or other
  misc_feature (208)..(208): n is a, c, g, or t
  modified_base (236)..(236): a, c, t, g, unknown or other
  misc_feature (236)..(236): n is a, c, g, or t
  modified_base (312)..(312): a, c, t, g, unknown or other
  misc_feature (312)..(312): n is a, c, g, or t
tcagactgtacagtcacgaccggtgctcgatttagctgcgtcacgatctctcttggggagcttcagctgtggtagagaagacaggattcaggacaatctccagcatggccggcctccctctcctcctcaccctcctcactcactgtgcagggtcctgggcccagtctgtgctgactcagccaccctnagtgtctcgggacccccgggnagagggtctccatctcttgttctgggancagcctccggacgtcggaaataagttgtctactggtaccagcagcctccccgagaaacccggcccccaagcctccncatctataggaatgatcacgccggccctgacgggtactaccgtgacccgtattcctcgtggcctcgaacgttctcgggccttcccgtccgggcccctccccgtgggcccagtccgaggtccgggccgtcccggtccggaggactggacggcttaggggaattattccgtgtcggctaggtttgggatcggcctagtcgtggaacggttcggttcccgtacgggttggttcccggggacgggacggggcccgaggtcctcggtccccgtccggttaggccctaacggcccccgaacgggg

SEQ ID NO: 311546 - DNA, 730 bp, Homo sapiens
  misc_feature: GZ8MTXP01BIOL2.25.36.D03.1.454.CMB.2.raw
  modified_base (203)..(203): a, c, t, g, unknown or other
  misc_feature (203)..(203): n is a, c, g, or t
  modified_base (330)..(330): a, c, t, g, unknown or other
  misc_feature (330)..(330): n is a, c, g, or t
tcagactgtacagtcacgaccggtgctcgatttagctgcgtcacgatctctcttgggggggggtctcaggaggcagcgctctcgggacgtctccaccatggcctgggctctgctgttcctcaccctcctcactcagggcacgagggtcctgggcccagtctgccctgactcagcctcgcctccgtgtctgggactcctggacngtcggtcaccatctcctgcactaggaaccagccgtagactagttgggtatacttataactatcgtcctccgtcggtacccaaacaaccgacccaggaccaaccggacccccaaatcatactatttangatgtcagtcacgtccggtacccttgtcggtacgtttccgtggttccgtctttccgtcgtcggtcccttaaccgtaagtcccgtacgggtacctaacccgtccggggtccccttcccgtacgaaccctcgtccggtccgggggtccttaccggagggtccgtacgggaacgggaacgtcggtaactttaccgtttaagttcgggttacgtacttaacgttacgtaaactacgaaggtaacctaaccctaactaaacggttcggttcgttcggggttaacgggttccgggagggtaaccggttaccgtaaagggttccgttaacccggttccggttacccgggaacaccggaacccggtaaccgggtcccgttccccggtaacccccgttcgggtttcccc

SEQ ID NO: 311547 - DNA, 786 bp, Homo sapiens
  misc_feature: GZ8MTXP01B4G5H.25.36.D03.1.454.CMB.2.raw
  modified_base (188)..(188): a, c, t, g, unknown or other
  misc_feature (188)..(188): n is a, c, g, or t
  modified_base (210)..(210): a, c, t, g, unknown or other
  misc_feature (210)..(210): n is a, c, g, or t
  modified_base (249)..(249): a, c, t, g, unknown or other
  misc_feature (249)..(249): n is a, c, g, or t
tcagactgtacagtcacgaccggtgctcgatttagctgcgtcacgatctctcttggggagcttcagctgtggtagagaagacaggattcaggacaatctccagcatggccggcctccctctcctcctcaccctcctcactcactgtgcagggtcctgggcccagtctgtgctgactcacgccaccctnagtgtccgtcgggacccccggnaggacggtcctcctattcgttcgtttgttcgtggggacncgacggtcctacccggaacggtacggtaaaattacggtttcgtactacgtcggtaccacgacaccgtcctaccccgaacggaaccccggacccccaaagtccctaccgtctacgtacgttaagtacggtaaatcgtaacgtaccgaccggtcccggaccccttacggaacgggtacctaccgtcgtaacccgtatttccgtcgtcggccttacggacgttccgtccggtcccttcccgtcccggtaccctcccgtcggtaccctagtcccggtagggtccgggtcccgttccggggtaccgaggtacgtcgggacgttcctaaggggttaactttaacgtttcggtacggttcgggaaccggtttggggttttacgggggaacttcggggtcccgttaagggtccgtttagggggaaccgggtttccggggttccggggttacggggttcggggttacccggggcgggaacggggttccacgggtccgtaccgggtaaccggtttcggacgaccgtaaccggaaccgtaacccgggg

SEQ ID NO: 311548 - DNA, 655 bp, Homo sapiens
  misc_feature: GZ8MTXP01AT6ZF.25.36.D03.1.454.CMB.2.raw
  modified_base (190)..(190): a, c, t, g, unknown or other
  misc_feature (190)..(190): n is a, c, g, or t
  modified_base (213)..(213): a, c, t, g, unknown or other
  misc_feature (213)..(213): n is a, c, g, or t
  modified_base (244)..(244): a, c, t, g, unknown or other
  misc_feature (244)..(244): n is a, c, g, or t
  modified_base (499)..(499): a, c, t, g, unknown or other
  misc_feature (499)..(499): n is a, c, g, or t
  modified_base (533)..(533): a, c, t, g, unknown or other
  misc_feature (533)..(533): n is a, c, g, or t
tcagactgtacagtcacgaccggtgctcgatttagctgcgtcacgatctctcttggggagcttcagctgtggtagagaagacaggattcaggacaatctccagcatggccggcctccctctcctcctcacccctcctcactcactgtgcagggtcctgggcccagtctgtcgctgactcacgcccacctnagtcgtccgtcgggacccccggnaggtaggtcctcattctcgttgtcgtgggancgagtcgtaccgaggtacggtaaattacgtttgtactacgtcgtacagcacgcctaccgacgaacccgccccaagcctccacatacgtagtaggattcggactcgaccgccgtacctacgaaccggtctaccgtagtacccgtattcccgtgtccgactaccgtaggttccgtcgggtcccttccccgggtcccgcccctttcccggacggtacctacggtaccgtaggggtccggtcccgtacccgggtaccgnggtacgtggacgtacgtagtaacgtttataccgngtagtcgtagttgggaactcgtctacgttgcggtgtcggttacggtcggttcgggccgggaacggccggaccgttagtccggacgttcccgtcgaacccgttcgaacccgttaacccggccg

SEQ ID NO: 311549 - DNA, 668 bp, Homo sapiens
  misc_feature: GZ8MTXP01EZ35D.25.36.D03.1.454.CMB.2.raw
  modified_base (201)..(201): a, c, t, g, unknown or other
  misc_feature (201)..(201): n is a, c, g, or t
  modified_base (269)..(269): a, c, t, g, unknown or other
  misc_feature (269)..(269): n is a, c, g, or t
  modified_base (308)..(309): a, c, t, g, unknown or other
  misc_feature (308)..(309): n is a, c, g, or t
  modified_base (312)..(312): a, c, t, g, unknown or other
  misc_feature (312)..(312): n is a, c, g, or t
  modified_base (344)..(344): a, c, t, g, unknown or other
  misc_feature (344)..(344): n is a, c, g, or t
tcagactgtacagtcacgaccggtgctcgatttagctgcgtcacgatctctcttgggggggggtctcaggaggcagcgctctcgggacgtctccaccatggcctgggctctgctgttcctcaccctcctcactcagggcacagggtcctgggcccagtctgccctgactcagcctgcctccgtgtctgggactcctggacngtcgtcaccatctcctgcacgtaggaaccagccgtgactagttgggtatacttaataactatgtctcncgtaccaacacaccagcaacgaccccaaatcatcattannatntacagtcacgtcggtcctgtggtagtttccgnggttctcttcgtcgtaacggccttcccgtaaagtccgtacgggtacctaacccgtcccgggtccccttcccgtacgtaaccccgtagttccccgggtccggggtaccttccggaacgggtccgttagggaaccgggaacggtacgtacttaaactttaagttacgggttcgtaacttactttaccaagtacgaagtacgaaccactaaactgtcggtaggttcgggtacggacgggtaacggacgtaacgttaccggaccgttccggttacgtaacgacgtaaccccgtaacgggtccttaccccgccccgttcggtaaccccg

SEQ ID NO: 311550 - DNA, 624 bp, Homo sapiens
  misc_feature: GZ8MTXP01BO3EO.25.36.D03.1.454.CMB.2.raw
  modified_base (203)..(203): a, c, t, g, unknown or other
  misc_feature (203)..(203): n is a, c, g, or t
  modified_base (212)..(212): a, c, t, g, unknown or other
  misc_feature (212)..(212): n is a, c, g, or t
  modified_base (228)..(228): a, c, t, g, unknown or other
  misc_feature (228)..(228): n is a, c, g, or t
  modified_base (235)..(235): a, c, t, g, unknown or other
  misc_feature (235)..(235): n is a, c, g, or t
  modified_base (280)..(280): a, c, t, g, unknown or other
  misc_feature (280)..(280): n is a, c, g, or t
  modified_base (326)..(326): a, c, t, g, unknown or other
  misc_feature (326)..(326): n is a, c, g, or t
  modified_base (336)..(336): a, c, t, g, unknown or other
  misc_feature (336)..(336): n is a, c, g, or t
  modified_base (451)..(451): a, c, t, g, unknown or other
  misc_feature (451)..(451): n is a, c, g, or t
tcagactgtacagtcacgaccggtgctcgatttagctgcgtcacgatctctcttgggggggggtctcaggaggcagcgctctcgggacgtctccaccatggcctgggctctgctgttcctcaccctcctcactcagggcacgagggtcctgggcccagtctgccctgactcagcctgcctccgtgtctgggactccgtggacngtcgtcacntctctgcactgaaccngccgtanactagttggtactacttaatactagtcgtctccgtacgacccaanaaccaccgtaggaccaaccggtacccctaaaactcatactatttanagtatgtacncgtacacgtccggtcctgtggttcgtttccgtcggtctcttacgtcgtcggtctccgtaaagttcgacggactaaccgtcgggacccttcgtacaacgtcgtcgggaccgggtcnccgtaaggctaggacgacgtacgtcttaacttagttaggtctacttacttacaactaacggaagtacaaaccactaagtccgtggttgtcgggttacggacgggtacgttacgtacgttaccgacgttcgcgaaccggacaaccgcggtccacccgggtccccttggtaaccc

SEQ ID NO: 311551 - DNA, 639 bp, Homo sapiens
  misc_feature: GZ8MTXP01ALWZ7.25.36.D03.1.454.CMB.2.raw
  modified_base (170)..(170): a, c, t, g, unknown or other
  misc_feature (170)..(170): n is a, c, g, or t
  modified_base (189)..(189): a, c, t, g, unknown or other
  misc_feature (189)..(189): n is a, c, g, or t
  modified_base (211)..(211): a, c, t, g, unknown or other
  misc_feature (211)..(211): n is a, c, g, or t
  modified_base (404)..(404): a, c, t, g, unknown or other
  misc_feature (404)..(404): n is a, c, g, or t
  modified_base (409)..(409): a, c, t, g, unknown or other
  misc_feature (409)..(409): n is a, c, g, or t
  modified_base (494)..(494): a, c, t, g, unknown or other
  misc_feature (494)..(494): n is a, c, g, or t
  modified_base (548)..(548): a, c, t, g, unknown or other
  misc_feature (548)..(548): n is a, c, g, or t
tcagactgtacagtcacgaccggtgctcgatttagctgcgtcacgatctctcttggggagcttcagctgtggtagagaagacaggattcaggacaatctccagcatggccggcctccctctcctcctcaccctcctcactcactgtgcagggtcctgggcccagtctgtnctgactcacgcccaccctnagtgtcgtcgggaccccccggnaggaggtctccatccttcgttgttcgtggggactccgaggtcccttaccggaacggttacggtaaaatttaaggtttctccgtaacgtagggtacccaggcacggtcctaccccgaaacggaaacccgccccccaaagccctcctcatactagtaggaatgatcgacgccgcctcgaggtctactcgaccgtnttccnctcggctaccgtagtcctgggccctcgtcccgtaccctccgtaggcctagtcgaggtcgtcgtccggacgaggacgtggacggtntaggaatttacgtactcggtgacgtaggtttggacttgaccgtgtccgttaggnggtcgggttccggtggttcggtccggggacggttacgggacccgagtcccggtctaacccggtcgttaggccgaacggttccgaacccggg

SEQ ID NO: 311552 - DNA, 614 bp, Homo sapiens
  misc_feature: GZ8MTXP01ERKGE.25.36.D03.1.454.CMB.2.raw
  modified_base (222)..(222): a, c, t, g, unknown or other
  misc_feature (222)..(222): n is a, c, g, or t
  modified_base (233)..(233): a, c, t, g, unknown or other
  misc_feature (233)..(233): n is a, c, g, or t
  modified_base (353)..(353): a, c, t, g, unknown or other
  misc_feature (353)..(353): n is a, c, g, or t
  modified_base (366)..(366): a, c, t, g, unknown or other
  misc_feature (366)..(366): n is a, c, g, or t
tcagactgtacagtcacgaccggtgctcgatttagctgcgtcacgatctctcttggggagcttcagctgtggtagagaagacaggattcaggacaatctccagcatggccgcctccctctcctcctcacctcctcactcactgtgcagggtcctgggcccagtctgtgctgactcagccaccctcagtgtctcgggacccccggagagggtcctccattctnttgttctggancagctccgacggtcggaaatagttgtctacgtggtaccagcacgctaccccaagaacccgccccaagcctcctcaatctaataggaatgatcgacgccggccctacgacggtactaccgngacccgtattccnctggcctacggaaacgttcctcgggcctcccgtcccgggtccctcccgtacggacctacgttcgacggtcgggcccgttccgggtcccgaagggacttgggacgtcgtaggggtaaatttagttacgtggtacgcgttaaggtttcggatcgtcgtaacgtctaggcgtacggttccggacggttcggttcggagggttaccgaccgaagtccgtacgtaaccgttcgacgccgcgaacccgtaacgg

SEQ ID NO: 311553 - DNA, 658 bp, Homo sapiens
  misc_feature: GZ8MTXP01CT1AK.25.36.D03.1.454.CMB.2.raw
  modified_base (130)..(130): a, c, t, g, unknown or other
  misc_feature (130)..(130): n is a, c, g, or t
  modified_base (200)..(200): a, c, t, g, unknown or other
  misc_feature (200)..(200): n is a, c, g, or t
  modified_base (298)..(298): a, c, t, g, unknown or other
  misc_feature (298)..(298): n is a, c, g, or t
  modified_base (376)..(376): a, c, t, g, unknown or other
  misc_feature (376)..(376): n is a, c, g, or t
  modified_base (385)..(385): a, c, t, g, unknown or other
  misc_feature (385)..(385): n is a, c, g, or t
  modified_base (395)..(395): a, c, t, g, unknown or other
  misc_feature (395)..(395): n is a, c, g, or t
  modified_base (401)..(401): a, c, t, g, unknown or other
  misc_feature (401)..(401): n is a, c, g, or t
tcagactgtacagtcacgaccggtgctcgatttagctgcgtcacgatctctcttgggggggggtctcaggaggcagcgctctcgggacgtctccaccatggcctgggctctgctgttcctcaccctcctnactcagggcacagggtcctgggcccagtctgccctgactcagcctgcctcgtgtctaggactcctggacngtcgtcactatctcctgacctacgtacggaacctagcccgtagactagttggggtactcttaactaaactgtcggttcctaccgtacggaccccaaanaacccacgagacctaaccgcccctaaaatcaagtctaatttacagtatgtcacgctacgccggctacgtgtcttccgnggtctctancgtacgcctnacggtntccggtacacctcggtccctcgtacgtaccgtacgtaccggtcggggtcctaacccggtaggtacgtaggtaacggacgtaccgtaacgttacgtttactttacggttctattacttagactacgaacgtacaacccacgtaacgtgtcgttgggtcgggtcgggacgggtaacggttacggtaaccggtacgttacccggttcgttacggtaaccgtacggtaacccgacgttcgttaccccgtcccgttcgtccc

SEQ ID NO: 311554 - DNA, 623 bp, Homo sapiens
  misc_feature: GZ8MTXP02IU5UX.25.36.D03.1.454.CMB.2.raw
  modified_base (207)..(207): a, c, t, g, unknown or other
  misc_feature (207)..(207): n is a, c, g, or t
  modified_base (210)..(210): a, c, t, g, unknown or other
  misc_feature (210)..(210): n is a, c, g, or t
  modified_base (230)..(230): a, c, t, g, unknown or other
  misc_feature (230)..(230): n is a, c, g, or t
  modified_base (234)..(234): a, c, t, g, unknown or other
  misc_feature (234)..(234): n is a, c, g, or t
tcagactgtacagtcacgaccggtgctcgatttagctgcgtcacgatctctcttggggagcttcagctgtggtagagaagacaggattcaggacaatctccagcatggccggcctccctctcctcctcaccctcctcactcactgtgcagggtcctgggcccagtctgtgctgactcagccaccctcagtgtctgggacccccgggnagnggtctccatctcttgttcgnggancagcctccgacgtacggaaattagttgtctacgtggtaccagcacgcctacccaacgaacccggacccccaacgtcctcctcactctagtaggaatgatcgacgccggccctacgacggactaccgtcgaccgtacttcctcgtcggcctacgaacgtcgtcggcctcccgtcccggtcccttcccgtcggaccctacgtcgtacggtcgggtccgtcccggggtaccggagggtacgtcggacggtacgtacgtaagttagttacgttgtgtcgtaggttaggtagtcgtcgtacgtcgtggtacggtcggtccggtacgggtcggttcgggtacgggacgggaccggacgaacgtcgtaccggtaccgtacggtacgacgaccgacg

SEQ ID NO: 311555 - DNA, 506 bp, Homo sapiens
  misc_feature: GZ8MTXP02ILSTN.25.36.D03.1.454.CMB.2.raw
tcagactgtacagtcacgaccggtgctcgatttagctgcgtcacgatctctcttgggggtctcaggaggcagcgctctcgggacgtctccaccatggcctgggctctgctgttcctcaccctcctcactcagggcacagggtcctgggcccagtctgccctgactcagcctgcctccgtgtctgggactcctggacagtcggtcaccatctcctgcactggaaccagccgtgacattggtgcttataactatgtctcctggtcccaacaacacccaggcaaggcccccaaatcatcatttatgatgtcagtcatcggccctctggagtttcctggtcgcttctctggctcaagtctggcactcggcctccctgaccatctcggggctccaggctgagacgaggctacttattatgctatttcattacagagacaacacagtctggtcgttcggcggacgggaccaagttcgaccgtctcggtcacgccaaggctcgcccctcggtc

SEQ ID NO: 311556 - DNA, 635 bp, Homo sapiens
  misc_feature: GZ8MTXP02GJILD.25.36.D03.1.454.CMB.2.raw
  modified_base (207)..(207): a, c, t, g, unknown or other
  misc_feature (207)..(207): n is a, c, g, or t
  modified_base (234)..(234): a, c, t, g, unknown or other
  misc_feature (234)..(234): n is a, c, g, or t
  modified_base (299)..(299): a, c, t, g, unknown or other
  misc_feature (299)..(299): n is a, c, g, or t
  modified_base (306)..(306): a, c, t, g, unknown or other
  misc_feature (306)..(306): n is a, c, g, or t
tcagactgtacagtcacgaccggtgctcgatttagctgcgtcacgatctctcttggggagcttcagctgtggtagagaagacaggattcaggacaatctcgagcatggccggcctccctctcctcctcaccctcctcactcactgtgcagggtcctgggcccagtctgtgctgactcagccaccctcagtgtcgtcgggaccccggnagaggtctccatctcttgttctgggancagctccgacgtacgaaatagttgctactggtaccagcagctacccagaaccgccccaagcctcncatctanaggatgatcagcgcctgacggactacctgacccgtattcctcgtgggcctacggaacgttccgtcgggccctcccgtcccgggccctcccgtacggccctagtcgaggtcgggccctccgggtcccgaggtactggaggtcctaggtaattagttacgtggtgccgtaggtttgggattcggcccgtaggttccgtaaggtagggttccgggtaccggtacggggtttcgggttccggggaccggggtaacggggtaaccccgtaaaggccgttaccgggaccccgtttacccggttacgggtaccgaccggtacccccgaaaccgggg

SEQ ID NO: 311557 - DNA, 520 bp, Homo sapiens
  misc_feature: GZ8MTXP02GMRPV.25.36.D03.1.454.CMB.2.raw
  modified_base (243)..(243): a, c, t, g, unknown or other
  misc_feature (243)..(243): n is a, c, g, or t
  modified_base (324)..(324): a, c, t, g, unknown or other
  misc_feature (324)..(324): n is a, c, g, or t
tcagactgtacagtcacgaccggtgctcgatttagctgcgtcacgatctctcttggggggtctcaggaggcagcgctctcgggacgtctccaccatggcctgggctctgctgttcctcaccctcctcactcagggcacagggtcctgggcccagtctgccctgactcagcctgcctccgtgtctgggactcctggacagtcggtcaccatctcctgcactggaaccagcccgtgacattggtncttataactatgtctcctggtcccaacaacacccaggcaaggcccccaaatcatcatttatgatgtcagtcatcggccctntggatttcctggtcgcttctctggctccaagtctggcaactcggcctccctgaccatctcggggctccaggctgaggacgaggctacttattattgctatttcatacagagacaccaacagtctggtcgttcggcggacgggaccaaggttcgaccgtccgtacggtcacggcccaaggcctcgccccctggtccc

SEQ ID NO: 311558 - DNA, 507 bp, Homo sapiens
  misc_feature: GZ8MTXP02GTXRG.25.36.D03.1.454.CMB.2.raw
  modified_base (207)..(207): a, c, t, g, unknown or other
  misc_feature (207)..(207): n is a, c, g, or t
  modified_base (350)..(350): a, c, t, g, unknown or other
  misc_feature (350)..(350): n is a, c, g, or t
  modified_base (428)..(428): a, c, t, g, unknown or other
  misc_feature (428)..(428): n is a, c, g, or t
tcagactgtacagtcacgaccggtgctcgatttagctgcgtcacgatctctcttggggagcttcagctgtggtagagaagacaggattcaggacaatctccagcatggccggcctccctctcctcctcaccctcctcactcactgtgcagggtcctgggcccagtctgtgctgactcagccaccctcagtgtctgggacccccgggnagagggtctccatctcttgttctgggagcagctccgacgtcggaaataagttgtctactggtaccagcagctcccagaaacggcccccaagctcctcatctataggaatgatcagcggccctcagggatacctgaccgattcnctggctcgaagtctggctcctcggcctccctggcccatcagtggctccggtccgaggatgaggctgaatattactgtncagtttgggatgccagtctgagtggtcgacggtgttcggcgacgggaccaaggctgaccgtcctaggtcacgcccaagg

SEQ ID NO: 311559 - DNA, 501 bp, Homo sapiens
  misc_feature: GZ8MTXP02F00KI.25.36.D03.1.454.CMB.2.raw
  modified_base (208)..(208): a, c, t, g, unknown or other
  misc_feature (208)..(208): n is a, c, g, or t
  modified_base (352)..(352): a, c, t, g, unknown or other
  misc_feature (352)..(352): n is a, c, g, or t
  modified_base (455)..(455): a, c, t, g, unknown or other
  misc_feature (455)..(455): n is a, c, g, or t
tcagactgtacagtcacgaccggtgctcgatttagctgcgtcacgatctctcttggggagcttcagctgtgggtagagaagacaggactcaggacaatctccagcatggccagcttccctctcctcctcaccctcctcactcactgtgcagggtcctgggcccagtctgtgctgtctcagccaccctcagtgtctggggcccccgggnagagggtcgacatctcttgttctggaagtcgctccaacgtcggcagtaatagtgtaagctggtaccagcaactcccaggaaccgcccccacactcctcatgtatgggaatgatcagcgccctcaggggtcccctgaccgattcnctgcctcacgtctggcacctcagcctccctgccatcccgtggctccaatctgagatgaggccgattattattgtgcagcgtgggatgacaggaagacggttangtcttggaattcgggacaaggtcacgtctaggtcacgccaggaccc

SEQ ID NO: 311560 - DNA, 525 bp, Homo sapiens
  misc_feature: GZ8MTXP02IP8QD.25.36.D03.1.454.CMB.2.raw
  modified_base (206)..(206): a, c, t, g, unknown or other
  misc_feature (206)..(206): n is a, c, g, or t
  modified_base (233)..(233): a, c, t, g, unknown or other
  misc_feature (233)..(233): n is a, c, g, or t
  modified_base (406)..(406): a, c, t, g, unknown or other
  misc_feature (406)..(406): n is a, c, g, or t
tcagactgtacagtcacgaccggtgctcgatttagctgcgtcacgatctctcttggggagcttcagctgtggtagagaagacaggattcaggacaatctccagcatggccggcctccctctcctcctcaccctcctcactcactgtgcagggtcctgggcccagtctgtgctgactcagccaccctcagtgtctgggaaccccggnagaggtctccatctcttgttctgggancagctccgacgtcggaaattagttgtctactggtaccagcagctccagaaccgccccaagctcctcatctatagaatgatcagcggccctgagggatacctgaccgtattcctctggctcgaagtctggctcctcggccctccctggcccatcagtcggcctccggccgaggntggaggctggaattattactggtgcgtaggtttgggatcgcctagtctggacgttcggtccggacggttggttcgggcggacgggaccagcgtcgaccgtcgtaggtccacgcccacgg

SEQ ID NO: 311561 - DNA, 525 bp, Homo sapiens
  misc_feature: GZ8MTXP02GW4VF.25.36.D03.1.454.CMB.2.raw
  modified_base (304)..(304): a, c, t, g, unknown or other
  misc_feature (304)..(304): n is a, c, g, or t
tcagactgtacagtcacgaccggtgctcgatttagctgcgtcacgatctctcttgggggggtctcaggaggcagcgctctcgggacgtctccaccatggcctgggctctgctgttcctcaccctcctcactcagggcacagggtcctgggcccagtctgccctgactcagcctgcctccgtgtctgggactcctggacagtcggtcaccatctcctgcactggaaccagccgtgacattggtgcttataactatgtctcctgtcccaacaacacccaggcaacggcccccaaatcatcatttangatgtcagtcatccggccctgtggtagtttcctggtctcttctctggctccagtctggccaacgtcggcctccctgaccatcgtcggggctccgaggcctaggacggacgaggtcttacgttattattgctatttcatacagacgacaacacagtctggtcgtcggcggtacggacctaaggttcgaccgtcgtcgcacgccaggcctcgccccgtcgtcc

SEQ ID NO: 311562 - DNA, 522 bp, Homo sapiens
  misc_feature: GZ8MTXP02HVSA8.25.36.D03.1.454.CMB.2.raw
  modified_base (228)..(228): a, c, t, g, unknown or other
  misc_feature (228)..(228): n is a, c, g, or t
  modified_base (244)..(244): a, c, t, g, unknown or other
  misc_feature (244)..(244): n is a, c, g, or t
  modified_base (439)..(439): a, c, t, g, unknown or other
  misc_feature (439)..(439): n is a, c, g, or t
  modified_base (486)..(486): a, c, t, g, unknown or other
  misc_feature (486)..(486): n is a, c, g, or t
tcagactgtacagtcacgaccggtgctcgatttagctgcgtcacgatctctcttgggggggtctcaggaggcagcgctctcgggacgtctccaccatggcctgggctctgctgttcctcaccctcctcactcagggcacagggtcctgggcccagtctgccctgactcagcctgcctccgtgtctgggactcctggacagtcggtcaccatctcctgcactggaaccngccgtgactattggtncttataactatgtctcctggtccaacaacaccagcaaggccccaaactcatcatttatgatgtcagtcatcggccctctggtagtttcctggtccgtcttctctggctcaagtctgcaactcgcctccctgaccatctcggggctccgaggcctgaggacgaggcttacttatttattgtctatttcatacaganacacaacagtcgtagtgttcggcggacggtccaaagttcgaccgtcncggtcacgcccgacggcttccgccccgttcggtccc

SEQ ID NO: 311563 - DNA, 666 bp, Homo sapiens
  misc_feature: GZ8MTXP02IWP8W.25.36.D03.1.454.CMB.2.raw
  modified_base (244)..(244): a, c, t, g, unknown or other
  misc_feature (244)..(244): n is a, c, g, or t
  modified_base (257)..(257): a, c, t, g, unknown or other
  misc_feature (257)..(257): n is a, c, g, or t
  modified_base (308)..(308): a, c, t, g, unknown or other
  misc_feature (308)..(308): n is a, c, g, or t
tcagactgtacagtcacgaccggtgctcgatttagctgcgtcacgatctctcttggggggtctcaggaggcagcgctctcgggacgtctccaccatggcctgggctctgctgttcctcaccctcctcactcagggcacagggtcctgggcccagtctgccctgactcagcctgcctccgtgtctgggactcctggacagtcggtcaccatctcctgcactggaaccagccgtgactattgggtntacttaataactntgtcctcgtcgtacccaacaccaccgagacaccgaccccaatcatctattnagatgcagtcagtccgcctgtaggtctttcgtggtcgtcttctcgtcgtcctcgtacgtcgtcggacctaccgtccggtcccttcccgtacgacctactccggtcgggtcctccgacggtccgtaggaacggacggtacggtaccttaactttaatttacgttacgtacttactttacaacttaaccgaggtaacgaacccgaaaccaaacgtacgttccggttagggtttcggggttaccggggacggggaacggggtaaacccgttaagggttaccggtacccggtttcccgtaccggttaaccgacccggacccgaacgggtccccgtacccggtcccccggttcggttaccccg

SEQ ID NO: 311564 - DNA, 504 bp, Homo sapiens
  misc_feature: GZ8MTXP02FXBG9.25.36.D03.1.454.CMB.2.raw
  modified_base (243)..(243): a, c, t, g, unknown or other
  misc_feature (243)..(243): n is a, c, g, or t
  modified_base (323)..(323): a, c, t, g, unknown or other
  misc_feature (323)..(323): n is a, c, g, or t
tcagactgtacagtcacgaccggtgctcgatttagctgcgtcacgatctctcttgggggggtctcaggaggcagcgctctcgggacgtctccaccatggcctgggctctgctgttcctcaccctcctcactcagggcacagggtcctgggcccagtctgccctgactcagcctgcctccgtgtctgggactcctggacagtcggtcaccatctcctgcactggaaccagccgtgacattggtncttataactatgtctcctggtccaacaacacccaggcaaggcccccaaactcatcatttatgatgtcagtcatcggcctntggagtttcctgtcgcttctctgctcagtctgcactcggcctccctgaccatcgcgggctccgagctgaggcgaggctacgttattattgctatttcaatacagagacacaacagtcgtggtcgttcggcggacgggaccaagttcgaccgtctcggtcacgcccaggctcgcccctgtcc

SEQ ID NO: 311565 - DNA, 503 bp, Homo sapiens
  misc_feature: GZ8MTXP02JT98I.25.36.D03.1.454.CMB.2.raw
  modified_base (242)..(242): a, c, t, g, unknown or other
  misc_feature (242)..(242): n is a, c, g, or t
  modified_base (303)..(303): a, c, t, g, unknown or other
  misc_feature (303)..(303): n is a, c, g, or t
  modified_base (459)..(459): a, c, t, g, unknown or other
  misc_feature (459)..(459): n is a, c, g, or t
tcagactgtacagtcacgaccggtgctcgatttagctgcgtcacgatctctcttggggggtctcaggaggcagcgctctcgggacgtctccaccatggcctgggctctgctgttcctcaccctcctcactcagggcacagggtcctgggcccagtctgccctgactcagcctgcctccgtgtctgggactcctggacagtcggtcaccatctcctgcactggaaccagccgtgacattggtncttataactatgtctcctggtcccaacaacacccaggcaaggcccccaaatcatcatttangatgtcagtcatcggccctctggatttcctgtcgcttctctggctccagtctggctcctcgcctccctgccatcagtcggctccggtccgaggatgaggctagattatactgtgcgtagtttgggatgcagtctgagtggtccgacggtgtcgggnggacgggaccagctgaaccgtcctaggtcagcccaaggctccgg

SEQ ID NO: 311566 - DNA, 586 bp, Homo sapiens
  misc_feature: GZ8MTXP02F6OF8.25.36.D03.1.454.CMB.2.raw
  modified_base (305)..(305): a, c, t, g, unknown or other
  misc_feature (305)..(305): n is a, c, g, or t
  modified_base (344)..(344): a, c, t, g, unknown or other
  misc_feature (344)..(344): n is a, c, g, or t
  modified_base (348)..(348): a, c, t, g, unknown or other
  misc_feature (348)..(348): n is a, c, g, or t
  modified_base (363)..(363): a, c, t, g, unknown or other
  misc_feature (363)..(363): n is a, c, g, or t
  modified_base (375)..(375): a, c, t, g, unknown or other
  misc_feature (375)..(375): n is a, c, g, or t
tcagactgtacagtcacgaccggtgctcgatttagctgcgtcacgatctctcttggggagctctgggagaggagcccagcactagaagtcggcggtgtttccattcggtgatcagcactgaacacagaggactcaccatggagtttgggctgagctgggttttcctcgttgctcttttaagaggtgtccactgtcaggtgcacctggtggagtcgtgggggagcgtggtccagcctgggagtccctgagctctcctgtgaagcctctggatttagttcagtggttctggcatgcacgtgggtccnccaggctccgagggcaaggggccgagtggtggcagttangcangtgagtggtaacttntagtaatattangacagtaccgtcggtaggaacggctatccacctatccacgagacaactaacgtaccgaatagttagtagttacgttaggaagtggtacacgtccgtaggaacggtacggtacggacggtaccgtccgggtcttacgttacgttacttacgtggtaacggacggtaaggtacgggtacgggggtaagggttacgggtttaacggtttaacgg

SEQ ID NO: 311567 - DNA, 525 bp, Homo sapiens
  misc_feature: GZ8MTXP02GC8RK.25.36.D03.1.454.CMB.2.raw
  modified_base (244)..(244): a, c, t, g, unknown or other
  misc_feature (244)..(244): n is a, c, g, or t
  modified_base (307)..(307): a, c, t, g, unknown or other
  misc_feature (307)..(307): n is a, c, g, or t
  modified_base (441)..(441): a, c, t, g, unknown or other
  misc_feature (441)..(441): n is a, c, g, or t
tcagactgtacagtcacgaccggtgctcgatttagctgcgtcacgatctctcttgggggggtctcaggaggcagcgctctcgggacgtctccaccatggcctgggctctgctgttcctcaccctcctcactcagggcacagggtcctgggcccagtctgccctgactcagcctgcctccgtgtctgggactcctggacagtcggtcaccatctcctgcactggaaccagccgtgacattgggtncttaataactatgtctcctggtccccaacaacacccaggcaaggcccccaaatcatcatttangatgtcagtcatcggccctctggtagtttctggtcgcttctctggctccaagtctggcaactcgcctccctgacccatcgtcgggctccgagctgaggacgaggctaacttattattgctatttcataacaganacacaacagtctggtcgttcggacggacggaaccaaagttcgaacccgtcctacggtcacgcccaaggcctcgccccctggtcc

SEQ ID NO: 311568 - DNA, 807 bp, Homo sapiens
  misc_feature: GZ8MTXP02HANWC.25.36.D03.1.454.CMB.2.raw
  modified_base (209)..(209): a, c, t, g, unknown or other
  misc_feature (209)..(209): n is a, c, g, or t
  modified_base (237)..(237): a, c, t, g, unknown or other
  misc_feature (237)..(237): n is a, c, g, or t
tcagactgtacagtcacgaccggtgctcgatttagctgcgtcacgatctctcttggggagcttcagctgtggtagagaagacaggattcaggacaatctccagcatggccggcctccctctcctcctcaccctcctcactcactgtgcagggtcctgggcccagtctgtgctgactcagcccaccctcagtcgtcgtcgggaccccggnagaggtctccattctcttgttctgggancagcctccgacgtacgtaaattagttgtctacgtcggtaccagcacgcctacccgaacggaaaccccggcccccaaagtcccttacccctactaacttaccgttaagtaaacgggtaaacttcggaaacttcccggaaacggtcccggtaccccccgttaggaacccggggtaccttaacccgtcggtaaacccgttctttccgtccgtcgggtccttacggtaacgttcgtccggtccttcccgtcccgggtccctcccgtacgggacctacgtccggacgggttcggggtcccgtacccggggtaccggagggtagttacggaagggttaccttagaaagttttaacgttccggttaggggttccgtacggtttaacgggttttagggggacttaccgggtaccgttagggtttcccggtaggggttaacggggtttccggggttaacccggggtacgggtttcgggggtaccggggaacggggaaacccgggtaccgtaaacggtccgtaccggggtaccccgtttacccggtaggtaccccgtaccggggacccccgttaacgggg

SEQ ID NO: 311569 - DNA, 521 bp, Homo sapiens
  misc_feature: GZ8MTXP02HNLFU.25.36.D03.1.454.CMB.2.raw
  modified_base (309)..(309): a, c, t, g, unknown or other
  misc_feature (309)..(309): n is a, c, g, or t
  modified_base (460)..(460): a, c, t, g, unknown or other
  misc_feature (460)..(460): n is a, c, g, or t
  modified_base (464)..(464): a, c, t, g, unknown or other
  misc_feature (464)..(464): n is a, c, g, or t
  modified_base (473)..(473): a, c, t, g, unknown or other
  misc_feature (473)..(473): n is a, c, g, or t
  modified_base (493)..(493): a, c, t, g, unknown or other
  misc_feature (493)..(493): n is a, c, g, or t
tcagactgtacagtcacgaccggtgctcgatttagctgcgtcacgatctctcttgggggggtctcaggaggcagcgctctcgggacgtctccaccatggcctgggctctgctgttcctcaccctcctcactcagggcacagggtcctgggcccagtctgccctgactcagcctgcctcgtgtctgggactcctggacagtcggtcaccatctcctgcactggaaccaggcccgtgactattggtgacttataactatgtctcctggtcccaacaacacccaggcaacggcccccaaactcatcatttangatgtcagtcatcggccctctggtagttcctggtcgtcttctctcggctccaagtctggcaaccgtcggccctccctcgaccagtcgtcggggctccgaggcctgacggacgaggctacttattattgctatttacatacagagacacaanatcngtagtcggngaggaccaagtcgaccgtcncggtcacgccacggctcgcccctcgtcc

SEQ ID NO: 311570 - DNA, 553 bp, Homo sapiens
  misc_feature: GZ8MTXP02JWX08.25.36.D03.1.454.CMB.2.raw
  modified_base (383)..(383): a, c, t, g, unknown or other
  misc_feature (383)..(383): n is a, c, g, or t
  modified_base (397)..(397): a, c, t, g, unknown or other
  misc_feature (397)..(397): n is a, c, g, or t
  modified_base (404)..(404): a, c, t, g, unknown or other
  misc_feature (404)..(404): n is a, c, g, or t
tcagactgtacagtcacgaccggtgctcgatttagctgcgtcacgatctctcttggggagctctgagagcggagccccagccccagaattcccaggtgttttcatttggtgatcagcactgaacacagaggactcaccatggagtttgggctgagctgggtttccttgttgttattttcctaggtgtccagagtgaggtgcagttggtggagtcgtgggggaggcttggtccagcctggagggtccgtgagagtctcctgtgcagcctctggattcatcttcagtgaccactaaatggactgggtccgccaggctccgagggaaggggctggagtgggtgcgatagaataagctaagagttacacacagatacgcgcgtctgngaaaggcagacttnatatcanaagagatgtactacgaaagactacattgtatctagacaactaagaacgaacgacgtaacgaaaaccggaaacggaacgaccggaccggtacgtacgttacgtacgtacgtaacgtacggtacgtacgtacgtacggtacgtacgtaccg

SEQ ID NO: 311571 - DNA, 516 bp, Homo sapiens
  misc_feature: GZ8MTXP02HQ4ZF.25.36.D03.1.454.CMB.2.raw
  modified_base (239)..(239): a, c, t, g, unknown or other
  misc_feature (239)..(239): n is a, c, g, or t
  modified_base (319)..(319): a, c, t, g, unknown or other
  misc_feature (319)..(319): n is a, c, g, or t
  modified_base (425)..(425): a, c, t, g, unknown or other
  misc_feature (425)..(425): n is a, c, g, or t
  modified_base (487)..(487): a, c, t, g, unknown or other
  misc_feature (487)..(487): n is a, c, g, or t
tcagactgtacagtcacgaccggtgctcgatttagctgcgtcacgatctctcttgggggtctcaggaggcagcgctctcgggacgtctccaccatggcctgggctctgctgttcctcaccctcctcactcaggcacagggtcctgggcccagtctgccctgactcagcctgcctccgtgtctgggactcctggacagtcgtcaccatctcctgcactggaaccagccgtgacattgggncttataactatgtctcctggtcccaacaacacccaggcaacggcccccaaatcatcatttatgatgtcagtcatcgcctntggatttcctgtcgcttctctgctccaagtctggcaactcgctccctgaccatctcgggctccgaggctgagacgaggctacttattattgtctatttcaatacanagacaccaacagtctggtcgttcgggcggaacgggaccaaaggttcgaaccgtccttcggcncgacccgaagccttcgccccctcggtccc

SEQ ID NO: 311572 - DNA, 611 bp, Homo sapiens
  misc_feature: GZ8MTXP02I8YVA.25.36.D03.1.454.CMB.2.raw
  modified_base (209)..(209): a, c, t, g, unknown or other
  misc_feature (209)..(209): n is a, c, g, or t
  modified_base (238)..(238): a, c, t, g, unknown or other
  misc_feature (238)..(238): n is a, c, g, or t
tcagactgtacagtcacgaccggtgctcgatttagctgcgtcacgatctctcttggggagcttcagctgtggtagagaagacaggattcaggacaatctccagcatggccggcctccctctcctcctcaccctcctcactcactgtgtaggtcctgggcccagtctgtgctgactcagcccaccctcagtgtcgtcgggaccccccggnaggagggtctccatctcttgttctgggancagcctccgacgtacggaaaattagtttgtctactggtaccagcagcctcccaagaaaccggcccccaagcctcctcatctataggaatgatcagccgccctcgaggactaccgtgaccgtattctctggctcgaagtcgtcgcctccgtcggccctcccgtggcccatcgaggttcgggccgtcccgggtccggaggagtggaggtctaggtaaattacgtttacgtggttgacgttaggtttggggattcggaccgtaggtcgtgggtaggttcgggtaccccggtagggttcggttaccggggcggggtacgggaacccgaaggcgttcggaacccggtccgttacgggccacggacccgaaggtccccg

SEQ ID NO: 311573 - DNA, 529 bp, Homo sapiens
  misc_feature: GZ8MTXP02HSMOX.25.36.D03.1.454.CMB.2.raw
  modified_base (403)..(403): a, c, t, g, unknown or other
  misc_feature (403)..(403): n is a, c, g, or t
  modified_base (408)..(408): a, c, t, g, unknown or other
  misc_feature (408)..(408): n is a, c, g, or t
tcagactgtacagtcacgaccggtgctcgatttagctgcgtcacgatctctcttggggggtctcaggaggcagcactctcgggacgtctccaccatggcctgggctctgctcctcctcagcctcctcactcagggcacaggatcccgggctcagtctgccctgactcagcctcgctcagtgtccgggtctcctggacagtcagtcaccatctcctgcactggaaccagaagtgatcttggtgcttatgacactgtctcctggcaccagtttacccagaaagcccccagagtcatccttatgatgtcaggaagcggcctcacggggtccctgatcgcttctctgggtccaaatctggcaacacggccctccctgaccatctctgggctcccgaggcctgagagngaggngtagtattattattgtcgtgtatatatgtacgagactaactacgttagtttacggttcggttacggtcgtacgtacggtacgtaacgtacgtaccgtaccgtacggtacgacgaccgaacg

SEQ ID NO: 311574 - DNA, 546 bp, Homo sapiens
  misc_feature: GZ8MTXP02JUKLG.25.36.D03.1.454.CMB.2.raw
  modified_base (320)..(320): a, c, t, g, unknown or other
  misc_feature (320)..(320): n is a, c, g, or t
  modified_base (356)..(356): a, c, t, g, unknown or other
  misc_feature (356)..(356): n is a, c, g, or t
tcagactgtacagtcacgaccggtgctcgatttagctgcgtcacgatctctcttgggagatgggtcctgtcccagatgcacctgcaggagtcgggcccaggactggtgaagccttcggagaccctgtccctcacctgcagtgtctctggtggctccgtcagtgcttattactggagctggatccgcagtccgccgggagggactggagtggattgggcgtatatatacgaatggattaaccacctacaacccctcctcaagagtcgagtcaccatatcagcggacacgtccagggatcaggtgtcctgcatctgacttcngcgactgccgccggacacggccctatactactgtcnccagacgattcggactgacgacgtattttcggagtaattattattctttgtgtctttgactagtgtgggccaagggacgacggtcaccgtctcttcagcctccaccgaaacgggcccacgtccggtccttcccccgtcggcctacccctcctaccaacgaacgccaccgtcgcggggccacgacgcccgg

SEQ ID NO: 311575 - DNA, 516 bp, Homo sapiens
  misc_feature: GZ8MTXP02IP93T.25.36.D03.1.454.CMB.2.raw
  modified_base (237)..(237): a, c, t, g, unknown or other
  misc_feature (237)..(237): n is a, c, g, or t
tcagactgtacagtcacgaccggtgctcgatttagctgcgtcacgatctctcttggggagcttcagctgtggtagagaagacaggattcaggacaatctccagcatggccggcctccctctcctcctcacccctcctcactcactgtgcagggtcctgggcccagtctgtgctgactcagccaccctcagtgtctcgggacccccgggcagagggtctccatctcttgttctgggancagctccgacgtcggaaatagttgtctactggtaccagcagctccccagaaccggccccaagcctcctcatctataggaatgatcagccggccctcgagggatacctgaccgtattctctggctcgaagtctcggctcctcggcctcctgccatcagtggcctcggtcgagatgagctagaattattactgtgctaggtttgggatgcctagtctggtagtggtccgacggttgttcggcggacggaccaagcgtcgaccgtctaggtcacgccaacgg

SEQ ID NO: 311576 - DNA, 525 bp, Homo sapiens
  misc_feature: GZ8MTXP02F5R94.25.36.D03.1.454.CMB.2.raw
  modified_base (243)..(243): a, c, t, g, unknown or other
  misc_feature (243)..(243): n is a, c, g, or t
  modified_base (324)..(324): a, c, t, g, unknown or other
  misc_feature (324)..(324): n is a, c, g, or t
  modified_base (460)..(460): a, c, t, g, unknown or other
  misc_feature (460)..(460): n is a, c, g, or t
tcagactgtacagtcacgaccggtgctcgatttagctgcgtcacgatctctcttgggggggtctcaggaggcagcgctctcgggacgtctccaccatggcctgggctctgctgttcctcaccctcctcactcagggcacagggtcctgggcccagtctgccctgactcagcctgcctccgtgtctgggactcctggacagtcggtcaccatctcctgcactggaaccagccgtgacattggtncttataactatgtctcctggtcccaacaacacccaggcaaggcccccaaatcatcatttatgatgtcagtcatcggccctntggtatttcctggtcgcttctctggctccaagtctggcaactcggcctccctgacctatcgtcgggctccaggcctgaggacgagctacttattatgctatttcatacagagacaacacagtctaggtcgttcggnggacgggacctaaagttcgaacccgtcctcggtaacacgcccgaaggcctcgccccctggtaccc

SEQ ID NO: 311577 - DNA, 549 bp, Homo sapiens
  misc_feature: GZ8MTXP02FKUGX.25.36.D03.1.454.CMB.2.raw
  modified_base (208)..(208): a, c, t, g, unknown or other
  misc_feature (208)..(208): n is a, c, g, or t
  modified_base (236)..(236): a, c, t, g, unknown or other
  misc_feature (236)..(236): n is a, c, g, or t
tcagactgtacagtcacgaccggtgctcgatttagctgcgtcacgatctctcttggggagcttcagctgtggtagagaagacaggattcaggacaatctccagcatggccggcctccctctcctcctcaccctcctcactcactgtgcagggtcctgggcccagtctgtgctgactcagccaccctcagtgtctcgggacccccgggnagagggtctccatctcttgttctgggancagctccgacgtcggaaatagttgtctactggtaccagcagcctcccaagaaaccggcccccaagcctcctcatctataggaatgatcagcggcccctgacgggactacctgaccgattctcgtggctcgaagtctggctccgcggccctcccgtggcccatcagtcgggcctccggtcgagatgaggctagaatattactggtgcgtaggtttgggattgcctagtcgtggaggtcggtccggtacgggttggttcggggacgggacgggacccaaaggcgtacggacccgtcgtaggtcacggcccaacgg

SEQ ID NO: 311578 - DNA, 704 bp, Homo sapiens
  misc_feature: GZ8MTXP02H7YUE.25.36.D03.1.454.CMB.2.raw
  modified_base (209)..(209): a, c, t, g, unknown or other
  misc_feature (209)..(209): n is a, c, g, or t
tcagactgtacagtcacgaccggtgctcgatttagctgcgtcacgatctctcttggggagcttcagctgtggtagagaagacaggattcaggacaatctccagcatggccggcctccctctcctcctcaccctcctcactcactgtgcagggtcctgggcccagtctgtgctgactcagccaccctcagtgtctcgggaccccccgggnaggaggtctcatctcttgttcgtgggagcagctccgacgtaggaaattagttgtctacgtcggtaccagcagcctacccgaacggaaccgccccaagcctacctacatactaagtaaggaatagatacgacgccggccctacgaacggtactaccgtcgaccgtatttccgtcgtcggtcgtacgaacgttccgtcggtcctcccgtcccggcccttcccgacgacctacgtccgaggtcgggccgtcccgggtaccggaggtacgtaggacggtcttaggtaaatttaacgtttacgtggttacgtacgttaagggtttgggacgttcggtaccgtaggttcgttagggtacggttacggggttacccgggtaacggggtttcggggtttacccgggggaccggggtaaacggggaaacccgtaaacggtcccggttaccggaaccccggttaccggtaaccggggtacccgaaccggtaccccggtaaacggg

SEQ ID NO: 311579 - DNA, 544 bp, Homo sapiens
  misc_feature: GZ8MTXP02IYC3E.25.36.D03.1.454.CMB.2.raw
  modified_base (187)..(187): a, c, t, g, unknown or other
  misc_feature (187)..(187): n is a, c, g, or t
  modified_base (207)..(207): a, c, t, g, unknown or other
  misc_feature (207)..(207): n is a, c, g, or t
  modified_base (236)..(236): a, c, t, g, unknown or other
  misc_feature (236)..(236): n is a, c, g, or t
  modified_base (301)..(301): a, c, t, g, unknown or other
  misc_feature (301)..(301): n is a, c, g, or t
  modified_base (345)..(345): a, c, t, g, unknown or other
  misc_feature (345)..(345): n is a, c, g, or t
  modified_base (438)..(438): a, c, t, g, unknown or other
  misc_feature (438)..(438): n is a, c, g, or t
tcagactgtacagtcacgaccggtgctcgatttagctgcgtcacgatctctcttggggagcttcagctgtggtagagaagacaggattcaggacaatctccagcatggccggcctccctctcctcctcaccctcctcactcactgtgcagggtcctgggcccagtctgtgctgactcagccaccctnagtgtctcgggacccccggnaggaggtctccattctcttgttctgggancagctccgacgtcggaaattagttgtctactggtaccagcagctcccagaaccgccccaagctcncatctatagatgatcagcgcctgacggactacctgaccgattcnctggctcgaagtctggctccgtcgccctcctggccatcagtcggcctcggtcgaggatgaggctagaattattactgtcgcgtaggtttgggntcgcgtagtcgtgtacggtcggtaccggtcggttcggtacgggacgggaacggaaccgaagtccgtacggtacccgtacgtacggtaccgaccggacccgtaacgg

SEQ ID NO: 311580 - DNA, 555 bp, Homo sapiens
  misc_feature: GZ8MTXP02JIP5N.25.36.D03.1.454.CMB.2.raw
  modified_base (188)..(188): a, c, t, g, unknown or other
  misc_feature (188)..(188): n is a, c, g, or t
  modified_base (210)..(210): a, c, t, g, unknown or other
  misc_feature (210)..(210): n is a, c, g, or t
  modified_base (241)..(241): a, c, t, g, unknown or other
  misc_feature (241)..(241): n is a, c, g, or t
  modified_base (309)..(309): a, c, t, g, unknown or other
  misc_feature (309)..(309): n is a, c, g, or t
  modified_base (315)..(315): a, c, t, g, unknown or other
  misc_feature (315)..(315): n is a, c, g, or t
tcagactgtacagtcacgaccggtgctcgatttagctgcgtcacgatctcgtcttggggagcttcagctgtggtagagaagacaggattcaggacaatctccagcatggccggcctccctctcctcctcaccctcctcactcactgtgcagggtcctgggcccagtctgtgctgactcagccaccctnagtgtcgtcgggacccccgggnaggagggtcctccgatctcttgttctgggancagctccgagtcggaaatagttgctactggtaccagcagcctcccgagaaccggcccccaagcctccnatctanaggatgatcagcgccctgaggactacctgaccgtattcctctgggcctacggaagtcgtcgggcctcctccggtccctcccgtcggcccatcagtcggcctccggtccgaggatgaggctagaattattacgtgtgcgtaggttgggatcggaccagtcgtgtacggtcggtcggacgggtggttcgggcgggtaacggaccgaagcgtacgaccgtcgtaacggtcgaacgcccgaagg

SEQ ID NO: 311581 - DNA, 525 bp, Homo sapiens
  misc_feature: GZ8MTXP02HS819.25.36.D03.1.454.CMB.2.raw
  modified_base (242)..(242): a, c, t, g, unknown or other
  misc_feature (242)..(242): n is a, c, g, or t
  modified_base (300)..(300): a, c, t, g, unknown or other
  misc_feature (300)..(300): n is a, c, g, or t
  modified_base (447)..(447): a, c, t, g, unknown or other
  misc_feature (447)..(447): n is a, c, g, or t
  modified_base (456)..(456): a, c, t, g, unknown or other
  misc_feature (456)..(456): n is a, c, g, or t
tcagactgtacagtcacgaccggtgctcgatttagctgcgtcacgatctctcttgggggggtctcaggaggcagcgctctcgggacgtctccaccatggcctgggctctgctgttcctcaccctcctcactcaggcacagggtcctgggcccagtctgccctgactcagcctgcctccgtgtctgggactcctggacagtcggtcaccatctcctgcactggaaccagccgtgacattgggncttataactatgtctcctgtccaacaacaccaggcaacggccccaaatcatcatttangatgtcagtcatcggcctctggtatttcctggtctcttctctcggctccaagtctggcctaactcggcctccctgacctgtcgtcggggctcccgagggctaggacggacgaggtcctatttattattcgtctatttctatacaganacacaacanctgtgttcggcggacggacgaacgtcgacgtccgtcgtcgacgaccgacgcgtccgcccgtcggtcccg

SEQ ID NO: 311582 - DNA, 495 bp, Homo sapiens
  misc_feature: GZ8MTXP02F1RHO.25.36.D03.1.454.CMB.2.raw
  modified_base (399)..(399): a, c, t, g, unknown or other
  misc_feature (399)..(399): n is a, c, g, or t
  modified_base (457)..(457): a, c, t, g, unknown or other
  misc_feature (457)..(457): n is a, c, g, or t
  modified_base (464)..(464): a, c, t, g, unknown or other
  misc_feature (464)..(464): n is a, c, g, or t
  modified_base (489)..(489): a, c, t, g, unknown or other
  misc_feature (489)..(489): n is a, c, g, or t
tcagactgtacagtcacgaccggtgctcgatttagctgcgtcacgatctctcttggggacccaaaaaccacacccctccttgggagaatcccctagatcacagctcctcaccatggactggacctggagcatccttttcttggtggcagcagcaacaggtgcccactcccaggttcaactggtgcagtctggacctgaggtgaagaagcctggggcctcagtgaaggtctcctgcaaggcttctggttacacctttagcagctatggcatcagctgggtgcgacaggcccctggacaaggggcttgagtggatggcatggatcagccttaaccatggtatcacagactatgcacaggaattccagggcagagtcacttgaccacagacacatccacgancacagcctacatggacctgagacgcctagagatctgacgacacggccgtatacttacngtgacgngagtcgattatcgcttactccggtntacccg

SEQ ID NO: 311583 - DNA, 559 bp, Homo sapiens
  misc_feature: GZ8MTXP02JAX8P.25.36.D03.1.454.CMB.2.raw
  modified_base (259)..(259): a, c, t, g, unknown or other
  misc_feature (259)..(259): n is a, c, g, or t
  modified_base (278)..(278): a, c, t, g, unknown or other
  misc_feature (278)..(278): n is a, c, g, or t
  modified_base (308)..(308): a, c, t, g, unknown or other
  misc_feature (308)..(308): n is a, c, g, or t
  modified_base (321)..(321): a, c, t, g, unknown or other
  misc_feature (321)..(321): n is a, c, g, or t
  modified_base (334)..(334): a, c, t, g, unknown or other
  misc_feature (334)..(334): n is a, c, g, or t
  modified_base (338)..(338): a, c, t, g, unknown or other
  misc_feature (338)..(338): n is a, c, g, or t
  modified_base (357)..(357): a, c, t, g, unknown or other
  misc_feature (357)..(357): n is a, c, g, or t
tcagactgtacagtcacgaccggtgctcgatttagctgcgtcacgatctctcttgggagatgggtcctgtcccagatgcacctgcaggagtcgggcccaggactggtgaagccttcggagaccctgtccctcacctgcagtgtctctggtggctccgtcagtgcttatactggagctggatccgccagtccgccgggagggactggagtggattgggctatatatacgaatggattaaccactacacgcccctccctanaagagtcgagtcaccatancagcggacacgtcagggatcgaggtgtccngcatctgacttcngcgactgccccgngacncggccctatacctactgtnccagagattcggactgcgagtattttcggagtaattagttattctttagtgtcttttagactagttggtggggaccaaggggacgacgggtccaccggtctacttcacgtccctaccgaccaacgggtccccagtcccgtcccttcccccgtggccccaccctccctaccaacgacgaccaccgtcgcggggccacgaccgg

SEQ ID NO: 311584 - DNA, 558 bp, Homo sapiens
  misc_feature: GZ8MTXP02GFUWA.25.36.D03.1.454.CMB.2.raw
  modified_base (300)..(300): a, c, t, g, unknown or other
  misc_feature (300)..(300): n is a, c, g, or t
tcagactgtacagtcacgaccggtgctcgatttagctgcgtcacgatctctcttggggagcttcagctgtgggtagagaagacaggactcaggacaatctccagcatggccagcttccctctcctcctccaccctcctcactcactgtgcagggtcctgggcccagtctgtgctgtctcagccaccctcagtgtctcggggcccccgggcaggagggtcgacatctcttgtctggaagtcgctccaacgtcggcagtaatagtgtaagctggtaccagcaactcccaggaaccgccccanactcctcatgtatgggaatgatcagccgcccctcgacggggtcccctgacccgtattcctctcgcctccacgtctggcacctcacgccctccctggcccactccgtcgggctccaactcctgagagtgacggccggtattattaattgttggcgagtggtggagtagagaaggaacggtaacggttagtcgttacgtacggtacgtacggtacgaacgtaacgtaccgtaccgtacggtacgacgaccgaccgacccg

SEQ ID NO: 311585 - DNA, 583 bp, Homo sapiens
  misc_feature: GZ8MTXP02JH8H1.25.36.D03.1.454.CMB.2.raw
  modified_base (209)..(209): a, c, t, g, unknown or other
  misc_feature (209)..(209): n is a, c, g, or t
  modified_base (300)..(300): a, c, t, g, unknown or other
  misc_feature (300)..(300): n is a, c, g, or t
  modified_base (306)..(306): a, c, t, g, unknown or other
  misc_feature (306)..(306): n is a, c, g, or t
tcagactgtacagtcacgaccggtgctcgatttagctgcgtcacgatctctcttggggagcttcagctgtggtagagaagacaggattcaggacaatctccagcatggccggcctccctctcctcctcaccctcctcactcactgtgcagggtcctgggcccagtctgtgctgactcagccaccctcagtgtcgtcgggacccccgggnaggagggtctccatctcttgttctggagtcgctccaacgtcggcagtaatgtgtaagctggtaccagcaactcccaaggaaccgcccccanactccncatgtatggaatgatcacgccgcccctgaccggggtccctgaccgtattctctcgcccctccacgtcctcggccaccctcacgccctcccgtcggccctacgtccggtcgggcctccaatccgtagacggatacggacggtccgtaatttagttattggtgcgaggcggttgggataggaacgagggaacgtaacggttatggtcgttacggtaagttcgggaacctaggtacaaccggtcgtacggtcgacgtacccgaaacggacccaaaccccg

SEQ ID NO: 311586 - DNA, 536 bp, Homo sapiens
  misc_feature: GZ8MTXP02GHKCZ.25.36.D03.1.454.CMB.2.raw
  modified_base (305)..(305): a, c, t, g, unknown or other
  misc_feature (305)..(305): n is a, c, g, or t
  modified_base (374)..(374): a, c, t, g, unknown or other
  misc_feature (374)..(374): n is a, c, g, or t
  modified_base (407)..(407): a, c, t, g, unknown or other
  misc_feature (407)..(407): n is a, c, g, or t
  modified_base (431)..(431): a, c, t, g, unknown or other
  misc_feature (431)..(431): n is a, c, g, or t
  modified_base (457)..(457): a, c, t, g, unknown or other
  misc_feature (457)..(457): n is a, c, g, or t
tcagactgtacagtcacgaccggtgctcgatttagctgcgtcacgatctctcttggggagctctgagagcggagccccagccccagaattcccaggtgttttcatttggtgatcagcactgaacacagaggactcaccatggagtttgggctgagctgggttttcctcgttgctcttttaagaggtgtccagtgtcagatgcaactggcggagtcgggggagcgtggtccagccggggaatccctgagactctcctgtgcagtgtccgcgtccaccttccgtcgttttggcattcactgggtccnccaggctccaggcaaggggctggagtgggtgcggtcatagtggtgggatggaagtaatgctattttagngcagactcggagaacggccactcacatcacagngcagctacaaagtacctactttanctagactaatacgaaacgtgacgacncgacgacgacggtctgtactactacgcggacggtcgggtcaggaacgacggacgggtccgggccgtacgtacggactag

SEQ ID NO: 311587 - DNA, 618 bp, Homo sapiens
  misc_feature: GZ8MTXP02GIHGW.25.36.D03.1.454.CMB.2.raw
  modified_base (244)..(244): a, c, t, g, unknown or other
  misc_feature (244)..(244): n is a, c, g, or t
  modified_base (259)..(259): a, c, t, g, unknown or other
  misc_feature (259)..(259): n is a, c, g, or t
tcagactgtacagtcacgaccggtgctcgatttagctgcgtcacgatctctcttgggggggtctcaggaggcagcgctctcgggacgtctccaccatggcctgggctctgctgttcctcaccctcctcactcagggcacagggtcctgggcccagtctgccctgactcagcctgcctccgtgtctgggactcctggacagtcggtcaccatctcctgcactggaaccagccgtgacattgggtntacttaataactatntctcctcgtaccaacaaccaccacgaccaaccgaccccaactcatctattatgtatgtacagtcacgtccgtcctcgtggtacgtttccgtcgtctcttctcgtcgtctccgtaacgtcgtcgacctaccgtccgtccctccctacgaccctacgtccgtccgggcctccgacggtcgtaggacggacgacgtacttaactttattagttcgtacttactttacgaactacgagaacaaccaaccaacgtacgtcgttcggttcggttacgggacgggaacgggtaccgtaacggttccgtacccgttccggtaccggtaaccgacggacccgacggtcctacccgtccccgtcggtcc

SEQ ID NO: 311588 - DNA, 666 bp, Homo sapiens
  misc_feature: GZ8MTXP02FU5US.25.36.D03.1.454.CMB.2.raw
tcagactgtacagtcacgaccggtgctcgatttagctgcgtcacgatctctcttggggagcttcagctgtggtagagaagacaggattcaggacaatctccagcatggccggcctccctctcctcctcaccctcctcactcactgtgcagggtcctgggcccagtctgtgctgactcagcccaccctcagtgtcgtccgggaccccggcaggaggtcctccattcttcttgttcgtgggagcagcctccgacgtacggtaaattagttgtactacgtcggtaccagcacgccctacccgaaacggaaaccccggcccccaaagccctccctacactcctaagtaggaaattgaactcgacgccggacccctggaacgggtaccttacccgtacggaacctattcctcgtcggtctacggaagtccgtcggcctccgtcccggtccctcccgtacggccctacgtccgaggttccggccgttcccgggcggaggacgtgacgggtctagaactttattacgtggtagccgttagggtttagggatcggtaccgtagttcgtagggtacggttccgggtaccgggtagggttcgggttacggggacgggaacggacgacggtccgtaccggtaaccggtacggtacgtaccgaaccggacccgtacgg

SEQ ID NO: 311589 - DNA, 497 bp, Homo sapiens
  misc_feature: GZ8MTXP02JDMHO.25.36.D03.1.454.CMB.2.raw
  modified_base (434)..(434): a, c, t, g, unknown or other
  misc_feature (434)..(434): n is a, c, g, or t
  modified_base (456)..(456): a, c, t, g, unknown or other
  misc_feature (456)..(456): n is a, c, g, or t
tcagactgtacagtcacgaccggtgctcgatttagctgcgtcacgatctctcttggggacccaaaaaccacacccctccttgggagaatcccctagatcacagctcctcaccatggactggacctggagcatccttttcttggtggcagcagcaacaggtgcccactcccaggttcaactggtgcagtctggacctgaggtgaagaagcctggggcctcagtgaaggtctcctgcaaggcttctggttacacctttagcagctatggcatcagctgggtgcgacaggcccctggacaagggcttgagtggatggcagtggatcagccttaaacatggtatcacagactatgcacaggaattccgagggcagagtcacttgaccacagacacatccacgagcacagcctacatggacctgagagcctagagatcngacgacacggcctatacttacngtcgacgagagtcgattagtcgacttacgtcggtgtacccg

SEQ ID NO: 311590 - DNA, 523 bp, Homo sapiens
  misc_feature: GZ8MTXP02I5WVG.25.36.D03.1.454.CMB.2.raw
  modified_base (245)..(245): a, c, t, g, unknown or other
  misc_feature (245)..(245): n is a, c, g, or t
  modified_base (252)..(252): a, c, t, g, unknown or other
  misc_feature (252)..(252): n is a, c, g, or t
  modified_base (257)..(258): a, c, t, g, unknown or other
  misc_feature (257)..(258): n is a, c, g, or t
  modified_base (260)..(261): a, c, t, g, unknown or other
  misc_feature (260)..(261): n is a, c, g, or t
  modified_base (263)..(263): a, c, t, g, unknown or other
  misc_feature (263)..(263): n is a, c, g, or t
  modified_base (265)..(266): a, c, t, g, unknown or other
  misc_feature (265)..(266): n is a, c, g, or t
  modified_base (271)..(271): a, c, t, g, unknown or other
  misc_feature (271)..(271): n is a, c, g, or t
  modified_base (273)..(273): a, c, t, g, unknown or other
  misc_feature (273)..(273): n is a, c, g, or t
  modified_base (279)..(280): a, c, t, g, unknown or other
  misc_feature (279)..(280): n is a, c, g, or t
  modified_base (282)..(282): a, c, t, g, unknown or other
  misc_feature (282)..(282): n is a, c, g, or t
  modified_base (291)..(291): a, c, t, g, unknown or other
  misc_feature (291)..(291): n is a, c, g, or t
  modified_base (303)..(303): a, c, t, g, unknown or other
  misc_feature (303)..(303): n is a, c, g, or t
  modified_base (305)..(305): a, c, t, g, unknown or other
  misc_feature (305)..(305): n is a, c, g, or t
  modified_base (307)..(307): a, c, t, g, unknown or other
  misc_feature (307)..(307): n is a, c, g, or t
  modified_base (325)..(325): a, c, t, g, unknown or other
  misc_feature (325)..(325): n is a, c, g, or t
  modified_base (345)..(345): a, c, t, g, unknown or other
  misc_feature (345)..(345): n is a, c, g, or t
  modified_base (381)..(381): a, c, t, g, unknown or other
  misc_feature (381)..(381): n is a, c, g, or t
tcagactgtacagtcacgaccggtgctcgatttagctgcgtcacgatctctcttggggagctctgagagcggagccccagccccagaattcccaggtgttttcatttggtgatcagcactgaacacagaggactcaccatggagtttgggctgagctgggttttccttgttgttattttccaggtgtccagagtgaggtgcagttggtggagtctggggagcgtgtcgagacgtggaggtcgtgnagtctcngtgcnncnngntnntctcngnacacanngngtcgcgcgngcgcgaggaggngngnggtggtggcgtatagaanaagataagatacacacaganacgcgcgtcgtagtagaagagagatatatatactanagagatagtataacaaacgtaactactactagtatactacgataaataagaacacgacgtaacgaaaacggaaacggacgacggtacgtacgtacgtacgtacgtaacgtacgtacgtacgtacgtacgtacgtacgtaacg

SEQ ID NO: 311591 - DNA, 516 bp, Homo sapiens
  misc_feature: GZ8MTXP02J0BV3.25.36.D03.1.454.CMB.2.raw
  modified_base (306)..(306): a, c, t, g, unknown or other
  misc_feature (306)..(306): n is a, c, g, or t
  modified_base (342)..(342): a, c, t, g, unknown or other
  misc_feature (342)..(342): n is a, c, g, or t
  modified_base (452)..(452): a, c, t, g, unknown or other
  misc_feature (452)..(452): n is a, c, g, or t
  modified_base (468)..(468): a, c, t, g, unknown or other
  misc_feature (468)..(468): n is a, c, g, or t
tcagactgtacagtcacgaccggtgctcgatttagctgcgtcacgatctctcttgggggggtctcaggaggcagcgctctcgggacgtctccaccatggcctgggctctgctgttcctcaccctcctcactcagggcacagggtcctgggcccagtctgccctgactcagcctgcctccgtgtctgggactcctggacagtcggtcaccatctcctgcactggaacccagccgtgacattggtgcttataactatgtctcctggtcccaacaacacccaggccaaggcccccaaatcatcatttangatgtcagtcatcggccctctggagtttcctggtcncttctctggctccaagtctggcaactcggcctccctgaccatccgtcggggctccgaggctgacggacgaggcttacgttattattgctatttcattacagagacacaanagtctggtcgttcggnggacggaccagttcgaccgtctcggcacgccaggctcgcccctggtcc

SEQ ID NO: 311592 - DNA, 556 bp, Homo sapiens
  misc_feature: GZ8MTXP02F61VH.25.36.D03.1.454.CMB.2.raw
  modified_base (244)..(244): a, c, t, g, unknown or other
  misc_feature (244)..(244): n is a, c, g, or t
  modified_base (313)..(313): a, c, t, g, unknown or other
  misc_feature (313)..(313): n is a, c, g, or t
  modified_base (531)..(531): a, c, t, g, unknown or other
  misc_feature (531)..(531): n is a, c, g, or t
tcagactgtacagtcacgaccggtgctcgatttagctgcgtcacgatctctcttgggggggtctcaggaggcagcgctctcgggacgtctccaccatggcctgggctctgctgttcctcaccctcctcactcagggcacagggtcctgggcccagtctgccctgactcagcctgcctccgtgtctgggactcctggacagtcggtcaccatctcctgcactggaaccagccgtgacagttggtntcttaataactatgtctcctcgtacccaacaaccacccaggcaaccggacccccaaatcatctatttangatgtcagtcatccggcctcgtggtatttccgtgtcgtcttctctcggtctccgaagtccgtaggacctaccgtccggtccctcccgtacgacctacgtccgtcgggccttcgaggcctaggacgggacacggtacttacttattatcgactatttacatacagacacaacacgtagtgtggtgtcggacggtacggactagtcgaccgtcgtacggnaccgccgacggctccgccctgtacc

SEQ ID NO: 311593 - DNA, 520 bp, Homo sapiens
  misc_feature: GZ8MTXP02IZAW6.25.36.D03.1.454.CMB.2.raw
  modified_base (227)..(227): a, c, t, g, unknown or other
  misc_feature (227)..(227): n is a, c, g, or t
  modified_base (241)..(241): a, c, t, g, unknown or other
  misc_feature (241)..(241): n is a, c, g, or t
  modified_base (444)..(444): a, c, t, g, unknown or other
  misc_feature (444)..(444): n is a, c, g, or t
  modified_base (450)..(450): a, c, t, g, unknown or other
  misc_feature (450)..(450): n is a, c, g, or t
tcagactgtacagtcacgaccggtgctcgatttagctgcgtcacgatctctcttggggggtctcaggaggcagcgctctcgggacgtctccaccatggcctgggctctgctgttcctcaccctcctcactcagggcacagggtcctgggcccagtctgccctgactcagcctgcctccgtgtctgggactcctggacagtcggtcaccatctcctgcactggaaccngccgtgacattggncttataactatgtctcctggtcccaacaacacccaggcaacggcccccaaatcatcatttatgatgtcagtcatcggccctctggtagtttcctggtcgtcttctctggctccaagtctggccaacgtcgcctccctgacctatcgtcggggctccgaggcctggaggacgaggtcttacttattatgctatttcatacaganacacanagtctggtcgtcggcggacggaccaagttcgaccgtcgtacgtcgacgaccaggcctcgcccctcggtcc

SEQ ID NO: 311594 - DNA, 505 bp, Homo sapiens
  misc_feature: GZ8MTXP02G9IQ7.25.36.D03.1.454.CMB.2.raw
  modified_base (244)..(244): a, c, t, g, unknown or other
  misc_feature (244)..(244): n is a, c, g, or t
  modified_base (324)..(324): a, c, t, g, unknown or other
  misc_feature (324)..(324): n is a, c, g, or t
  modified_base (339)..(339): a, c, t, g, unknown or other
  misc_feature (339)..(339): n is a, c, g, or t
  modified_base (436)..(436): a, c, t, g, unknown or other
  misc_feature (436)..(436): n is a, c, g, or t
  modified_base (442)..(442): a, c, t, g, unknown or other
  misc_feature (442)..(442): n is a, c, g, or t
  modified_base (491)..(491): a, c, t, g, unknown or other
  misc_feature (491)..(491): n is a, c, g, or t
tcagactgtacagtcacgaccggtgctcgatttagctgcgtcacgatctctcttgggggggtctcaggaggcagcgctctcgggacgtctccaccatggcctgggctctgctgttcctcaccctcctcactcagggcacagggtcctgggcccagtctgccctgactcagcctgcctccgtgtctgggactcctggacagtcggtcaccatctcctgcactggaacctagccgtgacattggtncttataactatgtctcctggtcccaacaacacccaggcaaggcccccaaatcatcatttatgatgcagtcatcggccctntggatttcctggtcncttctctggctccaagtctggcaactcggcctccctgaccatctcggggctccgaggctgacggacgaggctattattattgctatttcatacaganacacanagtctggtcgtcggcgaggaccagtcgaccgtctcggtcagccgaggcncgccccgtggtccc

SEQ ID NO: 311595 - DNA, 606 bp, Homo sapiens
  misc_feature: GZ8MTXP02HC90S.25.36.D03.1.454.CMB.2.raw
  modified_base (207)..(207): a, c, t, g, unknown or other
  misc_feature (207)..(207): n is a, c, g, or t
tcagactgtacagtcacgaccggtgctcgatttagctgcgtcacgatctctcttggggagcttcagctgtgggtagagaagacaggactcaggacaatctccagcatggccagcttccctctcctcctcaccctcctcactcactgtgcagggtcctgggcccagtctgtgctgactcagccaccctcagtgtctgggacccccggnagagggtctccatctcttgttctgggagcagctccgacgtcggaaatagttgtctactggtaccagcagctcccagaaccggcccccaagcctcctcatctataggatgatcagccggcctcgagggactaccgtgaccgtattctcgtcggctcgaagtccgtcggccttcccgtccggccctcccgtggcccatcgaggtcgggcctcccgggtccgaggactggaggtctaggtaattattacgtgtcgcgtaggtttgggattcggaccgtagttcgtaggtacggttcgggttaccccggtaggggttcggttccggggacggggtaacggggaccgtaagggtccgtaccggtaacccggttccgtacggggttaccaccgggtaacccccgg

SEQ ID NO: 311596 - DNA, 774 bp, Homo sapiens
  misc_feature: GZ8MTXP02JZZWF.25.36.D03.1.454.CMB.2.raw
  modified_base (187)..(187): a, c, t, g, unknown or other
  misc_feature (187)..(187): n is a, c, g, or t
  modified_base (209)..(209): a, c, t, g, unknown or other
  misc_feature (209)..(209): n is a, c, g, or t
  modified_base (218)..(218): a, c, t, g, unknown or other
  misc_feature (218)..(218): n is a, c, g, or t
  modified_base (220)..(220): a, c, t, g, unknown or other
  misc_feature (220)..(220): n is a, c, g, or t
  modified_base (230)..(230): a, c, t, g, unknown or other
  misc_feature (230)..(230): n is a, c, g, or t
  modified_base (233)..(235): a, c, t, g, unknown or other
  misc_feature (233)..(235): n is a, c, g, or t
  modified_base (255)..(255): a, c, t, g, unknown or other
  misc_feature (255)..(255): n is a, c, g, or t
  modified_base (266)..(266): a, c, t, g, unknown or other
  misc_feature (266)..(266): n is a, c, g, or t
  modified_base (269)..(269): a, c, t, g, unknown or other
  misc_feature (269)..(269): n is a, c, g, or t
  modified_base (292)..(292): a, c, t, g, unknown or other
  misc_feature (292)..(292): n is a, c, g, or t
  modified_base (298)..(298): a, c, t, g, unknown or other
  misc_feature (298)..(298): n is a, c, g, or t
  modified_base (313)..(313): a, c, t, g, unknown or other
  misc_feature (313)..(313): n is a, c, g, or t
tcagactgtacagtcacgaccggtgctcgatttagctgcgtcacgatctctcttggggagcttcagctgtggtagagaagacaggattcaggacaatctccagcatggccggcctccctctcctcctcaccctcctcactcactgtgcagggtcctgggcccagtctgtgctgactcagccaccctnagtgtcgtcgggacccccgggnaggcggtcncntctcttgtgnggnnngctcgacgtagtaatagttntctacgtgacngcncgccaccgaacgaacccgcccancctctnatactagagatgacncgacgccgcctaggaccggtactaccgtacgaccgttcttccgtcgtcggtaccgtaacggtacgttccgtccgtcccttcccggtcccggtcccccttcccggtacggccctacgtccggtcggggtccggggtccccgttacccgggggtaccggaagggtacgtacgggtacggtacggttacgttaacgttaacgttacgttacggttacggtacggttacgggtttacgggttacggttaccggtaccggttacggttacggttacggggttacggggttaccgggggttacccgggggttaccgggggttaccgggggttaccgggggtaccgggggtaaccgggggtaaacccgggtaaccgggttaacccgggttaacccggggttaaccccggggttacccgggttaacccggggtaacccgggtaacccgggtaaccccgggtaacccggg

SEQ ID NO: 311597 - DNA, 557 bp, Homo sapiens
  misc_feature: GZ8MTXP02HKJ03.25.36.D03.1.454.CMB.2.raw
  modified_base (207)..(207): a, c, t, g, unknown or other
  misc_feature (207)..(207): n is a, c, g, or t
  modified_base (235)..(235): a, c, t, g, unknown or other
  misc_feature (235)..(235): n is a, c, g, or t
tcagactgtacagtcacgaccggtgctcgatttagctgcgtcacgatctctcttggggagcttcagctgtggtagagaagacaggattcaggacaatctccagcatggccggcctccctctcctcctcaccctcctcactcactgtgtagggtcctgggcccagtctgtgctgactcagccaccctcagtgtctgggacccccgggnagagggtctccatctcttgttctgggancagctccgacgtcggaaatagttgctactggtaccagcagcctcccagaaaccggcccccaagcctcctcatctataggaatgatcagcgcctgaggactacctgaccgattctctggctcgaagtctgcctcctcggccctccctgcccatcgagtcgggcctcccgggtccgaggactggacgctagtaaattagttactgtgcgtagtttgggatgccgtagtcgtggacggttcgggtccggacgggttggttccgggacgggacgggaccgaagcgtcggtacccgtcgtacggtcgacggaccccgaagggtcccg

SEQ ID NO: 311598 - DNA, 513 bp, Homo sapiens
  misc_feature: GZ8MTXP02JVEWU.25.36.D03.1.454.CMB.2.raw
  modified_base (207)..(207): a, c, t, g, unknown or other
  misc_feature (207)..(207): n is a, c, g, or t
  modified_base (235)..(235): a, c, t, g, unknown or other
  misc_feature (235)..(235): n is a, c, g, or t
  modified_base (328)..(328): a, c, t, g, unknown or other
  misc_feature (328)..(328): n is a, c, g, or t
  modified_base (420)..(420): a, c, t, g, unknown or other
  misc_feature (420)..(420): n is a, c, g, or t
  modified_base (428)..(428): a, c, t, g, unknown or other
  misc_feature (428)..(428): n is a, c, g, or t
tcagactgtacagtcacgaccggtgctcgatttagctgcgtcacgatctctcttggggagcttcagctgtggtagagaagacaggattcaggacaatctccagcatggccggcctccctctcctcctcaccctcctcactcactgtgcagggtcctgggcccagtctgtgctgactcagccaccctcagtgtctgggacccccgggnagagggtctccatctcttgttctgggancagctccgacgtcggaaataagttgctactggtaccagcagctcccagaaacggcccccaagctcctcatctataggatgatcagcggccctnacgggatacctgaccgattctctggctcgagtctggcctcctcggccctccctggccatcagtgggcctccggtccgagatgaggctagatnttactgtncgtagtttgggatcgccagtctggagtggtccgacggtgttcggcgggacggaccagcgtggaccgtcgaggtcacggaccacgg

SEQ ID NO: 311599 - DNA, 552 bp, Homo sapiens
  misc_feature: GZ8MTXP02H3I7P.25.36.D03.1.454.CMB.2.raw
  modified_base (228)..(228): a, c, t, g, unknown or other
  misc_feature (228)..(228): n is a, c, g, or t
  modified_base (243)..(243): a, c, t, g, unknown or other
  misc_feature (243)..(243): n is a, c, g, or t
  modified_base (320)..(320): a, c, t, g, unknown or other
  misc_feature (320)..(320): n is a, c, g, or t
  modified_base (332)..(332): a, c, t, g, unknown or other
  misc_feature (332)..(332): n is a, c, g, or t
  modified_base (370)..(370): a, c, t, g, unknown or other
  misc_feature (370)..(370): n is a, c, g, or t
tcagactgtacagtcacgaccggtgctcgatttagctgcgtcacgatctctcttgggggggtctcaggaggcagcgctctcgggacgtctccaccatggcctgggctctgctgttcctcaccctcctcactcagggcacagggtcctgggcccagtctgccctgactcagcctgcctccgtgtctgggactcctggacagtcggtcaccatctcctgcactggaaccngccgtgactattggncttataactatgtctcctggtcccaacaacaccagcaacggcccccaaatcatcattatgatgtcagtcatcgcctntggtatttccgngtcgtcttctctggctcagtctggcactcgcctccctnaccatcgcggggctccgaggtcctggacggacgaggtacttactttattagttcgacttatttcaattaccagactacaacaacctagtcgttgggtcgttcgggacggtacggaacctaacggtttcgacccgttccgtcggtaacacggacccgacggtcctccggtccccctacggtcc

SEQ ID NO: 311600 - DNA, 586 bp, Homo sapiens
  misc_feature: GZ8MTXP02HLSFB.25.36.D03.1.454.CMB.2.raw
  modified_base (245)..(245): a, c, t, g, unknown or other
  misc_feature (245)..(245): n is a, c, g, or t
  modified_base (324)..(324): a, c, t, g, unknown or other
  misc_feature (324)..(324): n is a, c, g, or t
  modified_base (340)..(340): a, c, t, g, unknown or other
  misc_feature (340)..(340): n is a, c, g, or t
tcagactgtacagtcacgaccggtgctcgatttagctgcgtcacgatctctcttgggggggtctcaggaggcagcgctctcgggacgtctccaccatggcctgggctctgctgttcctcaccctcctcactcagggcacagggtcctgggcccagtctgccctgactcagcctgcctccgtgtctgggactcctggacagtcggtcaccatctcctgcactggaacccagcccgtgacattggtncttataactatgtctcctggtcccaacaacaccaggcaaggcccccaaatcatcatttatgatgtcagtcatcggcctntggtatttcctggtcncttctctggctccagtctgcactcgcctcctgaccatcgtcggggctccgaggctggaggtacgaggtccttaacgtttatttaagttcgtactattttccaattaccgaggaacaaccaacctaaacagttcgtagggttcggttacgggacgggtaacgggtacccaaaggtttccgaacccgttccgtcgggttaaccaccggacccgaaacggtccgttccggccccccgttcgggtacccc

SEQ ID NO: 311601 - DNA, 533 bp, Homo sapiens
  misc_feature: GZ8MTXP02F3RWW.25.36.D03.1.454.CMB.2.raw
  modified_base (262)..(262): a, c, t, g, unknown or other
  misc_feature (262)..(262): n is a, c, g, or t
  modified_base (490)..(490): a, c, t, g, unknown or other
  misc_feature (490)..(490): n is a, c, g, or t
tcagactgtacagtcacgaccggtgctcgatttagctgcgtcacgatctctcttgggagatgggtcctgtcccagatgcacctgcaggagtcgggcccaggactggtgaagccttcggagaccctgtccctcacctgcagtgtctctggtggctccgtcagtgcttattactggagctggatccgccagtccgccgggagggactggagtggattgggcgtatatatacgaatggattaaccactacaacccctcctcaagngtcgagtcaccatatcagcggacacgtccagggatcaggtgttcctgcatctgacttctgcgactgccgcggacaccggccctatactactgtcgccagagattcggactgcgacgtattttcggagtaattattattctttgtgtctttgactatggtgggcaagggacgacggtcaccgtctcgttcacgcctccaccgaacgggcccactccggtccttccccgngccaccctcctccaacgcgccacctcgcggggcacgcgcccgg

SEQ ID NO: 311602 - DNA, 604 bp, Homo sapiens
  misc_feature: GZ8MTXP02G2P3X.25.36.D03.1.454.CMB.2.raw
  modified_base (207)..(207): a, c, t, g, unknown or other
  misc_feature (207)..(207): n is a, c, g, or t
  modified_base (234)..(234): a, c, t, g, unknown or other
  misc_feature (234)..(234): n is a, c, g, or t
  modified_base (296)..(296): a, c, t, g, unknown or other
  misc_feature (296)..(296): n is a, c, g, or t
  modified_base (321)..(321): a, c, t, g, unknown or other
  misc_feature (321)..(321): n is a, c, g, or t
  modified_base (331)..(331): a, c, t, g, unknown or other
  misc_feature (331)..(331): n is a, c, g, or t
tcagactgtacagtcacgaccggtgctcgatttagctgcgtcacgatctctcttggggagcttcagctgtggtagagaagacaggattcaggacaatctccagcatggccggcctccctctcctcctcaccctcctcactcactgtgcagggtcctgggcccagtctgtgctgactcagccaccctcagtgtctcgggacccccggnagaggtctccatctcttgttctgggancagctccgacgtcggaaatagttgtctactggtaccagcagctccagaacgccccaagctcnatctataggaatgatcagccgcctnacggataccngaccattctctggctcgagtctggctcctccggccctcccgtaggcccatcgagtcgggcctccgggtcccgagggactggaacggctaggaaattagttacgttggtcgacgttagggttttggggaattcggaccgtagttccgtaggtaagggttcgggttaccgggtacgggttcgggttccggggaccgggaacggggacccgtaaaggtccgttacgggaacccggttcccgtaaggggttcccaccgggtaccccgtaaaccgggg

SEQ ID NO: 311603 - DNA, 643 bp, Homo sapiens
  misc_feature: GZ8MTXP02J2HNH.25.36.D03.1.454.CMB.2.raw
  modified_base (208)..(208): a, c, t, g, unknown or other
  misc_feature (208)..(208): n is a, c, g, or t
  modified_base (349)..(349): a, c, t, g, unknown or other
  misc_feature (349)..(349): n is a, c, g, or t
tcagactgtacagtcacgaccggtgctcgatttagctgcgtcacgatctctcttggggagcttcagctgtggtagagaagacaggattcaggacaatctccagcatggccggcctccctctcctcctcaccctcctcactcactgtgcagggtcctgggcccagtctgtgctgactcagccaccctcagtgtctcgggacccccgggnagagggtctccatctcttgttctgggagcagctccgacgtcggaaataagttgctactggtaccagcagctcccagaacggcccccaagctcctcatctataggaatgatcagcggccctcagggactacctgaacccgtnttctcgtcgctacgacgtcgtcgtcctcccgtcccggtccccttcccgtcggaccctacgtcgtacggtcggggtccggtcccgggtaccgggtacgggtacgtacggacggtcgtagtaacgttagttacgttggtagtcgttaggtttagggtagtcgtaccgtacgtacgtggtacgggtcgggtccgggtacggggttcgggttacggggtacggggaccggggaaccggtaacggtaaccgtaccggtacccggtacccggtacggtaccggaccggacccggtaccgg

SEQ ID NO: 311604 - DNA, 512 bp, Homo sapiens
  misc_feature: GZ8MTXP02GS3HJ.25.36.D03.1.454.CMB.2.raw
  modified_base (410)..(410): a, c, t, g, unknown or other
  misc_feature (410)..(410): n is a, c, g, or t
  modified_base (437)..(437): a, c, t, g, unknown or other
  misc_feature (437)..(437): n is a, c, g, or t
tcagactgtacagtcacgaccggtgctcgatttagctgcgtcacgatctctcttgggggggtctcaggaggcagcgctctcgggacgtctccaccatggcctgggctctgctgttcctcaccctcctcactcagggcacagggtcctgggcccagtctgccctgactcagcctgcctccgtgtctgggactcctggacagtcggtcaccatctcctgcactggaaccagccgtgacattggtgcttataactatgtctcctgtcccaacaacacccagcaagccccaaatcatcattatgatgtcagtcatcggcctctggatttcctggtctcttctctggctccagtctggcactcggcctccctgaccatccgtcggggctcccgaggctggaggcgagcttacttntattgctattcatacagacacaccaanagtcgtggtacgtcggacggacggaccaggttcgaccgtctcggtcacgcccgaggcctccgccccgtcggtccc

SEQ ID NO: 311605 - DNA, 519 bp, Homo sapiens
  misc_feature: GZ8MTXP02G2AP2.25.36.D03.1.454.CMB.2.raw
  modified_base (227)..(227): a, c, t, g, unknown or other
  misc_feature (227)..(227): n is a, c, g, or t
  modified_base (241)..(241): a, c, t, g, unknown or other
  misc_feature (241)..(241): n is a, c, g, or t
  modified_base (300)..(300): a, c, t, g, unknown or other
  misc_feature (300)..(300): n is a, c, g, or t
  modified_base (335)..(335): a, c, t, g, unknown or other
  misc_feature (335)..(335): n is a, c, g, or t
  modified_base (435)..(435): a, c, t, g, unknown or other
  misc_feature (435)..(435): n is a, c, g, or t
  modified_base (443)..(443): a, c, t, g, unknown or other
  misc_feature (443)..(443): n is a, c, g, or t
tcagactgtacagtcacgaccggtgctcgatttagctgcgtcacgatctctcttggggggtctcaggaggcagcgctctcgggacgtctccaccatggcctgggctctgctgttcctcaccctcctcactcagggcacagggtcctgggcccagtctgccctgactcagcctgcctccgtgtctgggactcctggacagtcggtcaccatctcctgcactggaaccngccgtgacattggncttataactatgtctcctggtcccaacaacaccagcaacgcccccaaatcatcatttangatgtcagtcatcggcctctggtatttcctggtcncttctctggctccaagtctggcaactcggcctccctgacccagtctcggggctccgaggcctgagacgaggcttagtattattgactatttcatacaganacaccaanagtctggtcgttcggcggagggaccaagttcgaccgtccgtcggtcgacgacccgaacggctcgcccccttcggcc

SEQ ID NO: 311606 - DNA, 497 bp, Homo sapiens
  misc_feature: GZ8MTXP02GC1XX.25.36.D03.1.454.CMB.2.raw
  modified_base (208)..(208): a, c, t, g, unknown or other
  misc_feature (208)..(208): n is a, c, g, or t
  modified_base (237)..(237): a, c, t, g, unknown or other
  misc_feature (237)..(237): n is a, c, g, or t
tcagactgtacagtcacgaccggtgctcgatttagctgcgtcacgatctctcttggggagcttcagctgtggtagagaagacaggattcaggacaatctccagcatggccggcctccctctcctcctcaccctcctcactcactgtgcagggtcctgggcccagtctgtgctgactcagccaccctcagtgtctcgggacccccgggnaggagggtctccatctcttgttctgggancagctccgacgtcggaaataagttgtctactggtaccagcagctccagaacgccccaagctcctcatctatagatgatcagcgccctgacggatacctgaccgattctctggctacgaagtctggctcctcggccctcctggccatcagtcggctcggtccgaggactgaggctgaatagttactgtgcagtttggatgcagtctgagtggtcgacggtgtcggcggacgggcctaagctcgaccgtctagcagccacgg

SEQ ID NO: 311607 - DNA, 523 bp, Homo sapiens
  misc_feature: GZ8MTXP02HOSZS.25.36.D03.1.454.CMB.2.raw
  modified_base (243)..(243): a, c, t, g, unknown or other
  misc_feature (243)..(243): n is a, c, g, or t
  modified_base (306)..(306): a, c, t, g, unknown or other
  misc_feature (306)..(306): n is a, c, g, or t
  modified_base (324)..(324): a, c, t, g, unknown or other
  misc_feature (324)..(324): n is a, c, g, or t
  modified_base (329)..(329): a, c, t, g, unknown or other
  misc_feature (329)..(329): n is a, c, g, or t
  modified_base (335)..(335): a, c, t, g, unknown or other
  misc_feature (335)..(335): n is a, c, g, or t
  modified_base (378)..(378): a, c, t, g, unknown or other
  misc_feature (378)..(378): n is a, c, g, or t
  modified_base (446)..(446): a, c, t, g, unknown or other
  misc_feature (446)..(446): n is a, c, g, or t
  modified_base (468)..(468): a, c, t, g, unknown or other
  misc_feature (468)..(468): n is a, c, g, or t
  modified_base (492)..(492): a, c, t, g, unknown or other
  misc_feature (492)..(492): n is a, c, g, or t
tcagactgtacagtcacgaccggtgctcgatttagctgcgtcacgatctctcttgggggggtctcaggaggcagcgctctcgggacgtctccaccatggcctgggctctgctgttcctccaccctcctcactcagggcacagggtcctgggcccagtctgccctgactcagcctgcctccgtgtctgggactcctggacagtcggtcaccatctcctgcactggaaccagccgtgacattggngcttataactatgtctcctggtcccaacaacacccaggcaacggcccccaaatcatcatttangatgtcagtcatcgcctntggtntttccnggtctcttctctcggctccgaagtctggcaactcggcctcccngtaccatcgtcggggctcccgaggcctggacggacgagcttacttattattgtctatttcatacaganacacaacagtctggtcgtcggnggacggacctaagtcgaccgtccncgtcgacgcccgacggctccgccctcggtcc

SEQ ID NO: 311608 - DNA, 539 bp, Homo sapiens
  misc_feature: GZ8MTXP02IYHRQ.25.36.D03.1.454.CMB.2.raw
  modified_base (259)..(259): a, c, t, g, unknown or other
  misc_feature (259)..(259): n is a, c, g, or t
  modified_base (308)..(308): a, c, t, g, unknown or other
  misc_feature (308)..(308): n is a, c, g, or t
  modified_base (321)..(321): a, c, t, g, unknown or other
  misc_feature (321)..(321): n is a, c, g, or t
tcagactgtacagtcacgaccggtgctcgatttagctgcgtcacgatctctcttgggagatgggtcctgtcccagatgcacctgcaggagtcgggcccaggactggtgaagccttcggagaccctgtccctcacctgcagtgtctctggtggctccgtcagtgcttattactggagctggatccgccagtccgccgggagggactgggagtggattgggcgtatatatacgaatggattaaccactacaacccctcctnaagagtcgagtcaccatatcagcggacacgtccagggatcaggtgtccngcatctgacttcngcactgccgcggacacggccctatactactgtgccagagattcggactgcgacgtattttcgagtaattattatctttgtgtctttgactatggtggggaccaaggggacgacggtcaccgtctcttcacgcctccaccaacggcccacgtccggtccttccccctggccaccctccctccaacgaacgccaccgtccgtcggggccacgacgcccgg

SEQ ID NO: 311609 - DNA, 517 bp, Homo sapiens
  misc_feature: GZ8MTXP02GZ0B0.25.36.D03.1.454.CMB.2.raw
  modified_base (303)..(303): a, c, t, g, unknown or other
  misc_feature (303)..(303): n is a, c, g, or t
  modified_base (456)..(456): a, c, t, g, unknown or other
  misc_feature (456)..(456): n is a, c, g, or t
tcagactgtacagtcacgaccggtgctcgatttagctgcgtcacgatctctcttggggggtctcaggaggcagcgctctcgggacgtctccaccatggcctgggctctgctgttcctcaccctcctcactcagggcacagggtcctgggcccagtctgccctgactcagcctgcctccgtgtctgggactcctggacagtcggtcaccatctcctgcactggaaccagccgtgacattggtgcttataactatgtctcctggtcccaacaacacccaggcaaggcccccaaatcatcatttangatgtcagtcatcggccctctggtagtttcctggtcgcttctctggctccaagtctggcaactcggcctccctgaccatctcgggctccgaggctgaggacgagctacttatattgctatttcatacagacacacaacagtctggtcgtcggnggacggaccaagttcgaccgtccgtcggtaacgacgaccgaacggctcgccccctcggtcc

SEQ ID NO: 311610 - DNA, 537 bp, Homo sapiens
  misc_feature: GZ8MTXP02JDZBO.25.36.D03.1.454.CMB.2.raw
  modified_base (178)..(178): a, c, t, g, unknown or other
  misc_feature (178)..(178): n is a, c, g, or t
  modified_base (283)..(283): a, c, t, g, unknown or other
  misc_feature (283)..(283): n is a, c, g, or t
  modified_base (307)..(307): a, c, t, g, unknown or other
  misc_feature (307)..(307): n is a, c, g, or t
  modified_base (317)..(317): a, c, t, g, unknown or other
  misc_feature (317)..(317): n is a, c, g, or t
  modified_base (360)..(360): a, c, t, g, unknown or other
  misc_feature (360)..(360): n is a, c, g, or t
  modified_base (400)..(400): a, c, t, g, unknown or other
  misc_feature (400)..(400): n is a, c, g, or t
tcagactgtacagtcacgaccggtgctcgatttagctgcgtcacgatctctcttggggtgtgggctcagaagcagagttctggggtgtctccaccatggcctggacccctctctggctcactctcctcactctttgcataggttctgtggtttcttctgaactgactcaggaccccgntgtgtctgtggccttgggacagacagtcaggatcacatgccaaaggagacagcctcagaacttatatgcatcctggtaccagcagaacgccggacacggcccctntactgtcttctacggtgaaaaccncccgcccctnagggatctcagaccgattccctctggcctccgcctcaggaacncagcttcctgaccatcacgtggggctcgaggcgacgaagntgaggctagacttattactgttcccgtccgggacaccgagtggtaagctaggttgtggtcgtcgggcggacggaccgaggtcgaccgtcgtaggtaccacgacccgaaggctccgccccgtcggtcacctcttcccg

SEQ ID NO: 311611 - DNA, 629 bp, Homo sapiens
  misc_feature: GZ8MTXP02GB4JZ.25.36.D03.1.454.CMB.2.raw
  modified_base (244)..(244): a, c, t, g, unknown or other
  misc_feature (244)..(244): n is a, c, g, or t
  modified_base (256)..(256): a, c, t, g, unknown or other
  misc_feature (256)..(256): n is a, c, g, or t
tcagactgtacagtcacgaccggtgctcgatttagctgcgtcacgatctctcttgggggggtctcaggaggcagcgctctcgggacgtctccaccatggcctgggctctgctgttcctcaccctcctcactcagggcacagggtcctgggcccagtctgccctgactcagcctgcctccgtgtctgggactcctggacagtcggtcaccatctcctgcactggaaccagccgtgacattgggtntacttataactntgtctcctcgtaccaacaaccaccaggaccaaccgaccccaaactcatctatttatgtatgtacagtcacgtccgtcctgtggtacgtttccgtggtctcttctctcgtcctccgaagtctacggacctaaccgtccggccctccctacgaccctacgtccggtcggggcctcccgacggtccgtacggaacgggacgacggtactttaacgtttattacgttcgtacttatttacaacttaacgaagaacgaaccaacctaagtacgttcgttgggttacggttacgggacgggtaacggtaaccgtaacggttccgtaccgtccgtacggtaacgaccgacccgtacggtcctcccggtccccgtcggtcc

SEQ ID NO: 311612 - DNA, 573 bp, Homo sapiens
  misc_feature: GZ8MTXP02F4IYW.25.36.D03.1.454.CMB.2.raw
  modified_base (242)..(242): a, c, t, g, unknown or other
  misc_feature (242)..(242): n is a, c, g, or t
  modified_base (244)..(244): a, c, t, g, unknown or other
  misc_feature (244)..(244): n is a, c, g, or t
  modified_base (247)..(248): a, c, t, g, unknown or other
  misc_feature (247)..(248): n is a, c, g, or t
  modified_base (251)..(251): a, c, t, g, unknown or other
  misc_feature (251)..(251): n is a, c, g, or t
  modified_base (254)..(254): a, c, t, g, unknown or other
  misc_feature (254)..(254): n is a, c, g, or t
  modified_base (259)..(259): a, c, t, g, unknown or other
  misc_feature (259)..(259): n is a, c, g, or t
  modified_base (279)..(279): a, c, t, g, unknown or other
  misc_feature (279)..(279): n is a, c, g, or t
tcagactgtacagtcacgaccggtgctcgatttagctgcgtcacgatctctcttggggggggtctcaggaggcagcactctcgggacgtctccaccatggcctgggctctgctcctcctcagcctcctcactcagggcacaggatcccgggctcagtctgccctgactcagcctcgctcagtgtccgggtctcctggacagtcagtcaccatctcctgcactggaaccagaagtgatctgtntntannacnctntctcngctactacgttaccagaacnccagatctatcttatgtatgtacgaggacgccgcctcgaccggtcctgactcgtcttcgtcgtcggtactaacgtcgtacgaccaacgaccgtccctccgtacgacctactcgtcgtcgtcgtccgtacgtcgtagacgtacgtaggtacgtacgtagttattacgttacgttacgttacgtacgtacgtacggtacgtacgtacgtacgtacgtacgtacgtacgtacgttggttcggttcggtacggtacgacgaaccgacgtacgtacgtaccgtaccgtacgtacgtacg

SEQ ID NO: 311613 - DNA, 727 bp, Homo sapiens
  misc_feature: GZ8MTXP02JLO65.25.36.D03.1.454.CMB.2.raw
  modified_base (227)..(227): a, c, t, g, unknown or other
  misc_feature (227)..(227): n is a, c, g, or t
  modified_base (242)..(242): a, c, t, g, unknown or other
  misc_feature (242)..(242): n is a, c, g, or t
  modified_base (302)..(302): a, c, t, g, unknown or other
  misc_feature (302)..(302): n is a, c, g, or t
  modified_base (335)..(335): a, c, t, g, unknown or other
  misc_feature (335)..(335): n is a, c, g, or t
tcagactgtacagtcacgaccggtgctcgatttagctgcgtcacgatctctcttgggggggtctcaggaggcagcgctctcgggacgtctccaccatggcctgggctctgctgttcctcaccctcctcactcagggcacagggtcctgggcccagtctgccctgactcagcctgcctccgtgtctgggactcctggacagtcgtcaccatctcctgcactggaaccngccgtgacattggtncttataactatgtctcctggtccaacaacaccaggcaacggcccccaaatcatcatttangatgtcagtcatcggccctctggtatttcccgnggttccgtctttctcgtggcctccgtaagttcttcgggacctaaccgtccgggccccttcccgttcgaaccctagttcccgtccgggggccttaccccgaggcccgttgggaaacgggtaccggaacgggtcctttaaaccgtttaatttaagtttcgtacccttaatttttaccaaagtttaaccaagggtaaaccgtaaacctaaacccaaaacccgtaaggttacccgttagggggtttaccggtttccgggggaccggggtaaacgggggtaaccccgtaaaagggttttcccggaaaccccggttcccgttaccggggtaaccaccgggtacccccgtaaaacgggccccgttacccggtacccccccggttacgggtttacccccg

SEQ ID NO: 311614 - DNA, 530 bp, Homo sapiens
  misc_feature: GZ8MTXP02F5JCB.25.36.D03.1.454.CMB.2.raw
  modified_base (306)..(306): a, c, t, g, unknown or other
  misc_feature (306)..(306): n is a, c, g, or t
  modified_base (356)..(356): a, c, t, g, unknown or other
  misc_feature (356)..(356): n is a, c, g, or t
  modified_base (390)..(390): a, c, t, g, unknown or other
  misc_feature (390)..(390): n is a, c, g, or t
tcagactgtacagtcacgaccggtgctcgatttagctgcgtcacgatctctcttggggtgtgggctcagaagcagagttctggggtgtctccaccatggcctggacccctctctggctcactctcctcactctttgcataggttctgtggtttcttctgaactgactcaggaccccgctgtgtctgtggccttgggacagacagtcaggatcacatgccaaggagacagcctcagaacttattatgcatcctggtaccagcagaagccgggacaggcccctctacttgtcttctacggtgaaaacnccccgcccctcagggatctcagaccgattcctctggctccgctcaggacncagcttcctgaccatcatgggctcaggcgcaagntgaggctagactattactgttccctcccgggacaccgagtacgtaagctagggttgtggtcgttcggcggacgggaccaaaggtcggaaccgtcgtacggtcacggcccaaggcctcgccccctcggtcacctcgttccg

SEQ ID NO: 311615 - DNA, 510 bp, Homo sapiens
  misc_feature: GZ8MTXP02FJDE1.25.36.D03.1.454.CMB.2.raw
  modified_base (244)..(244): a, c, t, g, unknown or other
  misc_feature (244)..(244): n is a, c, g, or t
  modified_base (305)..(305): a, c, t, g, unknown or other
  misc_feature (305)..(305): n is a, c, g, or t
  modified_base (325)..(325): a, c, t, g, unknown or other
  misc_feature (325)..(325): n is a, c, g, or t
tcagactgtacagtcacgaccggtgctcgatttagctgcgtcacgatctctcttgggggggtctcaggaggcagcgctctcgggacgtctccaccatggcctgggctctgctgttcctcaccctcctcactcagggcacagggtcctgggcccagtctgccctgactcagcctgcctccgtgtctgggactcctggacagtcggtcaccatctcctgcactgggaaccagccgtgacattggtncttataactatgtctcctggtcccaacaacacccaggcaaggcccccaaatcatcatttangatgtcagtcatcggccctntggtagtttcctggtcgcttctctggctccagtctggcactcggcctccctgaccatctcggggctccgagctgagcgaggctacttattattgctatttcatacagagacacaacagtctggtgttcggcggagggaccaaagttcgaccgtctcggtcagcccaacggctcgccccctggtcc

SEQ ID NO: 311616 - DNA, 513 bp, Homo sapiens
  misc_feature: GZ8MTXP02G12DZ.25.36.D03.1.454.CMB.2.raw
  modified_base (243)..(243): a, c, t, g, unknown or other
  misc_feature (243)..(243): n is a, c, g, or t
  modified_base (439)..(439): a, c, t, g, unknown or other
  misc_feature (439)..(439): n is a, c, g, or t
  modified_base (454)..(454): a, c, t, g, unknown or other
  misc_feature (454)..(454): n is a, c, g, or t
tcagactgtacagtcacgaccggtgctcgatttagctgcgtcacgatctctcttgggggggtctcaggaggcagcgctctcgggacgtctccaccatggcctgggctctgctgttcctcaccctcctcactcagggcacagggtcctgggcccagtctgccctgactcagcctgcctccgtgtctgggactcctggacagtcggtcaccatctcctgcactggaaccagccgtgacattggtncttataactatgtctcctggtcccaacaacacccaggcaaggcccccaaatcatcatttatgatgtcagtcatcggcctctggtatttcctggtcgcttctctgctcagtctgcactcgcctccctgaccatcgtcggggctccgaggctgaggacgaggctacttattattgctatttcatacagacgacacaanagtctggtcgtcggnggacggaccaagttcgaccgtcgtcggtcacgacccgaaggcctcgcccccgtggtacc

SEQ ID NO: 311617 - DNA, 530 bp, Homo sapiens
  misc_feature: GZ8MTXP02GBBBK.25.36.D03.1.454.CMB.2.raw
tcagactgtacagtcacgaccggtgctcgatttagctgcgtcacgatctctcttgggggggtctcaggaggcagcactctcgggacgtctccaccatggcctgggctctgctcctcctcagcctcctcactcagggcacaggatcccgggctcagtctgccctgactcagcctcgctcagtgtccggtctcctggacagtcagtcaccatctcctgcactggaaccagaagtgatcttggtgcttatgacactgtctctggcacctagtttacccaggaaaacgcccccagacgtcactcctttatgatgtcaggaacgcggcctcgacggggtccctgactcgcttctctgggtccaaatctggacaacgacgccctccctcgaccatctcgtgggcctcgaggctgagatgagctagtattattattgcttgtacatatgacaggcaaacttatagttttcggtcgttcggcgtacgacgggaacctaaaggttcgaaccgttcgtcggtacacgtacccgtaaacgg

SEQ ID NO: 311618 - DNA, 492 bp, Homo sapiens
  misc_feature: GZ8MTXP02IAAD7.25.36.D03.1.454.CMB.2.raw
  modified_base (205)..(205): a, c, t, g, unknown or other
  misc_feature (205)..(205): n is a, c, g, or t
  modified_base (294)..(294): a, c, t, g, unknown or other
  misc_feature (294)..(294): n is a, c, g, or t
  modified_base (366)..(366): a, c, t, g, unknown or other
  misc_feature (366)..(366): n is a, c, g, or t
  modified_base (408)..(408): a, c, t, g, unknown or other
  misc_feature (408)..(408): n is a, c, g, or t
tcagactgtacagtcacgaccggtgctcgatttagctgcgtcacgatctctcttggggagcttcagctgtggtagagaagacaggattcaggacaatctccagcatggccggcctccctctcctcctcaccctcctcactcactgtgcagggtcctgggcccagtctgtgctgactcagccaccctcagtgtctgggaccccggnagaggtctcatctcttgtctgggagcagctccgacgtcggaaatagttgtctactggtaccagcagctccagaacggccccaagctccncatctataggatgatcagcggcctcaggataccgtgaccgattctctggctcgaagtctgctctcgcctccnggccatcagtggctcggtcgagatgaggctgaattattacgngtgctagtttgggatgccagtctgtagtcggtccgaggtcgttcggacggagggaccagcgtgaccgtcaggtccagccaacgg

SEQ ID NO: 311619 - DNA, 519 bp, Homo sapiens
  misc_feature: GZ8MTXP02IHLIR.25.36.D03.1.454.CMB.2.raw
  modified_base (187)..(187): a, c, t, g, unknown or other
  misc_feature (187)..(187): n is a, c, g, or t
  modified_base (206)..(206): a, c, t, g, unknown or other
  misc_feature (206)..(206): n is a, c, g, or t
  modified_base (232)..(232): a, c, t, g, unknown or other
  misc_feature (232)..(232): n is a, c, g, or t
  modified_base (380)..(380): a, c, t, g, unknown or other
  misc_feature (380)..(380): n is a, c, g, or t
  modified_base (432)..(432): a, c, t, g, unknown or other
  misc_feature (432)..(432): n is a, c, g, or t
tcagactgtacagtcacgaccggtgctcgatttagctgcgtcacgatctctcttggggagcttcagctgtggtagagaagacaggattcaggacaatctccagcatggccggcctccctctcctcctcaccctcctcactcactgtgcagggtcctgggcccagtctgtgctgactcagccaccctnagtgtctgggacccccggnagaggtctccatctcttgtctgggancagctccgacgtcgaatagttgtctactggtaccagcagctcccagaaccggcccccaagcctcctcatctataggaatgatcagcggccctcgaggactacctgaccgattctctgggctcgaagtctcggctccgtcggccctccncggccagtcagtcggcctccggtccgaggatgaggctagaattattacgtgngcgtagtttgggatcggccagtcgtgagtggtccgaggtggtcggcggaggtaccagcgtcgaccgtctacggtcacgacccgaagg

SEQ ID NO: 311620 - DNA, 755 bp, Homo sapiens
  misc_feature: GZ8MTXP02F782Y.25.36.D03.1.454.CMB.2.raw
  modified_base (242)..(242): a, c, t, g, unknown or other
  misc_feature (242)..(242): n is a, c, g, or t
  modified_base (308)..(308): a, c, t, g, unknown or other
  misc_feature (308)..(308): n is a, c, g, or t
tcagactgtacagtcacgaccggtgctcgatttagctgcgtcacgatctctcttgggggggtctcaggaggcagcgctctcgggacgtctccaccatggcctgggctctgctgttcctcaccctcctcactcagggcacagggtcctgggcccagtctgccctgactcagcctgcctccgtgtctgggactcctggacagtcgtcaccatctcctgcactggaaccagccgtgacattggtntcttataactatgtctcctgtacccaacaacacccaggaccaacggacccccaaatcatcatttangatgtcagtcagtccggcctgtggtacgtttcctggtccgtctttctcgtcggtctccgaagtcgtcggaccaaccgtcggccctcccgtacgaccctacgtccgtcggggtcctcccgacggccgttagggaacgggaccggtacggtacctttaaacgtttaagtttaacgtttcggtactttaactttttaccgaaatttaaacccgaaggaaaccgtacccaaaaccccgtaaacgtaacggtttaccgttacggggttccggtttaccgggggaccggggttaaaccgggggtaaacccccgttaaaagggttttcccgggaaaccccccggtttccggttacccggggttaacccgaacccccgggttaacccccggaaaacccggggttcccccgttacccccggttaacccccccccggtttcggggtttaaccccccg

SEQ ID NO: 311621 - DNA, 576 bp, Homo sapiens
  misc_feature: GZ8MTXP02FRJ8X.25.36.D03.1.454.CMB.2.raw
  modified_base (231)..(231): a, c, t, g, unknown or other
  misc_feature (231)..(231): n is a, c, g, or t
  modified_base (236)..(236): a, c, t, g, unknown or other
  misc_feature (236)..(236): n is a, c, g, or t
  modified_base (262)..(262): a, c, t, g, unknown or other
  misc_feature (262)..(262): n is a, c, g, or t
  modified_base (354)..(354): a, c, t, g, unknown or other
  misc_feature (354)..(354): n is a, c, g, or t
tcagactgtacagtcacgaccggtgctcgatttagctgcgtcacgatctctcttggggagcttcagctgtggtagagaagacaggattcaggacaatctccagcatggccggcctccctctcctcctcaccctcctcactcactgtgcagggtcctgggcccagtctgtgctgactcagccaccctcagtgtctcgggacccccgggcagagggtctccatctcttgttcngggancagctcgacgtacggaaattaagttntctactggtaccagcagcctcccaagaaaccggcccccaaagcctcctcactctaataaggaatgaatcagccgcctcgacgggtactaccngaccgtattctcgtcggctacggtaacgtcctcgggtcctcccgtccggccctcccgtcggccagtcgaggtcggcctccgggtcgaggatgaggtctagaattattactgtgcgtaggtttcgggatgccgagtcgtgaggtcgggtacgtcgggtcgttcggggacggacgggacctaaggccgtacggaccgttccgagggtccacggaccccgaacgg

SEQ ID NO: 311622 - DNA, 559 bp, Homo sapiens
  misc_feature: GZ8MTXP02HX8ZT.25.36.D03.1.454.CMB.2.raw
  modified_base (305)..(305): a, c, t, g, unknown or other
  misc_feature (305)..(305): n is a, c, g, or t
  modified_base (325)..(325): a, c, t, g, unknown or other
  misc_feature (325)..(325): n is a, c, g, or t
tcagactgtacagtcacgaccggtgctcgatttagctgcgtcacgatctctcttgggagatgggtcctgtcccagatgcacctgcaggagtcgggcccaggactggtgaagccttcggagaccctgtccctcacctgcagtgtctctggtggctccgtcagtgcttattactggagctggatccgccagtccgccgggagggactgggagtggattgggcgtatatatacgaatggattaaccacctacaacccctcctcaagagtcgagtcaccatatcagcggacacgtccagggatcaggtnttcctgctatctgactttcngcgactgccgcggacaccggccctatacactgtgccagagacttcggactgcgacgtattttcggagtaattattattctttagtgtctttgactagttggtgggaccgaaggggacgacggtcaccgtctccttcacgtcctaccaccgaacgggcccacgttccggtccttcccccgtcggccctaccctcctaccacgaacgcacccgtcgtacggggccacgacgcccgg

SEQ ID NO: 311623 - DNA, 521 bp, Homo sapiens
  misc_feature: GZ8MTXP02HSZ8D.25.36.D03.1.454.CMB.2.raw
  modified_base (243)..(243): a, c, t, g, unknown or other
  misc_feature (243)..(243): n is a, c, g, or t
  modified_base (305)..(305): a, c, t, g, unknown or other
  misc_feature (305)..(305): n is a, c, g, or t
  modified_base (336)..(336): a, c, t, g, unknown or other
  misc_feature (336)..(336): n is a, c, g, or t
  modified_base (376)..(376): a, c, t, g, unknown or other
  misc_feature (376)..(376): n is a, c, g, or t
  modified_base (381)..(381): a, c, t, g, unknown or other
  misc_feature (381)..(381): n is a, c, g, or t
  modified_base (449)..(449): a, c, t, g, unknown or other
  misc_feature (449)..(449): n is a, c, g, or t
  modified_base (466)..(466): a, c, t, g, unknown or other
  misc_feature (466)..(466): n is a, c, g, or t
tcagactgtacagtcacgaccggtgctcgatttagctgcgtcacgatctctcttgggggggtctcaggaggcagcgctctcgggacgtctccaccatggcctgggctctgctgttcctcaccctcctcactcagggcacagggtcctgggcccagtctgccctgactcagcctgcctccgtgtctgggactcctggacagtcggtcaccatcctcctgcactggaaccagccgtgacattggncttataactatgtctcctggtcccaacaacacccaggcaacggcccccaaatcatcatttangatgtcagtcatcggccctctggtatttccnggtctcttctctggctccaagtctggccactcgcctcccngaccntcgtcgggctcgaggctgaggacgaggcttactttattattgactatttacattacagtagacacaanagtctaggtcgttcggnggacggacctaagttcgaccgtcgcgtcacgaccaggctccgccccgtcggtacc

SEQ ID NO: 311624 - DNA, 542 bp, Homo sapiens
  misc_feature: GZ8MTXP02HTPFK.25.36.D03.1.454.CMB.2.raw
  modified_base (244)..(244): a, c, t, g, unknown or other
  misc_feature (244)..(244): n is a, c, g, or t
  modified_base (438)..(438): a, c, t, g, unknown or other
  misc_feature (438)..(438): n is a, c, g, or t
  modified_base (460)..(460): a, c, t, g, unknown or other
  misc_feature (460)..(460): n is a, c, g, or t
tcagactgtacagtcacgaccggtgctcgatttagctgcgtcacgatctctcttgggggggtctcaggaggcagcgctctcgggacgtctccaccatggcctgggctctgctgttcctcaccctcctcactcagggcacagggtcctgggcccagtctgccctgactcagcctgcctccgtgtctgggactcctggacagtcggtcaccatctcctgcactggaaccagccgtgacattgggtncttataactatgtctcctggtcccaacaacacccaggcaaggcccccaaactcatcatttatgatgtcagtcatcggcctctggtacgtttcctggtcgtcttctctcggctccaagttctggccaacgtcggcctccctgaccatcgtcggggctccgaggcctgaggacgaggcttacgtttatttattgtntatttcatacagagacacgaanagtctgtcgttacggcggacggacctaaggttcgaccgtcctaggtccacgacccgaacggctccggcccccgttcggtccc

SEQ ID NO: 311625 - DNA, 578 bp, Homo sapiens
  misc_feature: GZ8MTXP02GTCTO.25.36.D03.1.454.CMB.2.raw
  modified_base (263)..(263): a, c, t, g, unknown or other
  misc_feature (263)..(263): n is a, c, g, or t
  modified_base (301)..(301): a, c, t, g, unknown or other
  misc_feature (301)..(301): n is a, c, g, or t
  modified_base (318)..(318): a, c, t, g, unknown or other
  misc_feature (318)..(318): n is a, c, g, or t
tcagactgtacagtcacgaccggtgctcgatttagctgcgtcacgatctctcttgggagatgggtcctgtcccagatgcacctgcaggagtcgggcccaggactggtgaagccttcggagaccctgtccctcacctgcagtgtctctggtggctccgtcagtgcttattactggagctggatccgccagtccgccgggagggactgggagtggattgggcgtatatatacgaatggattaaccacctacacccctcctcaagngtcagtcacatatcagcggacacgtccaggatcaggtntcctgcatctgacttcngcgactgccgcggaccacggcccctaatacctactgtcgccaaggagtatttccgggaattggaccgtaacgtagtttttacggagtaatttattattctttgtgttctttttgactagttgggtggggaccgaaggggtacgaccgggtctaccgtctcgttcgacgtccctccacgaacgggcccagtccggtccttcccccgtggccctacccgtccctccaaacgcgccaccgtcggtcgggccacgacggcccgg

SEQ ID NO: 311626 - DNA, 579 bp, Homo sapiens
  misc_feature: GZ8MTXP02ISTX5.25.36.D03.1.454.CMB.2.raw
  modified_base (210)..(210): a, c, t, g, unknown or other
  misc_feature (210)..(210): n is a, c, g, or t
  modified_base (300)..(300): a, c, t, g, unknown or other
  misc_feature (300)..(300): n is a, c, g, or t
  modified_base (354)..(354): a, c, t, g, unknown or other
  misc_feature (354)..(354): n is a, c, g, or t
  modified_base (414)..(414): a, c, t, g, unknown or other
  misc_feature (414)..(414): n is a, c, g, or t
  modified_base (434)..(434): a, c, t, g, unknown or other
  misc_feature (434)..(434): n is a, c, g, or t
tcagactgtacagtcacgaccggtgctcgatttagctgcgtcacgatctctcttggggagcttcagctgtgggtagagaagacaggactcaggacaatctccagcatggccagcttccctctcctcctcaccctcctcactcactgtgcagggtcctgggcccagtctgtgctgtctcagccaccctcagtgtctcgggggccccccggnagagggtcgacatctcttgttctggaagtcgctccaacgtcggcagtaatgtgtaagctggtaccagcaactcccaggaaccgcccccanactcctcatgtatgggaatgatcagcgcccctgacgggtccctgaccgtattcnctgcctccacgtctcggcacctcacgcctcccgtgccatcccgtggcctcgaatctgagntgacggctatttatagttgngcgagcggttaggggcttaggacgaaagggtaaagtaacggtttatcggttaccgttacgggtaagtttcggggaacctaaacggggtccaacccggttccgttaaacgggtcctaaccggaaccccgaacgggtaaaccccccc

SEQ ID NO: 311627 - DNA, 578 bp, Homo sapiens
  misc_feature: GZ8MTXP02IRYHG.25.36.D03.1.454.CMB.2.raw
  modified_base (245)..(245): a, c, t, g, unknown or other
  misc_feature (245)..(245): n is a, c, g, or t
  modified_base (303)..(303): a, c, t, g, unknown or other
  misc_feature (303)..(303): n is a, c, g, or t
  modified_base (484)..(484): a, c, t, g, unknown or other
  misc_feature (484)..(484): n is a, c, g, or t
tcagactgtacagtcacgaccggtgctcgatttagctgcgtcacgatctctcttgggggggtctcaggaggcagcgctctcgggacgtctccaccatggcctgggctctgctgttcctcaccctcctcactcagggcacagggtcctgggcccagtctgccctgactcagcctgcctccgtgtctgggactcctggacagtcggtcaccatcctcctgcactggaacccagccgtgacattggtncttataactatgtctcctgtccaacaacacccaggcaacgcccccaaatcatcattangatgtcagtcatccggccctcgtggtagttttcctcgggtccgtctttctctcggtcctccgaaagttcctgggacctaaccgtccggcccttcccgtgaaccctctccgtccgggggccttcccgaggtcctaggaggaccgaggtcttaactttattattcgctatttcaatacagtanacaaccaacgtagtcgtggttcggtcggacggacgggacctaaggttcgaccgttctcggtccacgcccgaaggcctccgcccccgtaggtccc

SEQ ID NO: 311628 - DNA, 527 bp, Homo sapiens
  misc_feature: GZ8MTXP02HHWTA.25.36.D03.1.454.CMB.2.raw
  modified_base (242)..(242): a, c, t, g, unknown or other
  misc_feature (242)..(242): n is a, c, g, or t
  modified_base (303)..(303): a, c, t, g, unknown or other
  misc_feature (303)..(303): n is a, c, g, or t
  modified_base (323)..(323): a, c, t, g, unknown or other
  misc_feature (323)..(323): n is a, c, g, or t
  modified_base (449)..(449): a, c, t, g, unknown or other
  misc_feature (449)..(449): n is a, c, g, or t
  modified_base (469)..(469): a, c, t, g, unknown or other
  misc_feature (469)..(469): n is a, c, g, or t
tcagactgtacagtcacgaccggtgctcgatttagctgcgtcacgatctctcttgggggggtctcaggaggcagcgctctcgggacgtctccaccatggcctgggctctgctgttcctcaccctcctcactcagggcacagggtcctgggcccagtctgccctgactcagcctgcctccgtgtctgggactcctggacagtcgtcaccatctcctgcactggaaccagccgtgacattggtntcttataactatgtctcctggtcccaacaacacccaggcaacgcccccaaatcatcattangatgtcagtcatcggccctntggtatttcctgtcgtcttctctggctcaagttctggcaaccgtcggcccttccctgaccctatccgtcggggcctccgaggcctggacggacgaggcttacttattatgtctatttcatacaganacacacagtctggtgtcggnggacggactaaggttcgaccgtctcggtcacgccgtacggctccgccccgttagtccc

SEQ ID NO: 311629 - DNA, 518 bp, Homo sapiens
  misc_feature: GZ8MTXP02IJ8M3.25.36.D03.1.454.CMB.2.raw
  modified_base (187)..(187): a, c, t, g, unknown or other
  misc_feature (187)..(187): n is a, c, g, or t
  modified_base (234)..(234): a, c, t, g, unknown or other
  misc_feature (234)..(234): n is a, c, g, or t
  modified_base (417)..(417): a, c, t, g, unknown or other
  misc_feature (417)..(417): n is a, c, g, or t
tcagactgtacagtcacgaccggtgctcgatttagctgcgtcacgatctctcttggggagcttcagctgtggtagagaagacaggattcaggacaatctccagcatggccggcctccctctcctcctcaccctcctcactcactgtgcagggtcctgggcccagtctgtgctgactcagccaccctnagtgtctgggacccccggcagagggtctccatctcttgttctgggancagctccgacgtcggaaatagttgtctactggtaccagcagctcccagaacggccccaagctcctcatctataggaatgatcagcggcctcagggatacctgaccgtattcctctgggctcgaagtcctggctcctcgcctcctggccatcagtggcctcggtccgagatgaggctagaattnttactgtgcgtagtttgggatcgcctagtctgtacggtggtccgacgggttgttacggcggaggtccaagcgtcgaccgtccgtaggtcacgcccgtaagg

SEQ ID NO: 311630 - DNA, 512 bp, Homo sapiens
  misc_feature: GZ8MTXP02FSRL1.25.36.D03.1.454.CMB.2.raw
  modified_base (207)..(207): a, c, t, g, unknown or other
  misc_feature (207)..(207): n is a, c, g, or t
  modified_base (235)..(235): a, c, t, g, unknown or other
  misc_feature (235)..(235): n is a, c, g, or t
  modified_base (427)..(427): a, c, t, g, unknown or other
  misc_feature (427)..(427): n is a, c, g, or t
tcagactgtacagtcacgaccggtgctcgatttagctgcgtcacgatctctcttggggagcttcagctgtggtagagaagacaggattcaggacaatctccagcatggccggcctccctctcctcctcaccctcctcactcactgtgcagggtcctgggcccagtctgtgctgactcagccaccctcagtgtctgggacccccgggnagagggtctccatctcttgttctgggancagctccgacgtcggaaataagttgtctactggtaccagcagctcccagaaacggcccccaagctcctcatctataggaatgatcagcggccctcagggatacctgaccgattcctctggctcgaagtctggctcctcggccctccctggcccatcgagtcgggctccggtccgaggactgaggctgaactnttactgtgcaggtttggatgcagtctgagtggtccgaggtgtcggcggacggaccaagcgtgaccgtctaggtcacggcccaagg

SEQ ID NO: 311631 - DNA, 565 bp, Homo sapiens
  misc_feature: GZ8MTXP02J2C56.25.36.D03.1.454.CMB.2.raw
  modified_base (311)..(311): a, c, t, g, unknown or other
  misc_feature (311)..(311): n is a, c, g, or t
  modified_base (349)..(349): a, c, t, g, unknown or other
  misc_feature (349)..(349): n is a, c, g, or t
  modified_base (374)..(374): a, c, t, g, unknown or other
  misc_feature (374)..(374): n is a, c, g, or t
  modified_base (378)..(378): a, c, t, g, unknown or other
  misc_feature (378)..(378): n is a, c, g, or t
  modified_base (468)..(468): a, c, t, g, unknown or other
  misc_feature (468)..(468): n is a, c, g, or t
tcagactgtacagtcacgaccggtgctcgatttagctgcgtcacgatctctcttggggagctctgggagaggagcccagcactagaagtcggcggtgtttccattcggtgatcagcactgaacacagaggactcaccatggagtttgggctgagctgggttttcctcgttgctcttttaagaggtgtccactgtcaggtgcacctggtggagtcgtggggggagcgtggtccagcctggggagtccctgagactctcctgtgaagcctctggatttagtttcagttggttctggcatgcacgtggggtccncaggctccgagggcaaggggccgagtggtgctagttanagcacatgatcgggaattcagaatnttangcagctcgagaagggccattcacatcacagagactattcccggaatgttgtagttacttaggaaattcgggtacaacggcctaggaacgngttaccggagggtacctcgggtcttcgttagtaactttaccgtggtcgacggtaaggtacggttaccgggggtaggttacggttaaggtttaacggg

SEQ ID NO: 311632 - DNA, 505 bp, Homo sapiens
  misc_feature: GZ8MTXP02HQV2N.25.36.D03.1.454.CMB.2.raw
  modified_base (243)..(243): a, c, t, g, unknown or other
  misc_feature (243)..(243): n is a, c, g, or t
  modified_base (323)..(323): a, c, t, g, unknown or other
  misc_feature (323)..(323): n is a, c, g, or t
  modified_base (334)..(334): a, c, t, g, unknown or other
  misc_feature (334)..(334): n is a, c, g, or t
  modified_base (373)..(373): a, c, t, g, unknown or other
  misc_feature (373)..(373): n is a, c, g, or t
  modified_base (378)..(378): a, c, t, g, unknown or other
  misc_feature (378)..(378): n is a, c, g, or t
  modified_base (441)..(441): a, c, t, g, unknown or other
  misc_feature (441)..(441): n is a, c, g, or t
  modified_base (456)..(456): a, c, t, g, unknown or other
  misc_feature (456)..(456): n is a, c, g, or t
  modified_base (478)..(478): a, c, t, g, unknown or other
  misc_feature (478)..(478): n is a, c, g, or t
tcagactgtacagtcacgaccggtgctcgatttagctgcgtcacgatctctcttgggggggtctcaggaggcagcgctctcgggacgtctccaccatggcctgggctctgctgttcctcaccctcctcactcagggcacagggtcctgggcccagtctgccctgactcagcctgcctccgtgtctgggactcctggacagtcggtcaccatctcctgcactggaaccagccgtgactattggncttataactatgtctcctggtcccaacaacaccaggcaacggcccccaaatcatcatttatgatgtcagtcatcggcctntggtatttccnggtcgtcttctctggctccagtctggcaactcgctcccngaccntctcgggctccgaggctgaggacgaggctacttattattgtctatttcatacagagacacaangtctggtgttacggnggacggaccaagttcgacgtcncggtcacgccgaggctcgccctggtcc

SEQ ID NO: 311633 - DNA, 524 bp, Homo sapiens
  misc_feature: GZ8MTXP02JSGQ7.25.36.D03.1.454.CMB.2.raw
  modified_base (243)..(243): a, c, t, g, unknown or other
  misc_feature (243)..(243): n is a, c, g, or t
  modified_base (396)..(396): a, c, t, g, unknown or other
  misc_feature (396)..(396): n is a, c, g, or t
  modified_base (420)..(420): a, c, t, g, unknown or other
  misc_feature (420)..(420): n is a, c, g, or t
  modified_base (433)..(433): a, c, t, g, unknown or other
  misc_feature (433)..(433): n is a, c, g, or t
  modified_base (437)..(437): a, c, t, g, unknown or other
  misc_feature (437)..(437): n is a, c, g, or t
tcagactgtacagtcacgaccggtgctcgatttagctgcgtcacgatctctcttgggggggtctcaggaggcagcgctctcgggacgtctccaccatggcctgggctctgctgttcctcaccctcctcactcagggcacagggtcctgggcccagtctgccctgactcagcctgcctccgtgtctgggactcctggacagtcggtcaccatctcctgcactggaaccagccgtgacattggtncttataactatgtctcctggtccaacaacacccaggcaaggcccccaaatcatcattatgatgtcagtcatcggcctctggtagttctggtcgcttctctggctccaagtctggcaactcggcctccctgaccatctcggggctccgaggccngagacgacgtactacttattattntctattactatanaganacacaactagtcgtggtcggtcggacgggacggacgtaacgtacgtaccgtcgtcgtcgacgaccgacgtacgtccgtcccgtcgtc

SEQ ID NO: 311634 - DNA, 701 bp, Homo sapiens
  misc_feature: GZ8MTXP02G8QJ0.25.36.D03.1.454.CMB.2.raw
  modified_base (209)..(209): a, c, t, g, unknown or other
  misc_feature (209)..(209): n is a, c, g, or t
tcagactgtacagtcacgaccggtgctcgatttagctgcgtcacgatctctcttggggagcttcagctgtggtagagaagacaggattcaggacaatctccagcatggccggcctccctctcctcctcaccctcctcactcactgtgtagggtcctgggcccagtctgtgctgactcagcccaccctcagtgtcgtcgggacccccggnaggaggtctccatctcttgttctgggagcagctccgacgtacgaaaatagttgtctactggtaccagcagcctacccaagaaacccggccccaagcctcctacatctataggaatgatcgacgccgtccctcgaggaccctaccgtgacccgtattctcgtcggcgtcggtaagtccgtggtcccttccgtcccgggtccccttaccccgtcggtaccctacgttccggtacgggtccgggggtcccgttcccccgggggtaccggaaggggtaacgtcgggaacgggtccgttaaggtaaaactttacgtttacgtcggtcggtacgttaagggttttcggggaattcggaccgttaggttaccgtagggtacgggttcgggtcccgggtacggggtttcgggttaccggggacggggtacggggaaccaaggtccgtaaccggtaacccgttccggtaacggtcccgacggacccccggtaaggtccccg

SEQ ID NO: 311635 - DNA, 513 bp, Homo sapiens
  misc_feature: GZ8MTXP02IHMKU.25.36.D03.1.454.CMB.2.raw
  modified_base (128)..(128): a, c, t, g, unknown or other
  misc_feature (128)..(128): n is a, c, g, or t
  modified_base (227)..(227): a, c, t, g, unknown or other
  misc_feature (227)..(227): n is a, c, g, or t
  modified_base (242)..(242): a, c, t, g, unknown or other
  misc_feature (242)..(242): n is a, c, g, or t
  modified_base (304)..(304): a, c, t, g, unknown or other
  misc_feature (304)..(304): n is a, c, g, or t
  modified_base (322)..(322): a, c, t, g, unknown or other
  misc_feature (322)..(322): n is a, c, g, or t
  modified_base (439)..(439): a, c, t, g, unknown or other
  misc_feature (439)..(439): n is a, c, g, or t
tcagactgtacagtcacgaccggtgctcgatttagctgcgtcacgatctctcttgggggggtctcaggaggcagcgctctcgggacgtctccaccatggcctgggctctgctgttcctcaccctcctnactcagggcacagggtcctgggcccagtctgccctgactcagcctgcctcgtgtctgggactcctggacagtcggtcaccatctcctgcactggaaccngccgtgacattggtncttataactatgtctcctggtcccaacaaccaccaggcaacggcccccaaactcatcattangatgtcagtcatcgcctntggtagtttcctggtcgcttctctggctcaagtctgctaactcgcctccctcaccatcgtcgggctccgagctgagacgagctacttattattgctatttcatacagagacacaatntacgtgtcgtcggcggacggtacaacgtcgaccgtccgtcgtcgcgaccgtacggcctcggccccctggtaccc

SEQ ID NO: 311636 - DNA, 572 bp, Homo sapiens
  misc_feature: GZ8MTXP02JXUYE.25.36.D03.1.454.CMB.2.raw
  modified_base (236)..(236): a, c, t, g, unknown or other
  misc_feature (236)..(236): n is a, c, g, or t
  modified_base (333)..(333): a, c, t, g, unknown or other
  misc_feature (333)..(333): n is a, c, g, or t
  modified_base (345)..(345): a, c, t, g, unknown or other
  misc_feature (345)..(345): n is a, c, g, or t
tcagactgtacagtcacgaccggtgctcgatttagctgcgtcacgatctctcttggggagcttcagctgtggtagagaagacaggattcaggacaatctccagcatggccggcctccctctcctcctcaccctcctcactcactgtgcagggtcctgggcccagtctgtgctgactcagccaccctcagtgtctcgggacccccgggcagagggtctccatctcttgttctgggancagctccgacgtcggaaataagttgtctactggtaccagcagctcccagaaaccggcccccaagcctcctcatctataggaatgatcagccgccctnacgggactaccngaccgattctctggctcgaagtctggctcctcggccctccctggcccatcgagtcgggcctacccgggtccgagggatggaggctaggaattattactggtgcgtaggtttgggattgccgtagtcgtggtacggttcggtccggtacggggttggttccggggcgggacggggacccaaggtccgtacggtacccggtccgtaagggtccaacggccccgaacggg

SEQ ID NO: 311637 - DNA, 722 bp, Homo sapiens
  misc_feature: GZ8MTXP02G8QAO.25.36.D03.1.454.CMB.2.raw
  modified_base (207)..(207): a, c, t, g, unknown or other
  misc_feature (207)..(207): n is a, c, g, or t
  modified_base (358)..(358): a, c, t, g, unknown or other
  misc_feature (358)..(358): n is a, c, g, or t
tcagactgtacagtcacgaccggtgctcgatttagctgcgtcacgatctctcttggggagcttcagctgtggtagagaagacaggattcaggacaatctccagcatggccggcctccctctcctcctcaccctcctcactcactgtgcagggtcctgggcccagtctgtgctgactcagccaccctcagtgtctgggacccccgggnagagggtctccatctcttgttctgggagcagctccgacgtacggaaataagtttgtctactggtaccagcagctccagaaaccggccccaagctcctcatctataggaatgatcagccggccctgacgggactacctagaccgtatttccncgttcggctcggtaaagtccgtcggcctccgtccggtccctcccgtcggcccacgtccacgggtcggggtcccgtccgggtacccggagggtacgtcgggaagggccgttaaggaaagtttagtttaaccgttgggttacggtaccgttaaggggtttttgggggaacgttcgggtaccccgtaaggtttccgttaggggtaaacgggtttcgggggttacccggtaacgggggtttcgggtttccgggggaccgggggttaacgggggaaccccgtaaaagggtccccggttaacgggaacccccgggtttacccggttaaacgggggttaccccgtaaccggggacccccgtaaaccggggg

SEQ ID NO: 311638 - DNA, 599 bp, Homo sapiens
  misc_feature: GZ8MTXP02IANGK.25.36.D03.1.454.CMB.2.raw
  modified_base (197)..(197): a, c, t, g, unknown or other
  misc_feature (197)..(197): n is a, c, g, or t
  modified_base (242)..(242): a, c, t, g, unknown or other
  misc_feature (242)..(242): n is a, c, g, or t
tcagactgtacagtcacgaccggtgctcgatttagctgcgtcacgatctctcttgggggggtctcaggaggcagcgctctcgggacgtctccaccatggcctgggctctgctgttcctcaccctcctcactcagggcacagggtcctgggcccagtctgccctgactcagcctgcctcgtgtctggactcctggacngtcggtcaccatctcctgcactggaaccagccgtgactattggtncttataactatgtctcctgtcccaacaacacccaggcaaggcccccaaatcatcatttatgatgtcagtcatccggccctcgtggtacgtttccgtggtccgtcttcctcgtcggtctccaagttctcggacctaaccgtccggccctccctcgacccatcgtcggggcctccgaggtcctggaggaccgaggccttaacgtttatttagttgtacttatttcaattaccgaagagaaccaaccaactagtcgttacggtcggttcgggcgggtaacgggtacccgtaaggtttacgacccggttcgtccggtaaccgacgacccgaacgggccttcccggaccccgtttcggtccc

SEQ ID NO: 311639 - DNA, 542 bp, Homo sapiens
  misc_feature: GZ8MTXP02J1P4H.25.36.D03.1.454.CMB.2.raw
  modified_base (492)..(492): a, c, t, g, unknown or other
  misc_feature (492)..(492): n is a, c, g, or t
tcagactgtacagtcacgaccggtgctcgatttagctgcgtcacgatctctcttggggacccaaaaaccacacccctccttgggagaatcccctagatcacagctcctcaccatggactggacctggagcatccttttcttggtggcagcagcaacaggtgcccactcccaggttcaactggtgcagtctggacctgaggtgaagaagcctggggcctcagtgaaggtctcctgcaaggcttctggttacacctttagcagctatggcatcagctgggtgcgacaggcccctggacaagggcttggagtggatggcagtggatcgagtaccttaaacagtcggtatcacagactatgcacgaggacttccgagggcagacgtacaccgttgaaccacacgaacacactaccgacgacgcaacacgacctacagtcggacctggaggacgccgtaggacgactcgagaacgacgaccggacgtatacgttacnggtcgacgtagagtcgtattacgtcgtaccgttacgtccggtactacccg

SEQ ID NO: 311640 - DNA, 739 bp, Homo sapiens
  misc_feature: GZ8MTXP02GI5HB.25.36.D03.1.454.CMB.2.raw
tcagactgtacagtcacgaccggtgctcgatttagctgcgtcacgatctctcttggggggggtctcaggaggcagcgctctcgggacgtctccaccatggcctgggctctgctgttcctcaccctcctcactcagggcacagggtcctgggcccagtctgccctgactcagcctgcctccgtgtctgggactcctggacagtcggtcaccatcctcctgcactggaaccagccgtgactagttggtgtcttaataactatgtctcctggtacccaacaaccacccaggccaacggacccccaaatcatcatttatgatgtcagtcagtccggccctgtggtagtttcctggtccgtctttctctcggctccaagtctacggacctaaccgtccggccctcccgtcgaccctacgtccgtccggggcctcccgaggcctagggaacgggaacgacggtaccttaaaccgtttaatttaagttcgtacttaattttacccaaattaacccgaagaacggtaacccaaaacccggtaaactaacggttaccgttaggggtttcgggtttacccgggggtaaccgggggaaaccgggggtaaaccccgtaaaacgggttttccgggtaaacccccggtttcccgttacccgggggttaacccgtaaacccgggtacccccggaaaacgggggtacccccttaccccgggtacccccccccggtttcggggtttaaaccccccg

SEQ ID NO: 311641 - DNA, 708 bp, Homo sapiens
  misc_feature: GZ8MTXP02H43XN.25.36.D03.1.454.CMB.2.raw
  modified_base (208)..(208): a, c, t, g, unknown or other
  misc_feature (208)..(208): n is a, c, g, or t
  modified_base (296)..(296): a, c, t, g, unknown or other
  misc_feature (296)..(296): n is a, c, g, or t
  modified_base (303)..(303): a, c, t, g, unknown or other
  misc_feature (303)..(303): n is a, c, g, or t
tcagactgtacagtcacgaccggtgctcgatttagctgcgtcacgatctctcttggggagcttcagctgtgggtagagaagacaggactcaggacaatctccagcatggccagcttccctctcctcctcaccctcctcactcactgtgcagggtcctgggcccagtctgtgctgtctcagccaccctcagtgtctggggccccccggnaggagggtcgacatctcttgttctggaagtcgctccaacgtcggcagtaatgtgtaagctggaccagcaactcccaggaccgccccanactcctnatgtatgggaatgatcagccgcccctcgacggggtcccctgacccgtatttcctctgccctcaccgtctcggccacctcacgccctccctcggccctacgtcccgtcggggtccctacccgtaacgtccgttaggacgggtaacgttcggaccgggtacccggttaattttaacgtttaagtttagggttcgaccgtaagggttccgggttagggggtaacttagggtaaaaccgaaagggggtaaaacggtaaaaccggggttttaagtacgggtttaccggtttaaacgggggtaaacgtttacgggggtaaaacccgtaaacggggttaaccccgtaacccgggttacccgtaacggggttaccgaaacccggtaccccggtaaaaccggggaacccccccg

SEQ ID NO: 311642 - DNA, 621 bp, Homo sapiens
  misc_feature: GZ8MTXP02IAV89.25.36.D03.1.454.CMB.2.raw
  modified_base (207)..(207): a, c, t, g, unknown or other
  misc_feature (207)..(207): n is a, c, g, or t
  modified_base (231)..(231): a, c, t, g, unknown or other
  misc_feature (231)..(231): n is a, c, g, or t
  modified_base (299)..(299): a, c, t, g, unknown or other
  misc_feature (299)..(299): n is a, c, g, or t
  modified_base (351)..(351): a, c, t, g, unknown or other
  misc_feature (351)..(351): n is a, c, g, or t
tcagactgtacagtcacgaccggtgctcgatttagctgcgtcacgatctctcttggggagcttcagctgtggtagagaagacaggattcaggacaatctccagcatggccggcctccctctcctcctcaccctcctcactcactgtgcagggtcctgggcccagtctgtgctgactcagccaccctcagtgtctcgggacccccggnagaggtctcatctcttgtctggancagctccgacgtcggaaatagttgtctactggtaccagcagctcccagaaaccggcccccaagctccncatctataggaatgatcagccggccctgacggactacctgaccgtatttccnctggccttcgaagttcctggcctcctccggcccctccgtggcccattccgagtcgggcctaccgggtccgaggtactggacggtcttaggaaatttagtttacgtggtcgtcgtaagggtttggggtatcggcccgtaagtttccgtaggtacggtcggggttacccggagggtttcggttccgggggacgggaacggggtaaccaaacgggtccgttacggaaccccggtttccggtaacgggttcccgaacggtacccccgaaacggg

SEQ ID NO: 311643 - DNA, 592 bp, Homo sapiens
  misc_feature: GZ8MTXP02JCPZB.25.36.D03.1.454.CMB.2.raw
  modified_base (243)..(243): a, c, t, g, unknown or other
  misc_feature (243)..(243): n is a, c, g, or t
  modified_base (304)..(304): a, c, t, g, unknown or other
  misc_feature (304)..(304): n is a, c, g, or t
tcagactgtacagtcacgaccggtgctcgatttagctgcgtcacgatctctcttgggggggtctcaggaggcagcgctctcgggacgtctccaccatggcctgggctctgctgttcctcaccctcctcactcagggcacagggtcctgggcccagtctgccctgactcagcctgcctccgtgtctgggactcctggacagtcggtcaccatctcctgcactggaacccagccgtgacattggncttataactatgtctctggtcccaacaacacccaggcaacggcccccaaatcatcatttangatgtcagtcatccggcctcgtggtagtttcctggtcgtcttctcgtggctccgaagtctcggacctaaccgtcggtccctccctgaccctagttccgtcgggggcctcccgaggcctaggacggacgaggtcttaacgttatttagtgtctatttcaattaccgagtacacaccaaagtgtctggtcgttcgggacggacgggtaacctaaaggttcgaacccgttccgtacgggtaaccacggacccccgtaaggggtccctaccggtccccccgttacggtcccc

SEQ ID NO: 311644 - DNA, 538 bp, Homo sapiens
  misc_feature: GZ8MTXP02I481L.25.36.D03.1.454.CMB.2.raw
  modified_base (236)..(236): a, c, t, g, unknown or other
  misc_feature (236)..(236): n is a, c, g, or t
tcagactgtacagtcacgaccggtgctcgatttagctgcgtcacgatctctcttggggagcttcagctgtggtagagaagacaggattcaggacaatctccagcatggccggcctccctctcctcctcaccctcctcactcactgtgcagggtcctgggcccagtctgtgctgactcagccaccctcagtgtctcgggacccccgggcagagggtctccatctcttgttctgggancagctccgacgtcggaaatagttgtctactggtaccagcagctcccagaacggcccccaagctcctcatctataggaatgatcagccgcctcacgggatacctgaccgattctctggctcgaagtctggctcctcggccctcccgtggcccatcagtcgggcctccgggtccgaggatggaggtctggaacttattactgtagcaggtttgggatgccagtcgtggagtcgggtccgacgggttggttcgggcggacgggacctaaggccgtcgaccgtccgtaaggccacggcccaacggg

SEQ ID NO: 311645 - DNA, 562 bp, Homo sapiens
  misc_feature: GZ8MTXP02F86K7.25.36.D03.1.454.CMB.2.raw
  modified_base (207)..(207): a, c, t, g, unknown or other
  misc_feature (207)..(207): n is a, c, g, or t
  modified_base (444)..(444): a, c, t, g, unknown or other
  misc_feature (444)..(444): n is a, c, g, or t
  modified_base (455)..(455): a, c, t, g, unknown or other
  misc_feature (455)..(455): n is a, c, g, or t
tcagactgtacagtcacgaccggtgctcgatttagctgcgtcacgatctctcttggggagcttcagctgtggtagagaagacaggattcaggacaatctccagcatggccggcctccctctcctcctcaccctcctcactcactgtgcagggtcctgggcccagtctgtgctgactcagccaccctcagtgtctgggacccccgggnagagggtctccatctcttgttctgggagcagctccgacgtacggaaataagttgtctactggtaccagcagcctcccaagaaaccggcccccaagcctcctcatctataggaatgatcagcggcctgacggactacctgaccgattcctctgggctcgaagttcgtgctccgtcgccctcccgtggcccatccgagtcgggccttcgggccgaggatgaggctagaatattctgtgntaggtttgggntcgctagtcgtggacggtcggtccggtacgggttggtccgggacgggaacggaccgaacggtccgtacggtaccgtaccggtacggtccgaaccggacccgtaacgg

SEQ ID NO: 311646 - DNA, 498 bp, Homo sapiens
  misc_feature: GZ8MTXP02FK9LK.25.36.D03.1.454.CMB.2.raw
  modified_base (323)..(323): a, c, t, g, unknown or other
  misc_feature (323)..(323): n is a, c, g, or t
  modified_base (489)..(489): a, c, t, g, unknown or other
  misc_feature (489)..(489): n is a, c, g, or t
tcagactgtacagtcacgaccggtgctcgatttagctgcgtcacgatctctcttgggggggtctcaggaggcagcgctctcgggacgtctccaccatggcctgggctctgctgttcctcaccctcctcactcagggcacagggtcctgggcccagtctgccctgactcagcctgcctccgtgtctgggactcctggacagtcggtcaccatctcctgcactggaaccagccgtgacattggtgcttataactatgtctcctggtcccaacaacaccaggcaacggcccccaaactcatcatttatgatgtcagtcatcgcctntggattcctgtcgcttctctggctccaagtctgcaactcgcctccctgaccatctcgggctccaggctgagcgagctacttatattgctatttcatacagacacacaacagtctggtcttcggacggaggaccaaagttcgaccgtcgtcgcgacgcccaggtccncgccctcgc

SEQ ID NO: 311647 - DNA, 576 bp, Homo sapiens
  misc_feature: GZ8MTXP02GS8G6.25.36.D03.1.454.CMB.2.raw
  modified_base (340)..(340): a, c, t, g, unknown or other
  misc_feature (340)..(340): n is a, c, g, or t
  modified_base (423)..(423): a, c, t, g, unknown or other
  misc_feature (423)..(423): n is a, c, g, or t
tcagactgtacagtcacgaccggtgctcgatttagctgcgtcacgatctctcttggggacccaaaaaccacacccctccttgggagaatcccctagatcacagctcctcaccatggactggacctggagcatccttttcttggtggcagcagcaacaggtgcccactcccaggttcaactggtgcagtctggacctgaggtgaagaagcctggggcctcagtgaaggtctcctgcaaggcttctggttacacctttagcagctatggcatcagcgtgggtgcgacacggcccctggacaaggggcttaggagtggatggcagtggatcagtccttaaacntcggtatcacagactatgcacaggactccgagggcagagtcacgtgaccacagacacactccaacgagacaactacgcctaanacgtcgggaccctaggaacggaacgccgtagacgaacttcgacgacgaaccgaccgggtccgttaaattacgttaaccgtggtacggaccgtaaggtacggtaaccgtaatttacgtcgtacgtttaaccggtccgggtacgttaacccccgg

SEQ ID NO: 311648 - DNA, 547 bp, Homo sapiens
  misc_feature: GZ8MTXP02G54T6.25.36.D03.1.454.CMB.2.raw
  modified_base (242)..(242): a, c, t, g, unknown or other
  misc_feature (242)..(242): n is a, c, g, or t
  modified_base (302)..(302): a, c, t, g, unknown or other
  misc_feature (302)..(302): n is a, c, g, or t
  modified_base (461)..(461): a, c, t, g, unknown or other
  misc_feature (461)..(461): n is a, c, g, or t
tcagactgtacagtcacgaccggtgctcgatttagctgcgtcacgatctctcttgggggtctcaggaggcagcgctctcgggacgtctccaccatggcctgggctctgctgttcctcaccctcctcactcagggcacagggtcctgggcccagtctgccctgactcagcctgcctccgtgtctgggactcctggacagtcggtcaccatctcctgcactggaacccagccgtgacattggtncttataactatgtctcctggtcccaacaacacccaggcaaggcccccaaatcatcattangatgtcagtcatcggcctctggtatttccgtggtcgcttctctggcttccaagtctcggcaacgtccggcctccctgaccctatccgtcggggcctcccgaggtcctagacgggacgaggcttaacttattatgactatttcatacagacgacaccaanagtctggtacgtcggcggaggtaccgaaagttcgaacccggttcctcggtcacggaccccaaggtccctaccgtcccccgtagtcc

SEQ ID NO: 311649 - DNA, 547 bp, Homo sapiens
  misc_feature: GZ8MTXP02HKK1R.25.36.D03.1.454.CMB.2.raw
  modified_base (304)..(304): a, c, t, g, unknown or other
  misc_feature (304)..(304): n is a, c, g, or t
  modified_base (309)..(309): a, c, t, g, unknown or other
  misc_feature (309)..(309): n is a, c, g, or t
tcagactgtacagtcacgaccggtgctcgatttagctgcgtcacgatctctcttgggagatgggtcctgtcccagatgcacctgcaggagtcgggcccaggactggtgaagccttcggagaccctgtccctcacctgcagtgtctctggtggctccgtcagtgcttattactggagctggatccgcagtccgcgggagggactggagtggattgggcgtatatatacgaatggattaaccacctacaacccctcctacaagagtcgagtcaccatatcagcggacacgtccagggatcgaggtnttccngcatctgacttctgcgactgccgccggacaccggcctatacactgtgccagacgattcggaatgcgagtattttcggagtaattattatctttgtgtcttttgactattggtgggcaaagggacgacggtcaccgtctcttcacgtcctccaccaaacgggcccacgtcggtccttcccccgtggacccaccctccctaccaacgaacgccaaccgttcgcggggccaacgcgcccgg

SEQ ID NO: 311650 - DNA, 655 bp, Homo sapiens
  misc_feature: GZ8MTXP02I8RTY.25.36.D03.1.454.CMB.2.raw
  modified_base (262)..(262): a, c, t, g, unknown or other
  misc_feature (262)..(262): n is a, c, g, or t
  modified_base (300)..(300): a, c, t, g, unknown or other
  misc_feature (300)..(300): n is a, c, g, or t
tcagactgtacagtcacgaccggtgctcgatttagctgcgtcacgatctctcttgggagatgggtcctgtcccagatgcacctgcaggagtcgggcccaggactggtgaagccttcggagaccctgtccctcacctgcagtgtctctggtggctccgtcagtgcttattactggagctggatccgccagtccggccgggagggactgggagtggattgggcgtatatatacgaatggattaaccacctacaacccctcctanaagagtcgagtcaccatatcagcggacacgtccagggntcgaggtctcctgcatctgacttctgcgactgcccgacggaccaccggccctaatacctactgtcgccaggacgtacgttaccgggacttggacgtaacgttagtttttacggaagttaatttattatttctttgttcttcgttttgactagttgggtcggggaccgaaacgggggtaccgtaccggtcctacccggttcttaccgttcaacggtccctacccgaaacccgaacggggtccccctaacggttccccggttacccttcccccgtcggtaccctacccccgttaccctacccgaaacggaaccgccctaacccgttccgggacgggggacccaacgacggccccggg

SEQ ID NO: 311651 - DNA, 517 bp, Homo sapiens
  misc_feature: GZ8MTXP02I44BC.25.36.D03.1.454.CMB.2.raw
  modified_base (341)..(341): a, c, t, g, unknown or other
  misc_feature (341)..(341): n is a, c, g, or t
  modified_base (425)..(425): a, c, t, g, unknown or other
  misc_feature (425)..(425): n is a, c, g, or t
tcagactgtacagtcacgaccggtgctcgatttagctgcgtcacgatctctcttggggagctctgggagaggagcccagcactagaagtcggcggtgtttccattcggtgatcagcactgaacacagaggactcaccatggagtttgggctgagctgggttttcctcgttgctcttttaagaggtgtccactgtcaggtgcacctggtggagtctgggggagcgtggtccagcctgggagtccctgagactctcctgtgaagcctctggatttagttcagtggttctggcatgcactgggtccgccaggctccaggcaaggggccgagtggtggcagttanagcacatgatgggaagttctagaatattatgcagactccgtgaagggcgattcaccatctccagagacaatttcccggaaactnttgtgtacttaggaaatggtcaagcctagacgagtcgaggacctcggctcgtgtacttactgtaagcgagagtcgggaggttggtagtttag

SEQ ID NO: 311652 - DNA, 529 bp, Homo sapiens
  misc_feature: GZ8MTXP02JRR58.25.36.D03.1.454.CMB.2.raw
  modified_base (396)..(396): a, c, t, g, unknown or other
  misc_feature (396)..(396): n is a, c, g, or t
tcagactgtacagtcacgaccggtgctcgatttagctgcgtcacgatctctcttggggacccaaaaaccacacccctccttgggagaatcccctagatcacagctcctcaccatggactggacctggagcatccttttcttggtggcagcagcaacaggtgcccactcccaggttcaactggtgcagtctggacctgaggtgaagaagcctggggcctcagtgaaggtctcctgcaaggcttctggttacacctttagcagctatggcatcagctggtgcgacaggcccctggacaagggcttgagtggatgggcagtggatcgagccttaaaccatcggtatcgacagactatgcacaggattccgagggcagagtcacttgaccacagacacanccacgagcaacagcctacagtcggacctaggaagacgaccgtagacgactcgtagaacgacgaccggaccgttatacttacgtagtcgacgagacgtcgattaagtcgtacgtttacgtccggtacgtacccg

SEQ ID NO: 311653 - DNA, 546 bp, Homo sapiens
  misc_feature: GZ8MTXP02GU8I8.25.36.D03.1.454.CMB.2.raw
  modified_base (211)..(211): a, c, t, g, unknown or other
  misc_feature (211)..(211): n is a, c, g, or t
  modified_base (302)..(302): a, c, t, g, unknown or other
  misc_feature (302)..(302): n is a, c, g, or t
  modified_base (362)..(362): a, c, t, g, unknown or other
  misc_feature (362)..(362): n is a, c, g, or t
tcagactgtacagtcacgaccggtgctcgatttagctgcgtcacgatctctcttggggagcttcagctgtgggtagagaagacaggactcaggacaatctccagcatggccagcttccctctcctcctcaccctcctcactcactgtgcagggtcctgggcccagtctgtgctgtctcagcccaccctcagtgtcgtcggggccccccggnaggagggtcgacatctcttgtctggaagtcgctccaacgtcggcaagtaatagtgtaaagctggtaccagcaactccaggaaccgccccanactctcatgtatgggaatgatcagccgcccctcgacggggtcccctagacccgtattccnctcgccctcacgtcctggcaccctcacgccctcccgtgccatcccgtggcctccaatctagagatgaggctattattagtgtgcagcggtggatagacgaaggaaagtaacggttatgtacgttacggaattcgggaacctaaaggtcaccggtcctaacggcaacggacccgaacggaacccc

SEQ ID NO: 311654 - DNA, 511 bp, Homo sapiens
  misc_feature: GZ8MTXP02GT866.25.36.D03.1.454.CMB.2.raw
  modified_base (245)..(245): a, c, t, g, unknown or other
  misc_feature (245)..(245): n is a, c, g, or t
  modified_base (306)..(306): a, c, t, g, unknown or other
  misc_feature (306)..(306): n is a, c, g, or t
  modified_base (416)..(416): a, c, t, g, unknown or other
  misc_feature (416)..(416): n is a, c, g, or t
  modified_base (437)..(437): a, c, t, g, unknown or other
  misc_feature (437)..(437): n is a, c, g, or t
  modified_base (449)..(449): a, c, t, g, unknown or other
  misc_feature (449)..(449): n is a, c, g, or t
  modified_base (459)..(459): a, c, t, g, unknown or other
  misc_feature (459)..(459): n is a, c, g, or t
tcagactgtacagtcacgaccggtgctcgatttagctgcgtcacgatctctcttgggggggtctcaggaggcagcgctctcgggacgtctccaccatggcctgggctctgctgttcctcaccctcctcactcagggcacagggtcctgggcccagtctgccctgactcagcctgcctccgtgtctgggactcctggacagtcggtcaccatctcctgcactggaacccagccgtgacattgggtncttataactatgtctcctggtcccaacaacacccaggcaaggcccccaaatcatcatttangatgtcagtcatcggcctctggatttctggtcgtcttctctggctccaagtctggcaactcggcctccctgaccactctcggggctccaggctgaggacgaggctacttnttattgctatttcatacaganacacaacagtcnggtcgtcggnggaggaccaagttcgaccgtctcggtcgagcccaagcctcgcccctggtccc

SEQ ID NO: 311655 - DNA, 549 bp, Homo sapiens
  misc_feature: GZ8MTXP02F9WYK.25.36.D03.1.454.CMB.2.raw
  modified_base (282)..(282): a, c, t, g, unknown or other
  misc_feature (282)..(282): n is a, c, g, or t
  modified_base (300)..(300): a, c, t, g, unknown or other
  misc_feature (300)..(300): n is a, c, g, or t
  modified_base (307)..(307): a, c, t, g, unknown or other
  misc_feature (307)..(307): n is a, c, g, or t
  modified_base (357)..(357): a, c, t, g, unknown or other
  misc_feature (357)..(357): n is a, c, g, or t
  modified_base (390)..(390): a, c, t, g, unknown or other
  misc_feature (390)..(390): n is a, c, g, or t
  modified_base (396)..(396): a, c, t, g, unknown or other
  misc_feature (396)..(396): n is a, c, g, or t
tcagactgtacagtcacgaccggtgctcgatttagctgcgtcacgatctctcttggggtgtgggctcagaagcagagttctggggtgtctccaccatggcctggacccctctctggctcactctcctcactctttgcataggttctgtggtttcttctgaactgactcaggaccccgctgtgtctgtgtccttgggacagacagtcaggatcacatgccaaggagacagcctcagaacttattatgcatcctggtaccagcagaagccgggacaggcccctntacttgtcttctacggtnaaaaccnccccgcccctcagggatctcagaccgattcctctggctccgctcaggacncagcttcctgaccatcacgtggggctcgaggcncaaagntgaggctagactattactgttcccgtccgggacaccgagtacggtaagcgtaggttgtggtcgttcgggacggacgggaccaaagggtcgacccgttccgtacggtaccacgacccgaaggcctccggccccctcggtccaccgtcttccccg

SEQ ID NO: 311656 - DNA, 572 bp, Homo sapiens
  misc_feature: GZ8MTXP02HDNCC.25.36.D03.1.454.CMB.2.raw
  modified_base (207)..(207): a, c, t, g, unknown or other
  misc_feature (207)..(207): n is a, c, g, or t
  modified_base (235)..(235): a, c, t, g, unknown or other
  misc_feature (235)..(235): n is a, c, g, or t
  modified_base (302)..(302): a, c, t, g, unknown or other
  misc_feature (302)..(302): n is a, c, g, or t
  modified_base (329)..(329): a, c, t, g, unknown or other
  misc_feature (329)..(329): n is a, c, g, or t
tcagactgtacagtcacgaccggtgctcgatttagctgcgtcacgatctctcttggggagcttcagctgtggtagagaagacaggattcaggacaatctccagcatggccggcctccctctcctcctcaccctcctcactcactgtgcagggtcctgggcccagtctgtgctgactcagccaccctcagtgtctgggacccccgggnagagggtctccatctcttgttctgggancagctccgacgtcggaaataagttgtctactggtaccagcagctccagaaaccggccccaagctccncatctataggaatgatcagcggccctnacgggataccgtgaccgattctctgggcttcgaagtctggctccgtcggccctcccgtggccatcgagtgggcctccgggtccgaggatggaggctagaattattacgtgtagcgtagtttggggattcggcctaaggtgtcggtaggtcgggtacccggtcgggttcggttcgggcggggaacggggacccgaaaggtccgtacgggaacccgttccgtaaggtccgacggacccgaacggg

SEQ ID NO: 311657 - DNA, 534 bp, Homo sapiens
  misc_feature: GZ8MTXP02IOC35.25.36.D03.1.454.CMB.2.raw
  modified_base (249)..(249): a, c, t, g, unknown or other
  misc_feature (249)..(249): n is a, c, g, or t
  modified_base (304)..(304): a, c, t, g, unknown or other
  misc_feature (304)..(304): n is a, c, g, or t
  modified_base (412)..(412): a, c, t, g, unknown or other
  misc_feature (412)..(412): n is a, c, g, or t
tcagactgtacagtcacgaccggtgctcgatttagctgcgtcacgatctctcttggggagctctgagagcggagcccagccccagaattcccaggtgttttcatttggtgatcagcactgaacacagaggactcaccatggagtttgggctgagctgggtttccttgttgttatttttccaggtgtccagagtgaggtgcagttggtggagtctgggggagcttggtccagcctggagggtccgtgagngtctcctgtgcagcctctggattcatcttcagtgaccatacatggactgggtccnccaggctccgaggggacggggctggagtgggttggcccgtattagaaataaagctaagagttacacacagaatacgcgcgtctgtgaaaggcagatttcattatctanaaagagatagaattacaaaagtactacaactagtatctagaccaaaatgaaacagaccctagaaaaccgaggacgtaacggccgtagtattacgtgtgctaggtcaggactacggtataacc

SEQ ID NO: 311658 - DNA, 713 bp, Homo sapiens
  misc_feature: GZ8MTXP02GXT4A.25.36.D03.1.454.CMB.2.raw
  modified_base (208)..(208): a, c, t, g, unknown or other
  misc_feature (208)..(208): n is a, c, g, or t
  modified_base (212)..(212): a, c, t, g, unknown or other
  misc_feature (212)..(212): n is a, c, g, or t
  modified_base (236)..(236): a, c, t, g, unknown or other
  misc_feature (236)..(236): n is a, c, g, or t
tcagactgtacagtcacgaccggtgctcgatttagctgcgtcacgatctctcttggggagcttcagctgtggtagagaagacaggattcaggacaatctccagcatggccggcctccctctcctcctcaccctcctcactcactgtgcagggtcctgggcccagtctgtgctgactcagccaccctcagtgtctcgggacccccgggnaggnggtctccatctcttgtcgtggacncagcctccggacgtacggtaaattagttgtactacgtggtaccagcacgcctacccgaacggaaaccccggccccaagtccctcctactactactaagtaaggaatgactcgacggtccggtccctagaacgggtacctaccgtacgaccgtcttccgtcgtcgggtcctacggtaacgttccgtcggtccttcccgtacccgggtccccttcccgtacggtaccctacgttcccgtacggggttccggggtcccgttacccggggtaccgggaagggtacgtacgggacggtcttaaggtaactttacgtttacgtgggtacgtacgttagggtttgggactcggacgtacggttcgtaggggtacggttccggggtaccggtacggggttcgggtacggggacggggtacgggtaaccgtacggtccggtaccggtaccgttaccggtacggtaccgaccggtacccggtaacgg

SEQ ID NO: 311659 - DNA, 518 bp, Homo sapiens
  misc_feature: GZ8MTXP02JHPK9.25.36.D03.1.454.CMB.2.raw
  modified_base (304)..(304): a, c, t, g, unknown or other
  misc_feature (304)..(304): n is a, c, g, or t
  modified_base (447)..(447): a, c, t, g, unknown or other
  misc_feature (447)..(447): n is a, c, g, or t
tcagactgtacagtcacgaccggtgctcgatttagctgcgtcacgatctctcttgggagcttcagctgtggtagagaagacaggattcaggacaatctccagcatggccgcctccctctcctcctcaccctcctcactcactgtgcagggtcctgggcccagtctgtgctgactcagccaccctcagcgtctgggacccccgggcagacggtcaccctctcttgttctggaagcagctccaatatcggaactaacactgtgaactggtaccagcaggtccccaggaatcggcccccaaacttcncatttatagtagttatcagcaccctcaggggtcctgaccgattctctgctccagtctggcacctcagcctccctgccatcagtcgggtccagtctgaggatgaggctgtacctttattacgtgcgcagcgagtgggatgacgngacctgaatggtgtgggttttcggcggagggtacgaaggcgtacggaccgtccgtaggtcacgcccaacgg

SEQ ID NO: 311660 - DNA, 653 bp, Homo sapiens
  misc_feature: GZ8MTXP02GKYWB.25.36.D03.1.454.CMB.2.raw
  modified_base (382)..(382): a, c, t, g, unknown or other
  misc_feature (382)..(382): n is a, c, g, or t
tcagactgtacagtcacgaccggtgctcgatttagctgcgtcacgatctctcttggggagcttcagctgtgggtagagaagacaggactcaggacaatctccagcatggccagcttccctctcctcctcaccctcctcactcactgtgcagggtcctgggcccagtctgtgctgtctcagcccaccctcagtgtcgtcggggccccccggcaggagggtcgacatcttcgttgttctggaagtcgctccaacggtcggacagtaatagtgtaagcgtaggtaccagaccaacctcccgaagggaacccgccccccaacacctcctcatgtaagtagggaatgactcgagccgcccctcgacggggtcccagaccgtattccnctcgccctcctacgtctcgccaccttcaccgtccctcccgtcgccacgttcccggtcggccctaccaacttcgaggacggtaatcggaacggtacccgtaatttatttagtggtacgacgtaggtcggttagggacgtaggaacggaaaggtaaacggtaacggtttagtcggttaaccgttacggggttaacgttaccggggaaccgttaaacggtccgtaacccgttaccggtaacggtaccgaaccggaccccgaaccggaacccccg

SEQ ID NO: 311661 - DNA, 614 bp, Homo sapiens
  misc_feature: GZ8MTXP02FSBHH.25.36.D03.1.454.CMB.2.raw
  modified_base (211)..(211): a, c, t, g, unknown or other
  misc_feature (211)..(211): n is a, c, g, or t
  modified_base (240)..(240): a, c, t, g, unknown or other
  misc_feature (240)..(240): n is a, c, g, or t
tcagactgtacagtcacgaccggtgctcgatttagctgcgtcacgatctctcttggggagcttcagctgtggtagagaagacaggattcaggacaatctccagcatggccggcctccctctcctcctcaccctcctcactcactgtgcagggtcctgggcccagtctgtgctgactcagcccaccctcagtgtcgtcggggacccccgggnaggagggtctccatctcttgttcgtggancagcctccgacgtacggaaattagttgtctactggtaccagcagcctacccaagaacccggcccccaagcctcctcatctagtaggaatgatcgagccgccctgacgggtactaccgtgaccgtattctcgtgactcgaagtcgtggcctccgtccgccctcccgtggccctagtcgaggtcgggccttaccgggtacgaggagtggaggtctaaggtaattagttacgtggtacgtacgttagggtttgggattcggccgtagttcgtagggtacggttcgggtccggtacggggttcggtaccgggacggggaacgggacccaaggtccgtacggtaacccggttccgtaggtccaccggaccccgtaacgg

SEQ ID NO: 311662 - DNA, 518 bp, Homo sapiens
  misc_feature: GZ8MTXP02JQBT0.25.36.D03.1.454.CMB.2.raw
  modified_base (243)..(243): a, c, t, g, unknown or other
  misc_feature (243)..(243): n is a, c, g, or t
  modified_base (325)..(325): a, c, t, g, unknown or other
  misc_feature (325)..(325): n is a, c, g, or t
  modified_base (456)..(456): a, c, t, g, unknown or other
  misc_feature (456)..(456): n is a, c, g, or t
tcagactgtacagtcacgaccggtgctcgatttagctgcgtcacgatctctcttgggggggtctcaggaggcagcgctctcgggacgtctccaccatggcctgggctctgctgttcctcaccctctcactcagggcacagggtcctgggcccagtctgccctgactcagcctgcctccgtgtctgggactcctggacagtcggtcaccatctcctgcactggaaccagccgtgacattgggtncttataactatgtctcctggtcccaacaacacccaggcaacggcccccaaatcatcatttatgatgtcagtcatccggcctntggtatttcctggtcgtcttctctggctccaagtctcggcaacgtcggcctccctgaccctatccgtcggggctccgaggctgaggcgaggcttacttgttattgactattcatacagagacacacagtcnggtcgtcggcggtaggaccaggttcgaccgtcgacgtcacgccacggctccgcccctggtcc

SEQ ID NO: 311663 - DNA, 704 bp, Homo sapiens
  misc_feature: GZ8MTXP02GIAU6.25.36.D03.1.454.CMB.2.raw
  modified_base (209)..(209): a, c, t, g, unknown or other
  misc_feature (209)..(209): n is a, c, g, or t
  modified_base (232)..(232): a, c, t, g, unknown or other
  misc_feature (232)..(232): n is a, c, g, or t
  modified_base (235)..(235): a, c, t, g, unknown or other
  misc_feature (235)..(235): n is a, c, g, or t
tcagactgtacagtcacgaccggtgctcgatttagctgcgtcacgatctctcttggggagcttcagctgtggtagagaagacaggattcaggacaatctccagcatggccggcctccctctcctcctcacccctcctcactcactgtgcagggtcctgggcccagtctgtgctgactcagccaccctcagtgtctgggaccccccgggnaggcggtctcatctcttgttcgnggncagctccgacgtagtaaattagttgtctacgtcggtaccagcacgcctacccgaacggaaaccccggcccccaagtccctaccctacactactaagtaaggaatgactcgacggcccggacccctaggaaccggtactacccgtacgtaccgtacttccgtcgtcggtcctacggtaacgttccgtcggtcccttcccgtcccggtccctcccgtacggcctacgtcggtacgggtcgggcccgttacccgggtacgaggtacgtcgggacggtctagtaacttacgttacgttggtcgtacgttagggtttagggacttcggccgtaggttcgtaggtacgggtccggggttacccggtacggggtttcggggtaccgggggaccggggtaaccgggaaccgtaacggtccgttaccgggtaaccccggttacggtaccgggtaccgaacccgggtacccggtaacgg

SEQ ID NO: 311664 - DNA, 553 bp, Homo sapiens
  misc_feature: GZ8MTXP02F8COI.25.36.D03.1.454.CMB.2.raw
  modified_base (207)..(207): a, c, t, g, unknown or other
  misc_feature (207)..(207): n is a, c, g, or t
  modified_base (338)..(338): a, c, t, g, unknown or other
  misc_feature (338)..(338): n is a, c, g, or t
tcagactgtacagtcacgaccggtgctcgatttagctgcgtcacgatctctcttggggagcttcagctgtggtagagaagacaggattcaggacaatctccagcatggccggcctccctctcctcctcaccctcctcactcactgtgcagggtcctgggcccagtctgtgctgactcagccaccctcagtgtctcgggacccccggnagagggtctccatctcttgttctgggagcagctccgacgtcggaaatagttgtctactggtaccagcagctcccagaaccgccccaagctcctcatctataggaatgatcagcgccctgacggactaccgngaccgattctctggctcggaagtctgggcctccgtccggccctcccgtcggcccagtcgagtcgggcctccgggtcgaggactggaggctagaattagttactgtgcgtaggtttcgggatcggcctagtctggacggttcggtccggtacggttgtcgggcggtaacgggaccaaggccgtcggacccgtccgtaggtccacggacccgaacgg

SEQ ID NO: 311665 - DNA, 547 bp, Homo sapiens
  misc_feature: GZ8MTXP02JM09D.25.36.D03.1.454.CMB.2.raw
  modified_base (263)..(263): a, c, t, g, unknown or other
  misc_feature (263)..(263): n is a, c, g, or t
  modified_base (320)..(320): a, c, t, g, unknown or other
  misc_feature (320)..(320): n is a, c, g, or t
tcagactgtacagtcacgaccggtgctcgatttagctgcgtcacgatctctcttgggagatgggtcctgtcccagatgcacctgcaggagtcgggcccaggactggtgaagccttcggagaccctgtccctcacctgcagtgtctctggtggctccgtcagtgcttattactggagctggatccgccagtccgccgggagggactggagtggattgggcgtatatatacgaatggattaaccacctacaacccctcctcaagngtcgagtcaccatatcagcgacacgtccagggatcaggtgtcctgcatctgacttcngcgactgccgcggacacggccctatactactgtgccagagattcgggactgcgacgtattttcggagtaattattatctttgtgtcttttgactatggtgggaccaaggggacgacggtcaccgtctcttcacgcctccaccgaacgggcccacgtccggtccttcccccgtggccctaccccgtcctaccaacgcgccacccgttcgcggggccacgacggcccgg

SEQ ID NO: 311666 - DNA, 536 bp, Homo sapiens
  misc_feature: GZ8MTXP02JBSVK.25.36.D03.1.454.CMB.2.raw
  modified_base (271)..(271): a, c, t, g, unknown or other
  misc_feature (271)..(271): n is a, c, g, or t
  modified_base (294)..(294): a, c, t, g, unknown or other
  misc_feature (294)..(294): n is a, c, g, or t
  modified_base (314)..(314): a, c, t, g, unknown or other
  misc_feature (314)..(314): n is a, c, g, or t
  modified_base (355)..(355): a, c, t, g, unknown or other
  misc_feature (355)..(355): n is a, c, g, or t
  modified_base (362)..(362): a, c, t, g, unknown or other
  misc_feature (362)..(362): n is a, c, g, or t
  modified_base (380)..(380): a, c, t, g, unknown or other
  misc_feature (380)..(380): n is a, c, g, or t
  modified_base (384)..(384): a, c, t, g, unknown or other
  misc_feature (384)..(384): n is a, c, g, or t
tcagactgtacagtcacgaccggtgctcgatttagctgcgtcacgatctctcttggggagctctgggagaggagcccagcactagaagtcggcggtgtttccattcggtgatcagcactgaacacagaggactcaccatggagtttgggctgagctgggttttcctcgttgctcttttaagaggtgtccactgtcaggtgcacctgggtggagtcgtgggggaggcgtggtccagcctgggacggtccctgagactctcctgtgaagcctntggtatttagtttcagtggttcnggcatgcacgtggggtcccnccaggctccgagggcaagggggccggagtggtggcaggttntagcacntgatgggaattcagaatnttangacagctccgtgaagggccgattcacccatcctccagacgactaaacgttcccggaactattcgtgttaacttaggaaatggtacagcctagagagtcgaggctcggctcgtgtacttcgtgtgcgtagagtgggaggttggtagtttaagg

SEQ ID NO: 311667 - DNA, 586 bp, Homo sapiens
  misc_feature: GZ8MTXP02F3AM9.25.36.D03.1.454.CMB.2.raw
  modified_base (256)..(256): a, c, t, g, unknown or other
  misc_feature (256)..(256): n is a, c, g, or t
  modified_base (260)..(260): a, c, t, g, unknown or other
  misc_feature (260)..(260): n is a, c, g, or t
  modified_base (307)..(307): a, c, t, g, unknown or other
  misc_feature (307)..(307): n is a, c, g, or t
tcagactgtacagtcacgaccggtgctcgatttagctgcgtcacgatctctcttgggagatgggtcctgtcccagatgcacctgcaggagtcgggcccaggactggtgaagccttcggagaccctgtccctcacctgcagtgtctctggtggctccgtcagtgcttattactggagctggatccgccagtccgccgggagggactggagtggattgggctatatatacgaatggattaaccactacaacccctccnaagngtcgagtcaccatatcagcggacacgtccagggatcgaggtgttccngcatctgacttctgcgactgccgcggacaccggcctaatactactgtgccagagacttcgggactggcgtacgtagttttacggaagtaattaattattctttgtgtcttttgactagtggtggggaccgaagggacgacggtacgaccgtctcttcacgtcctaccaaccgacgggaccctacgtccggtcccttcccccgtcggaccctaaccccgtccctacccgaaaacggtccgaccaacccgtcggtcgggggaccaaccgacggccccgggg

SEQ ID NO: 311668 - DNA, 576 bp, Homo sapiens
  misc_feature: GZ8MTXP02HCW4C.25.36.D03.1.454.CMB.2.raw
  modified_base (243)..(243): a, c, t, g, unknown or other
  misc_feature (243)..(243): n is a, c, g, or t
  modified_base (308)..(308): a, c, t, g, unknown or other
  misc_feature (308)..(308): n is a, c, g, or t
  modified_base (486)..(486): a, c, t, g, unknown or other
  misc_feature (486)..(486): n is a, c, g, or t
tcagactgtacagtcacgaccggtgctcgatttagctgcgtcacgatctctcttgggggggtctcaggaggcagcgctctcgggacgtctccaccatggcctgggctctgctgttcctcaccctcctcactcagggcacagggtcctgggcccagtctgccctgactcagcctgcctccgtgtctgggactcctggacagtcggtcaccatctcctgcactggaaccagccgtgacattggtncttataactatgtctcctggtcccaacaacacccaggacaacggacccccaaactcatcatttangatgtcagtcatccggcctctggtagtttcctggtcgtcttctctgctcgagtctggcactcggcctaccctgaccactcgtcgggctccgagccgtgacggtacgaggcttaacttattactgtctatttcaagttacgagacaccacaacgtacgtacgtgggtacgttaccgggngggtaacggaaccgtaaggtttcgaacccgtccgttacgggtaacctacggaccccgaaacggcctaccggtcccccgttcggttacccc

SEQ ID NO: 311669 - DNA, 533 bp, Homo sapiens
  misc_feature: GZ8MTXP02FJX9S.25.36.D03.1.454.CMB.2.raw
tcagactgtacagtcacgaccggtgctcgatttagctgcgtcacgatctctcttgggagatgggtcctgtcccagatgcacctgcaggagtcgggcccaggactggtgaagccttcggagaccctgtccctcacctgcagtgtctctggtggctccgtcagtgcttattactggagctggatccgccagtccgccgggagggactggagtggattgggcgtatatatacgaatggattaaccacctacaacccctctcaagatcgagtcaccatatcagcggacacgtccagggatcaggtgttcctgcatctgacttctgcatgccgcggacacggccctatactactgtgccagagattcgggactgacgacgtattttcggagtaattattatcttgtgtctttgactatagtgggaccaagggtacgacggttacaccgtctcttcagcctaccaccaacggcccacgtcggtccttcccctggccacccgtcctaccaacgcgcacctcgtcggggcacgacgcccgg

SEQ ID NO: 311670 - DNA, 677 bp, Homo sapiens
  misc_feature: GZ8MTXP02HCM4E.25.36.D03.1.454.CMB.2.raw
  modified_base (302)..(302): a, c, t, g, unknown or other
  misc_feature (302)..(302): n is a, c, g, or t
tcagactgtacagtcacgaccggtgctcgatttagctgcgtcacgatctctcttgggggggtctcaggaggcagcgctctcgggacgtctccaccatggcctgggctctgctgttcctcaccctcctcactcagggcacagggtcctgggcccagtctgccctgactcagcctgcctccgtgtctgggactcctggacagtcggtcaccatctcctgcactggaaccagccgtgacattggtgacttataactatgtctcctgtcccaacaacacccagcaacgccccaaatcatcatttangatgtcagtcatccggcctgtggtacgtttccgtggtccgtcttctcgttggcttccgaagttctcggacctaaccgtccggacccttcccgtgaccctagttccgtccggggccttccgaggtcctagggaacggtaccgaggtacctttaacgtttacgtttaacttcggttactacttttacgaaactttaaaccgaaggttaaaccgaaaccctaaaccgtaaaccgtaaacggttccgttaggggtttcggtttacccgggggtacggggaaacgggtaaccgtaaacggtttccggaacccgttcccgtaccggttaaccgacgtaccccgaaacggtcccgtacccgtacccccgttacggttccccg

SEQ ID NO: 311671 - DNA, 603 bp, Homo sapiens
  misc_feature: GZ8MTXP02G8GD1.25.36.D03.1.454.CMB.2.raw
  modified_base (357)..(357): a, c, t, g, unknown or other
  misc_feature (357)..(357): n is a, c, g, or t
  modified_base (388)..(388): a, c, t, g, unknown or other
  misc_feature (388)..(388): n is a, c, g, or t
  modified_base (409)..(409): a, c, t, g, unknown or other
  misc_feature (409)..(409): n is a, c, g, or t
  modified_base (415)..(415): a, c, t, g, unknown or other
  misc_feature (415)..(415): n is a, c, g, or t
tcagactgtacagtcacgaccggtgctcgatttagctgcgtcacgatctctcttgggggggtctcaggaggcagcgctctcgggacgtctccaccatggcctgggctctgctgttcctcaccctcctcactcagggcacagggtcctgggcccagtctgccctgactcagcctgcctccgtgtctgggactcctggacagtcggtcaccatctcctgcactggaaccagccgtgactagttggtgacttataactatcgtctcctggtacccaacaaccacccaggaccaacggccccccaaaatccaatcctaatttatgatgtacagtcatcccggcccttgtggtacgtttccncgggttcctcttctctggcctccgaagttcnggactaccgtcggccctcccncgaccngtcgcgggctccgaggcctggacggacgacgtacttaacgttattattcgtactattttacaattaccgaagacgaaccaacaacgtagtcgtgggttacggttcgggacgggacgggtaaccgtaacggttcgacccggttcgtccggtcgacgtacccgaacggtcctaccgtcccccgtggtccc

SEQ ID NO: 311672 - DNA, 545 bp, Homo sapiens
  misc_feature: GZ8MTXP02H6LPT.25.36.D03.1.454.CMB.2.raw
  modified_base (319)..(319): a, c, t, g, unknown or other
  misc_feature (319)..(319): n is a, c, g, or t
  modified_base (359)..(359): a, c, t, g, unknown or other
  misc_feature (359)..(359): n is a, c, g, or t
  modified_base (393)..(393): a, c, t, g, unknown or other
  misc_feature (393)..(393): n is a, c, g, or t
  modified_base (422)..(422): a, c, t, g, unknown or other
  misc_feature (422)..(422): n is a, c, g, or t
  modified_base (448)..(448): a, c, t, g, unknown or other
  misc_feature (448)..(448): n is a, c, g, or t
tcagactgtacagtcacgaccggtgctcgatttagctgcgtcacgatctctcttggggggggtctcaggaggcagcgctctcgggacgtctccaccatggcctgggctctgctgttcctcaccctcctcactcagggcacagggtcctgggcccagtctgccctgactcaacctgcctccgtgtctgggtctcctggacgtcaatcaccatttcctgcactggaaccagcactgatgttggctacttgaccttgtctctggtaccaacaacacccggacaaaggctccaaactcataattttgagcagtaagcggcctntggggttctagtcgattcactggcctcaagtctggcaacncggcctaccctaacaactctctgggctccgagcngaagacgaggcttgtttattctgctgttncttatgtggtctagaaaactagttgngcgtggcggtagggacctaagttcgaccgtcttaaagtcacgtacccgaacggccttcgccccctggtccacgttcctcgttccccacccttcctcc

SEQ ID NO: 311673 - DNA, 543 bp, Homo sapiens
  misc_feature: GZ8MTXP02F3AYP.25.36.D03.1.454.CMB.2.raw
  modified_base (314)..(314): a, c, t, g, unknown or other
  misc_feature (314)..(314): n is a, c, g, or t
  modified_base (357)..(357): a, c, t, g, unknown or other
  misc_feature (357)..(357): n is a, c, g, or t
  modified_base (380)..(380): a, c, t, g, unknown or other
  misc_feature (380)..(380): n is a, c, g, or t
  modified_base (385)..(385): a, c, t, g, unknown or other
  misc_feature (385)..(385): n is a, c, g, or t
tcagactgtacagtcacgaccggtgctcgatttagctgcgtcacgatctctcttggggagctctgggagaggagcccagcactagaagtcggcggtgtttccattcggtgatcagcactgaacacagaggactcaccatggagtttgggctgagctgggttttcctcgttgctcttttaagaggtgtccactgtcaggtgcacctggtggagtcgtgggggaggcgtggtccagccgtgggacgtccctgagactctcctgtgaagcctctggtatttagtttcagttggttctggcatgcacgtggggtcccnccaggcctccgagggcaaagggggccgagtggttggcagttanagcacatgatggaattcagaatnttacngcagtactccgtgaacggccgattcacctatctaccagagactaaacttccccggaatattgtagttacgttaggaaatggtacaagtccgtagagagtcgaaggtctcggctcgttgtaattcgtgtgcgagtagtcgggaggtggtagtttaacgg

SEQ ID NO: 311674 - DNA, 506 bp, Homo sapiens
  misc_feature: GZ8MTXP02HX3A8.25.36.D03.1.454.CMB.2.raw
  modified_base (228)..(228): a, c, t, g, unknown or other
  misc_feature (228)..(228): n is a, c, g, or t
  modified_base (245)..(245): a, c, t, g, unknown or other
  misc_feature (245)..(245): n is a, c, g, or t
  modified_base (307)..(307): a, c, t, g, unknown or other
  misc_feature (307)..(307): n is a, c, g, or t
  modified_base (326)..(326): a, c, t, g, unknown or other
  misc_feature (326)..(326): n is a, c, g, or t
  modified_base (342)..(342): a, c, t, g, unknown or other
  misc_feature (342)..(342): n is a, c, g, or t
  modified_base (379)..(379): a, c, t, g, unknown or other
  misc_feature (379)..(379): n is a, c, g, or t
  modified_base (382)..(382): a, c, t, g, unknown or other
  misc_feature (382)..(382): n is a, c, g, or t
  modified_base (435)..(435): a, c, t, g, unknown or other
  misc_feature (435)..(435): n is a, c, g, or t
  modified_base (473)..(473): a, c, t, g, unknown or other
  misc_feature (473)..(473): n is a, c, g, or t
tcagactgtacagtcacgaccggtgctcgatttagctgcgtcacgatctctcttggggggggtctcaggaggcagcgctctcgggacgtctccaccatggcctgggctctgctgttcctcaccctcctcactcagggcacagggtcctgggcccagtctgccctgactcagcctgcctccgtgtctgggactcctggacagtcgtcaccatctcctgcactggaaccngccgtgactattgggtncttataactatgtctcctggtcccaacaacacccaggcaacggcccccaaatcatcatttangatgtcagtcatcggcctntggagtttcctggtcncttctctgctccagtctggcactcggctccctgaccntcncgggctcgagctgagcgagctattatattgactatttcatacagagacacaanagtctaggtgtcggaggacggactaaagtcgaccgtcncggtcgacgcccgagcctccggcccctcggtcc

SEQ ID NO: 311675 - DNA, 513 bp, Homo sapiens
  misc_feature: GZ8MTXP02G2IN0.25.36.D03.1.454.CMB.2.raw
  modified_base (243)..(243): a, c, t, g, unknown or other
  misc_feature (243)..(243): n is a, c, g, or t
  modified_base (396)..(396): a, c, t, g, unknown or other
  misc_feature (396)..(396): n is a, c, g, or t
  modified_base (442)..(442): a, c, t, g, unknown or other
  misc_feature (442)..(442): n is a, c, g, or t
tcagactgtacagtcacgaccggtgctcgatttagctgcgtcacgatctctcttgggggggtctcaggaggcagcgctctcgggacgtctccaccatggcctgggctctgctgttcctcaccctcctcactcagggcacagggtcctgggcccagtctgccctgactcagcctgcctccgtgtctgggactcctggacagtcggtcaccatctcctgcactggaacccagccgtgacattggncttataactatgtctcctggtcccaacaacacccaggcaaacggcccccaaactcatcatttatgatgtcagtcatcggccctctggatttcctggtcgcttctctggctcaagtctgcaactcggcctccctgaccatctcggggctaccgngctgagacgagtcttattattatgtatattcatacagacacaacanagtcgtggtcgtcggacggacgtacgacgttcgaccgtcgtcgtcgacgaccgacgcctccgcccctcgtc

SEQ ID NO: 311676 - DNA, 520 bp, Homo sapiens
  misc_feature: GZ8MTXP02IQ5W6.25.36.D03.1.454.CMB.2.raw
  modified_base (181)..(181): a, c, t, g, unknown or other
  misc_feature (181)..(181): n is a, c, g, or t
  modified_base (300)..(300): a, c, t, g, unknown or other
  misc_feature (300)..(300): n is a, c, g, or t
  modified_base (338)..(338): a, c, t, g, unknown or other
  misc_feature (338)..(338): n is a, c, g, or t
  modified_base (342)..(342): a, c, t, g, unknown or other
  misc_feature (342)..(342): n is a, c, g, or t
  modified_base (356)..(356): a, c, t, g, unknown or other
  misc_feature (356)..(356): n is a, c, g, or t
  modified_base (362)..(362): a, c, t, g, unknown or other
  misc_feature (362)..(362): n is a, c, g, or t
  modified_base (366)..(366): a, c, t, g, unknown or other
  misc_feature (366)..(366): n is a, c, g, or t
tcagactgtacagtcacgaccggtgctcgatttagctgcgtcacgatctctcttggggagctctgggagaggagcccagcactagaagtcggcggtgtttccattcggtgatcagcactgaacacagaggactcaccatggagtttgggctgagctgggtttcctcgttgctcttttaagnggtgtccactgtcaggtgcacctggtggagtctgggggagcgtggtccagcctgggagtccctgagctctcctgtgagctctggatttagttcagtggttctggcatgcactgggtccncaggctccgagggcaaggggccgagtggtggcagttangcanatgatgggaattcngaattnttangcagactccgtgaacggggccattcacctatctaccagagacaacttaccccggaatagttgtgtactggaaatggtcagctagagagtcggagtactcgggtctcgtgtaacttctggtgcgaggtcggtcggggaggttgggtaagtttagg

SEQ ID NO: 311677 - DNA, 619 bp, Homo sapiens
  misc_feature: GZ8MTXP02GYSZM.25.36.D03.1.454.CMB.2.raw
  modified_base (208)..(208): a, c, t, g, unknown or other
  misc_feature (208)..(208): n is a, c, g, or t
  modified_base (237)..(237): a, c, t, g, unknown or other
  misc_feature (237)..(237): n is a, c, g, or t
tcagactgtacagtcacgaccggtgctcgatttagctgcgtcacgatctctcttggggagcttcagctgtggtagagaagacaggattcaggacaatctccagcatggccggcctccctctcctcctcaccctcctcactcactgtgcagggtcctgggcccagtctgtgctgactcagccaccctcagtgtctcgggacccccgggnaggagggtctccatctcttgttctgggancagctccgacgtacggaaattagttgtctactggtaccagcagctcccaagaaaccggcccccaagcctcctcatctaataggaatgatcgagccgccctgacgggactacctgaccgtattcctcgtggcctacgaagtccgtggcctccgtccggtccctcccgtggcccagtcgaggttcgggcctccgggtacgaggactggaaggtcttaggaaattagttacgtggtcgacgttagggtttcggggattcgaccgtagttcgtagggtacggttcgggtaccggtacgggttcgggttccggggacggggaacgggaccgtaaggtccgtacgggtaacccggttcgtaacgggtccaaccggtacccgtaaccgg

SEQ ID NO: 311678 - DNA, 555 bp, Homo sapiens
  misc_feature: GZ8MTXP02FU7N9.25.36.D03.1.454.CMB.2.raw
  modified_base (166)..(166): a, c, t, g, unknown or other
  misc_feature (166)..(166): n is a, c, g, or t
  modified_base (305)..(305): a, c, t, g, unknown or other
  misc_feature (305)..(305): n is a, c, g, or t
  modified_base (376)..(376): a, c, t, g, unknown or other
  misc_feature (376)..(376): n is a, c, g, or t
tcagactgtacagtcacgaccggtgctcgatttagctgcgtcacgatctctcttggggagctctgggagaggagcccagcactagaagtcggcggtgtttccattcggtgatcagcactgaacacagaggactcaccatggagtttgggctgagctgggttttccncgttgctcttttaagaggtgtccactgtcaggtgcacctggtggagtctgggggagcgtggtccagcctgggagtccctgagactctcctgtgaagcctctggatttagttcagtggttctggcatgcacgtgggtccnccaggctccgaggcgaaggggccggagtggttggcagttatagcacatgatggaagttctagaatattagngacagtacgtcgtagacggcctatcactatcacagacgactacgtaccgaatagttgtagtacgtagaagtggtacagtccgtagagtacggtacggacggcgtcggtcttacgtagttaacttacgtggtcggacggtaggtacggtacgggggtaggttaggttaacggtttaacgg

SEQ ID NO: 311679 - DNA, 609 bp, Homo sapiens
  misc_feature: GZ8MTXP02H6IIY.25.36.D03.1.454.CMB.2.raw
  modified_base (206)..(206): a, c, t, g, unknown or other
  misc_feature (206)..(206): n is a, c, g, or t
  modified_base (296)..(296): a, c, t, g, unknown or other
  misc_feature (296)..(296): n is a, c, g, or t
  modified_base (328)..(328): a, c, t, g, unknown or other
  misc_feature (328)..(328): n is a, c, g, or t
tcagactgtacagtcacgaccggtgctcgatttagctgcgtcacgatctctcttggggagcttcagctgtggtagagaagacaggattcaggacaatctccagcatggccggcctccctctcctcctcaccctcctcactcactgtgcagggtcctggacccagtctgtgctgactcagccaccctcagtgtctcgggaccccggnagagggtctccatctcttgtctgggagcagctccgacgtacggaaatagttgtctactggtacagcagctccagaaccgccccaagctcncatctatagatgatcagcgactaaggctaccncgacgacttctcgtgctcgagtccgtgccttcccgtcggtccctcccgtcggccctacgtcgaggtcgggtccgtcccgggtccggaggagtggaacggtccgtaggtaaacttacgtttagtggtgtacgtaggtttggggattcgggacctaggtctggtacggttcgggtccggtacgggttcggttaccggggacggggtacgggaacccgttaaggccgtaacgggtacccgttaccggttacggtccgaacccggacccgtaaacgggtcccccg

SEQ ID NO: 311680 - DNA, 708 bp, Homo sapiens
  misc_feature: GZ8MTXP02HZMK7.25.36.D03.1.454.CMB.2.raw
  modified_base (212)..(212): a, c, t, g, unknown or other
  misc_feature (212)..(212): n is a, c, g, or t
  modified_base (224)..(224): a, c, t, g, unknown or other
  misc_feature (224)..(224): n is a, c, g, or t
  modified_base (242)..(242): a, c, t, g, unknown or other
  misc_feature (242)..(242): n is a, c, g, or t
tcagactgtacagtcacgaccggtgctcgatttagctgcgtcacgatctctcttgggggggtctcaggaggcagcgctctcgggacgtctccaccatggcctgggctctgctgttcctcaccctcctcactcagggcacagggtcctgggcccagtctgccctgactcagcctgcctcgtgtctggactcctggacagtcgtcaccatctcngcactggaaccnggccgtgactagttggtntacttaataactatgtctcctcggtaccccaaacaaccacccgaggaccaaccgacccccaaatcactctattatagatgtcagtctagtccggccctgtacggtagtttcccgtggtcgtcttcgtcgtcggcctcgaacgtctcggactaaccgtccggcccttcccacgtaaccctcgtcccgggttccggggccctcccggaggtccgtagggaacggaccggtacggttaccttaacgtttatttaggttaccgtatttaactttaccgaacttaaagaaacgtaacgtaaaccgtaaacccaaaccgtaacgtacgttacgggttcgggttaccggggtaccggggaaccgggtaaccggtaaacggttaccggtaacccggttacccggttccggtaaccggtaaccggaacccggtaaccggaccgtaccccggtacccccggttacccggtaccccg

SEQ ID NO: 311681 - DNA, 521 bp, Homo sapiens
  misc_feature: GZ8MTXP02G6TVN.25.36.D03.1.454.CMB.2.raw
  modified_base (307)..(307): a, c, t, g, unknown or other
  misc_feature (307)..(307): n is a, c, g, or t
  modified_base (354)..(354): a, c, t, g, unknown or other
  misc_feature (354)..(354): n is a, c, g, or t
  modified_base (366)..(366): a, c, t, g, unknown or other
  misc_feature (366)..(366): n is a, c, g, or t
  modified_base (377)..(377): a, c, t, g, unknown or other
  misc_feature (377)..(377): n is a, c, g, or t
  modified_base (381)..(381): a, c, t, g, unknown or other
  misc_feature (381)..(381): n is a, c, g, or t
  modified_base (440)..(440): a, c, t, g, unknown or other
  misc_feature (440)..(440): n is a, c, g, or t
  modified_base (472)..(472): a, c, t, g, unknown or other
  misc_feature (472)..(472): n is a, c, g, or t
tcagactgtacagtcacgaccggtgctcgatttagctgcgtcacgatctctcttggggagctctgagagcggagccccagccccagaattcccaggtgttttcatttggtgatcagcactgaacacagaggactcaccatggagtttgggctgagctgggttttccttgttgttattttccaggtgtccagagtgaggtgcagttggtggagtcgtgggggagcttggtccagcctgggagggtccgtgagagtctcctgtgcagcctctggattcatcttcagtgaccatacatggactgggtccncaggctcgaggggagggctggagtgggttgcccgtatagaaataagntaagagtcacanagaatacgcgngtcngtagaaaggcagattcattatctacaagagtatagaattacaaaagtactcactgtaanctagacaaatgaaacagacctaagaaaaccgngacaccggacgtgtaactacgtgaagctaggtcagactacggttcaacc
